United States Patent 11,981,905 (POLYNUCLEOTIDE SEQUENCES AND PROTEINS ENCODED THEREBY USEFUL FOR MODIFYING PLANT CHARACTERISTICS) - sequence listing, part 9

SEQ ID NO: 23408 - protein, 128 aa, Panicum virgatum
  misc_feature: Ceres CLONE 1827607
  misc_feature: Useful for making plants with altered cell wall content and/or composition
MRECISIHMGQAGIQVGNSCWELYCLGHGIQADERMRGDKTSGGGDDAFDTFFRETGAGKRVPRAVFVDVEPTVIDEVRTGAYRRLFHPEQLISGKDDAANRFARGDYTIGNDIAELGLDRIGQLGDN

SEQ ID NO: 23409 - DNA, 383 bp, Panicum virgatum
  misc_feature: Ceres CLONE 1827619
  misc_feature: Encodes the peptide sequence at SEQ ID NO. 23410
atcgacgcgaggccccatcggtcgcgttcccgtcggcgagagcgagcgcagcatccgcaccgcgccagcagcatggccgcgccgccgctgctccggcattggccccgcctcgccgtgatcggcgccgtcctcgcgctccacctcgccgccgccgccgcgcagtcgccagcgacgcctgccgcgcccacgaccccggccgcgccgacgacaccggctgcacccacgacccccgctgcgccgaccacccctgctgcacccacgacaccggctgcacccaccacaacggctgcgccgacaacacctgctgcgcccaccacaccggctgcaccgacaacgcaggcaaccactgcgcccacctcgacgccgaccacgccgagcactac

SEQ ID NO: 23410 - protein, 103 aa, Panicum virgatum
  misc_feature: Ceres CLONE 1827619
  misc_feature: Useful for making plants with altered carbohydrate content
MAAPPLLRHWPRLAVIGAVLALHLAAAAAQSPATPAAPTTPAAPTTPAAPTTPAAPTTPAAPTTPAAPTTTAAPTTPAAPTTPAAPTTQATTAPTSTPTTPST

SEQ ID NO: 23411 - DNA, 664 bp, Panicum virgatum
  misc_feature: Ceres CLONE 1827623
  misc_feature: Encodes the peptide sequence at SEQ ID NO. 23412
tgccatacttaatgctcttcttatgatgtatactgccactgggaactttgataggactatacaagtatatcaaagtattctggaagctggcttagagccggatgaggacacatacaatactttgatagtaatgtattgtagaaacttgaggccagaagaaggttttacattattgaatgaaatgggtaaacgaggtctgacaccaaagttgcaatcctacaaaagcttgcttgctgcatctgcaaaagcggaattgagggagcaagctgaccagctttttgaagaaatgagatcgaagggttatcaattaaaccgatctgtatatcacatgatgatgaaaatttacaggaacgctggcaaccactccaaagctgagaacttgctagcagtaatgaaagaggatggcattgagccaacaattgccactatgcatatcctcatgacttcttatgggactgctgggcacccacatgaagctgagaatgtactgaatagtttgaaatcctccagtttggaagtcagcacgctaccatacagtactgtcttcgatgcttacctgaaaaatggtgattatgagcttggtatcacaaaactgctggaaatgaaaagagatggtgtaaaaccagatcatcaagtttggacatgtttcattagggctgctagt

SEQ ID NO: 23412 - protein, 220 aa, Panicum virgatum
  misc_feature: Ceres CLONE 1827623
  misc_feature (36)..(70): Pfam Name: PPR Pfam Description: PPR repeat
  misc_feature (176)..(210): Pfam Name: PPR Pfam Description: PPR repeat
  misc_feature (106)..(140): Pfam Name: PPR Pfam Description: PPR repeat
AILNALLMMYTATGNFDRTIQVYQSILEAGLEPDEDTYNTLIVMYCRNLRPEEGFTLLNEMGKRGLTPKLQSYKSLLAASAKAELREQADQLFEEMRSKGYQLNRSVYHMMMKIYRNAGNHSKAENLLAVMKEDGIEPTIATMHILMTSYGTAGHPHEAENVLNSLKSSSLEVSTLPYSTVFDAYLKNGDYELGITKLLEMKRDGVKPDHQVWTCFIRAA

SEQ ID NO: 23413 - DNA, 522 bp, Panicum virgatum
  misc_feature: Ceres CLONE 1827627
  misc_feature: Encodes the peptide sequence at SEQ ID NO. 23414
atcttccccaccactccgcaagctcgctcatctgctggcctcctcccgaccctttccgccattcgagcttcttcttgcttcctggtgcaggtctgggttggcctgcgtggacaggcggcgagcgagccatggagatggccggcgtggcggccgcggcggacagcccgggcgcggcggcggcgcggccgagccggtacgagtcgcacaagcggcgggactggcagacgatcgggcagaacctgcgcaaccaccggccgccgctggagctggcccggtgcagcggtgcgcacgtgctcaagttcctccgctacctggaccagttcagcaagaccaaagtgcacgcgccagggtgccccttcttcggccacccgtcgccgccggcgccgtgcccgagcccgctcaagcaggcgaggggcagcctggacgcgcacgtcggccgcctccgcgccgccttcgaggagcacggcggccgccccgaggccaatccgttcggggcgcgcgccgtccggctctacctccgcg

SEQ ID NO: 23414 - protein, 131 aa, Panicum virgatum
  misc_feature: Ceres CLONE 1827627
  misc_feature: Useful for making plants with modulated low light sensitivity
  misc_feature: Useful for making plants with modulated nitrogen use efficiency
  misc_feature: Useful for making plants with modulated flowering time
  misc_feature: Useful for making plants with modulated biomass
  misc_feature: Useful for biocontainment applications
MEMAGVAAAADSPGAAAARPSRYESHKRRDWQTIGQNLRNHRPPLELARCSGAHVLKFLRYLDQFSKTKVHAPGCPFFGHPSPPAPCPSPLKQARGSLDAHVGRLRAAFEEHGGRPEANPFGARAVRLYLR

SEQ ID NO: 23415 - DNA, 249 bp, Panicum virgatum
  misc_feature: Ceres CLONE 1827651
  misc_feature: Encodes the peptide sequence at SEQ ID NO. 23416
ctgcccgcacccacccaacccaagttacccaaccaaccgcgcttgtttgtgtacactccactagtcccacccagctagcgccccctcctcatccagctccgcccaagccaggcatcagccagccaagaagcagagcagcgtccatggcggcggcgctgcggcgggccctgtccgcggcggtggcggtggcgctgctggcggcgccgtcggcgtcggcggactcgtggctgtacgagaagttcacccccg

SEQ ID NO: 23416 - protein, 35 aa, Panicum virgatum
  misc_feature: Ceres CLONE 1827651
  misc_feature: Useful for making plants with altered carbohydrate content
MAAALRRALSAAVAVALLAAPSASADSWLYEKFTP

SEQ ID NO: 23417 - DNA, 679 bp, Panicum virgatum
  misc_feature: Ceres CLONE 1827660
  misc_feature: Encodes the peptide sequence at SEQ ID NO. 23418
acagtacaccaccgctccctcccctctctctgtcggtctcctccgctccgcggctctgcgccggccgcctgcgcctcctccgcctcctctttaaaagcgcggcagagctccccctccgctcccaccccgttcccgtggcgtgccttctagggtttccttcgttcccccgcctccccgcgccgctccctcccgcccgccagatttggatctgcgctccagcctcaggttgttctgatggctcccgctgtagaagctgtgaaggaggcaggctcattccaaaaggttcctgctttgaatgaaagaatactgtcatccatgtccaggagatctgttgctgcgcacccttggcatgatctggagattggccctggtgcaccaaccatattcaactgtgtcattgagatacccaggggcagcaaggtgaagtacgaacttgacaagaaaactggactgataaaggtggaccgtgtgctgtattcatcagttgtgtaccctcacaactatggattcattcctcgcacactttgtgaagacaatgaccctctggatgtgctggttataatgcaggagccagttattccaggctgtttccttcgggcaaaggccatcggccttatgcctatgattgatcagggagaggctgatgataagatcattgctgtgtgcgccgatgatcctg

SEQ ID NO: 23418 - protein, 148 aa, Panicum virgatum
  misc_feature: Ceres CLONE 1827660
  misc_feature (52)..(148): Pfam Name: Pyrophosphatase Pfam Description: Inorganic pyrophosphatase
  misc_feature: SWISSPROT Homolog: EC 3.6.1.1 Inorganic diphosphatase
  misc_feature: Useful for making plants with modulated nitrogen use efficiency
MAPAVEAVKEAGSFQKVPALNERILSSMSRRSVAAHPWHDLEIGPGAPTIFNCVIEIPRGSKVKYELDKKTGLIKVDRVLYSSVVYPHNYGFIPRTLCEDNDPLDVLVIMQEPVIPGCFLRAKAIGLMPMIDQGEADDKIIAVCADDP

SEQ ID NO: 23419 - DNA, 1008 bp, Panicum virgatum
  misc_feature: Ceres CLONE 1827678
  misc_feature: Encodes the peptide sequence at SEQ ID NO. 23420
ctctcaggccttccgcaatccccgactcccctcccccaacgccaacacgccgccgccgctcccctccctctgttcctccctcggattctagaataatgaccatctcccgccgccgcagtccatagtaacaacaccctgcatatcctctccactctctctcgtcctgcgctgcgcaatcgccaatcgggaggccacaccgacgaggaagcagggcaacgaagatggtccgggaggttgcggagagctgcgtcgacggggtggtcatggagatggtcgcggcctactgcggccgcttctacgccgccaagcccgagctcgctgcccgccgcatcgaggccatcggtttccaggtcggccaccagctctccgagagatataccatggagcgccctcgatttagtgatcatcttgaagcaatcaaatttatctgcaaagacttttggtcagagctgttcaagaagcagattgataatctgaaaacaaatcacaggggtacctttgtccttcaagataaccgtttccggtggcttactcgtgtttctctagatccatctgcagagagcacagatgcaactgacaatgactctgcaccattgggtgatactgcagcccaaacaacaagcatgcttctgtatttcccatgcgggttaataagaggtgccttgaccaacttaggaatttcgtgctccgtctctgcagatatgtcaaaccttccagcatgttcctttgtggtgcgcataaagacatgaactgtgagaaatgatacaagtacaatgttgaagtgctagcttatggttcaagtcatttgacacctaccggttttcagtgtctcggaatgacttttccttcttcccttcataaccttattccagagatcgggtgtaactcttatgtgatttttttcatctatcaaagtggagcactttcatgttccttttgtataaatcatatttggatgtagtcaatcataggtcctgtttgaaattcaggaacgtacgaatcctacat

SEQ ID NO: 23420 - protein, 175 aa, Panicum virgatum
  misc_feature: Ceres CLONE 1827678
  misc_feature (9)..(175): Pfam Name: TRAPP_Bet3 Pfam Description: Transport protein particle (TRAPP) component, Bet3
MVREVAESCVDGVVMEMVAAYCGRFYAAKPELAARRIEAIGFQVGHQLSERYTMERPRFSDHLEAIKFICKDFWSELFKKQIDNLKTNHRGTFVLQDNRFRWLTRVSLDPSAESTDATDNDSAPLGDTAAQTTSMLLYFPCGLIRGALTNLGISCSVSADMSNLPACSFVVRIKT

SEQ ID NO: 23421 - DNA, 247 bp, Panicum virgatum
  misc_feature: Ceres CLONE 1827679
  misc_feature: Encodes the peptide sequence at SEQ ID NO. 23422
aagaacgggaagggaaggagaagagaaggctctcggccataggtacagccagagggcagcagccaccaacacaggcctcacatgaaagctccatccgccatggcattctcgcccgccacggcctgctgtgaccccttggtgccggtggcgccccgggagccgcagcgcggctcctcggcccgcgcccaggcgctcatgtgcacgccctccgcctccgggtagccagacgtgcacgtccggccgcacg

SEQ ID NO: 23422 - protein, 40 aa, Panicum virgatum
  misc_feature: Ceres CLONE 1827679
  misc_feature: SWISSPROT Homolog: EC 1.11.1.15 Peroxiredoxin
MAFSPATACCDPLVPVAPREPQRGSSARAQALMCTPSASG

SEQ ID NO: 23423 - DNA, 481 bp, Panicum virgatum
  misc_feature: Ceres CLONE 1827680
  misc_feature: Encodes the peptide sequence at SEQ ID NO. 23424
atctctatcgaacagcagctacagctgccgatgaagaataaggggtgtgtcctatcctcctaccacatcaatggccgtgcgtaacggatgcggagtcttgggcgcggcggccttcctggggggcgtgcccgcgctgctgggcgccgccggggtggcggaggcggccgcgagcaagctcgaccacgtggtgcagccgagccgggccaaccaccacctggtgcacgacggcgacctcctcaagctccgcctcgacgccaactcgggcggccggctcctgtcccgcaccctgttcctctatggccaggacctcgccgacctcccgctcgtgccgggggactcccccggcgtagtcaccgctttttctttgtcgtctgccaccgacaagatccacgagctcgacttctacttcctggccaacgtgacccgccagccgcacctgctgcagacgaacctgtacgtcgactgtctgggcaaccgggag

SEQ ID NO: 23424 - protein, 136 aa, Panicum virgatum
  misc_feature: Ceres CLONE 1827680
  misc_feature: SWISSPROT Homolog: EC 2.4.1.207 Xyloglucan:xyloglucosyl transferase
MAVRNGCGVLGAAAFLGGVPALLGAAGVAEAAASKLDHVVQPSRANHHLVHDGDLLKLRLDANSGGRLLSRTLFLYGQDLADLPLVPGDSPGVVTAFSLSSATDKIHELDFYFLANVTRQPHLLQTNLYVDCLGNR

SEQ ID NO: 23425 - DNA, 1172 bp, Panicum virgatum
  misc_feature: Ceres CLONE 1827722
  misc_feature: Encodes the peptide sequence at SEQ ID NO. 23426
aaacccaaccctcccgcgagatctctctcgccggcctccaccgcctgctcagatccacctcgcccttgccggcgcgcgcctcacgccggcagccatgtcgcacaaccacggcgacacgatcccgctccacccgtcgtcggcgcagtccgacatggacgagatcgagagcctgatccacgccgcgccctcctcggccacggtactccccgcgcggccgccctccccgccgcgcgcctccatcccggtctcctcctccccggccccggcgcccgtcccttcgaagccccctctccccgctgcctccatcccgatctccgtctcccccgtgccgcccgcgtccgcctccgtttccgtccccatcggcgctgacggcttcggccctcagcccaacacgctcaccgagcccgtgtgggacaccgtcaagcgagacctcgcccgcatcgtcagcaacctcaagctcgtcgtcttcccaaacccctaccgcgaggaccccggcaaggcgctcagggactgggacctgtgggggcccttcttcttcatcgtcttcctcggtctcaccctctcctggtcggcctccgttaagaagtctgaagtatttgctgtggcatttgctgtcctggctgctggggcgataattttaactttaaatgttctgcttctgggtggacacatcatcttcttccaaagcctcagtcttcttggctattgcctgttcccactggatgtcggtgctctagtctgcatgctgaaggacaatgtcatacttaagattgtcgtggtggcaatcacattggcatggagctcctgggctgcgtatccattcatgagtgctgcagtcaacccaaggagaaaggctttggccctatatcctgtcttcctcatgtatatctcagttggtttccttataattgccatagattaatgaatgtggtgagcgttgtagtaacttctgaggtgtgagaatttcctcatcgatgatcgaaccacctgaatacatacaagtttgagtagacaaatattagtagggttactaccctcatggagtctgggaattgtctcgtggggattttggtcttaaatgggctggtggcatacggttttaaaattagctgagatctatgttgtaaaaggctcatacattggaccacttaattggatgtcaagcttttact

SEQ ID NO: 23426 - protein, 275 aa, Panicum virgatum
  misc_feature: Ceres CLONE 1827722
  misc_feature (109)..(256): Pfam Name: Yip1 Pfam Description: Yip1 domain
MSHNHGDTIPLHPSSAQSDMDEIESLIHAAPSSATVLPARPPSPPRASIPVSSSPAPAPVPSKPPLPAASIPISVSPVPPASASVSVPIGADGFGPQPNTLTEPVWDTVKRDLARIVSNLKLVVFPNPYREDPGKALRDWDLWGPFFFIVFLGLTLSWSASVKKSEVFAVAFAVLAAGAIILTLNVLLLGGHIIFFQSLSLLGYCLFPLDVGALVCMLKDNVILKIVVVAITLAWSSWAAYPFMSAAVNPRRKALALYPVFLMYISVGFLIIAID

SEQ ID NO: 23427 - DNA, 678 bp, Panicum virgatum
  misc_feature: Ceres CLONE 1827732
  misc_feature: Encodes the peptide sequence at SEQ ID NO. 23428
aggccactagcactgcagattctgtttccacgtggcgggacgccgccagcgccagctaggcgtccattgggaggaggagatctccccgcgttgggataagggatagggttgctcactcccttcacccaacgagcgccacacagctctgagccatatctcagctgctgggcccgtccctgagattttctcacacactgccccctccctgcaggatccaaagatcacaaactttaattgggccgtcacaagcaaacctcatctactatttttgcaggaaggaagagctagctccttgtgtgtgtgtgtgtgtgtgtgacaggaagagggtcgagatggctacggcgtacgctcccatggcgagccaggtgatgaagagcggcatggtgcactcgaggccgaggggcctctctggcgctgcgctgacgaggcggccacgcttcaccgtgaaggccatccagcctgagaagccaacgtaccaggtggtgcagcccatcaacggcgaccccttcatcggcagcctggagacgcccgtcacctcgagcccgctcgtcgcctggtacctctccaacctgccggcctaccgcaccgccgtgagcccgctgctccgcggcatcgaggtcggcctcgcgcacggctacctcctcgtcgggcccttcgcgctcaccggcccgctcccgc

SEQ ID NO: 23428 - protein, 115 aa, Panicum virgatum
  misc_feature: Ceres CLONE 1827732
  misc_feature (48)..(114): Pfam Name: PsaL Pfam Description: Photosystem I reaction centre subunit XI
MATAYAPMASQVMKSGMVHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLP

SEQ ID NO: 23429 - DNA, 609 bp, Panicum virgatum
  misc_feature: Ceres CLONE 1827743
  misc_feature: Encodes the peptide sequence at SEQ ID NO. 23430
gcgctcccccactcggattcgatcggattctttcttcctcggccggcgtccagcgcgggacggaacgagcctccaaatggcagccacgcgacggccggcgtcgggggcgaagcccaggggtggcggcggaggcgcggggaggaggagcgcgtggctggccgaggacgggagcaagcgctggggggaggcattcttcctgctctacacgcccttctggcttacgctctgcctcggcatcatcgtccccttcaagctctacgagaggttcacggagctggagtacctgattctcggattggtgtccaccgtgccggcgttcctcatccccctcttcctcgtagggaaggcagatagtgttagaagtttgaaagatcgatactgggtcaaggctaatatctggattataatttttagctatgttggtaactacttctggacacattacttcttcacggtccttggtgcttcgtatacttttccatcatggcggatgaataatgtaccccacacgacgtttctcctgactcatgcttgtttcctgttctatcatatggcgtcaaatatgacacttcgcagattacgtcactctatagctcacttaccacagtc

SEQ ID NO: 23430 - protein, 177 aa, Panicum virgatum
  misc_feature: Ceres CLONE 1827743
  misc_feature: SWISSPROT Homolog: EC 5.5.1.9 Cycloeucalenol cycloisomerase
  misc_feature: Useful for making plants with altered sterol content
MAATRRPASGAKPRGGGGGAGRRSAWLAEDGSKRWGEAFFLLYTPFWLTLCLGIIVPFKLYERFTELEYLILGLVSTVPAFLIPLFLVGKADSVRSLKDRYWVKANIWIIIFSYVGNYFWTHYFFTVLGASYTFPSWRMNNVPHTTFLLTHACFLFYHMASNMTLRRLRHSIAHLPQ

SEQ ID NO: 23431 - DNA, 107 bp, Panicum virgatum
  misc_feature: Ceres CLONE 1827743-R
tcctcctctccctttgcccgctggggctgcgccgggggggcttgttgtgccgtgtggggcggctgtggcttcgtggttctttgcgtgttgtgtctcgggtccttgcc

SEQ ID NO: 23432 - DNA, 1175 bp, Panicum virgatum
  misc_feature: Ceres CLONE 1827782
  misc_feature: Encodes the peptide sequence at SEQ ID NO. 23433
agcatcatctcaagaacccggacaaaaatctcgctcgcttcgacttgtgaaaccgctcaggtcggaacaaaaacctcccaaaaaaagggttcgaaaagcagatgataaagggccatcggatcatctcgaataaaaaaatttcgtttctttatctctgtgccgtgacggcggcggcgaccatggctgggctcgaagcggaagaggagaacccggcggcggcggcggcggagcttgcgggcggcgcggacgccagcttgaatgccttctttgaccacgcgggattggagttggcggcgggcggaggggggcaaggggcggaggaagaggaggagttggagtggctctcgaacatggacgcgttcccttcggtggagaccatggcggcggaggtggaggcggcgccgtcgcgtccttcggcggggctgggctgcctggaggcgctgccccatgtggtggggccgaggaccaaggggctgcggcggcggcggcgggtgacggcgccgtggagcgtcccgccggtgctgccccccgcgcccccgcccgccggcggcgctgcgccgcggcgccggtgcacgcactgcgcctcggaggagacgccgcagtggcggcagggccccgccgggcccagcacgctgtgcaacgcgtgcggcgtgcggttcaagtccggtcggctcttcccggagtaccgccccatgaacagccccaccttctccccgctgctgcactccaactcccaccgccgcgtcctggagatgcgccgccacgtggaggaggaggccgctgccggcggcggccgcgcgggcgccagggcccgccgcgccaagcgcgccgcggcgcgcgccgccgccgtcccccacggcaagtgatgcgaccagcaaccgccttccaccaagcgagaaatggtctttgctttctcggcgatggaggatggagatgattggggatcatgattattaccttcgctctccatcctcatctgcgtagtttgcgtttgcaattattagttttgttaggattgtaggattagaggttcaatagcagctgcagactgcagaagcgagaagagaatgtcatcgtgatcaacaaatttcctgctgtcctgcagccccagcagctgctgctgtaacagactcatggagacatggtgataagcttaagctttgtctgtcaggctc

SEQ ID NO: 23433 - protein, 228 aa, Panicum virgatum
  misc_feature: Ceres CLONE 1827782
  misc_feature (131)..(166): Pfam Name: GATA Pfam Description: GATA zinc finger
  misc_feature: The sequence is a functional homolog of SEQ ID NO 608 in the 10/374,780 US patent application
MAGLEAEEENPAAAAAELAGGADASLNAFFDHAGLELAAGGGGQGAEEEEELEWLSNMDAFPSVETMAAEVEAAPSRPSAGLGCLEALPHVVGPRTKGLRRRRRVTAPWSVPPVLPPAPPPAGGAAPRRRCTHCASEETPQWRQGPAGPSTLCNACGVRFKSGRLFPEYRPMNSPTFSPLLHSNSHRRVLEMRRHVEEEAAAGGGRAGARARRAKRAAARAAAVPHGK

SEQ ID NO: 23434 - DNA, 703 bp, Panicum virgatum
  misc_feature: Ceres CLONE 1827784
  misc_feature: Encodes the peptide sequence at SEQ ID NO. 23435
attttgagctcgtctcggtttctttcttgctctgctccgctgctgctgctgcttcttcttcatcatctccggtgggctgcgcgatggagacggcgttagcgctggcggccgccgtgctcctcttgtcctccacgctcgttgcttcagagttctgcgtgtgccggtccgaccagccgacggaggcgctgcagaaggtgatcgacttctcgtgcggcaacgacgcggactgctcgtccatcctgcagggcggcgggtgctacaaccccaacaacgtcgccgcgcactgctcctgggccgccaacagctactaccagaacaacaaggccaagggcgccacctgcgacttcggcggcgccgccaccatctccaccgccgaccccagtttctccgggtgcactttcccttcgactgccagtgcttccgggacggcgggcaccacgaccgtgggcggcgcgacgccgacgacgggcaccctgagccccggcgtgggcaccgggttcaacggtacggcggttgggaggcggcggcctgggcccggtgggcaccatggacagcgcttcggccggcctgctgctccccggcgccttcttcctcgccgccgccatcctctcgctcctagccctgcactagctccccctagctagctcctccgttctcagtagttcttggtccagtagttgttccttctctgaaccacgtcaag

SEQ ID NO: 23435 - protein, 186 aa, Panicum virgatum
  misc_feature: Ceres CLONE 1827784
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
METALALAAAVLLLSSTLVASEFCVCRSDQPTEALQKVIDFSCGNDADCSSILQGGGCYNPNNVAAHCSWAANSYYQNNKAKGATCDFGGAATISTADPSFSGCTFPSTASASGTAGTTTVGGATPTTGTLSPGVGTGFNGTAVGRRRPGPGGHHGQRFGRPAAPRRLLPRRRHPLAPSPALAPPS

SEQ ID NO: 23436 - DNA, 1125 bp, Panicum virgatum
  misc_feature: Ceres CLONE 1827833
  misc_feature: Encodes the peptide sequence at SEQ ID NO. 23437
cctctttgccgaaaccctaaccctactcgccgtggccgccctccccccggcgacgccgccatgtcgaacccgaagggctccaagatgctccagttcgtcaactaccgcatgcgggtgacgatccaggacggccgccagctcgttggcaagttcatggcgttcgaccgccacatgaacctcgtcctcggcgactgcgaggagttccgccgcctcccgccctccaagtcctccaagaccaccggcgaccgcgaggagcgccgcacgctcgggcttctcctcctccgcggcgaggaggtcgtctccatgaccgtcgagggcccgccgccgcctgacgagtcgcgcgccaaggccgccgcggctgggggtgccctcgccggcccgggtgtcggccgcgccgctggacgcggtgttccctctggcccgctcctccaggccgctccgggcctcgccggccctgttcggggcgtgggaggacccgcccccggcatgatgcagccccagatctcgcggccgccgatgcccaacctgtcggcgccgccggtggcgtacccgcaggttgtgcgaccgccgcaggggatgcctcctccgccaatgcggcctggaatgccgccgcagatgccgatgccgttccaacgtccgcctggggcgccgcctgctccgttccctggggcacccccacaacagttcatgaggggtcccccgccgatggggccgcctcagatcaggcccgggatgccgggtcctccacaccctggaatgaggcctgggatgcctccgccgccgttcggacagccgaggccagggatgccgcccccgccacctggcccgcagcagcctggacagaacccgccgcagtagcctcttacctgtgcaatcttggagacgcactatggaagattttcctatcgcgagaaaggatcgtaatcgcaccttggaagacctgtggaattccaagtagtttcgttttggtattgtgagagaagagaaccttgttagcgtgtactaatcatcctttgatgtgacttgtgaggggacttttgttctgatgcaatgtacgtaaagaggcgagggcctgttttaactgtttggatgttaagttaggaaatatggatagcttgtttcatc

SEQ ID NO: 23437 - protein, 265 aa, Panicum virgatum
  misc_feature: Ceres CLONE 1827833
  misc_feature (7)..(84): Pfam Name: LSM Pfam Description: LSM domain
MSNPKGSKMLQFVNYRMRVTIQDGRQLVGKFMAFDRHMNLVLGDCEEFRRLPPSKSSKTTGDREERRTLGLLLLRGEEVVSMTVEGPPPPDESRAKAAAAGGALAGPGVGRAAGRGVPSGPLLQAAPGLAGPVRGVGGPAPGMMQPQISRPPMPNLSAPPVAYPQVVRPPQGMPPPPMRPGMPPQMPMPFQRPPGAPPAPFPGAPPQQFMRGPPPMGPPQIRPGMPGPPHPGMRPGMPPPPFGQPRPGMPPPPPGPQQPGQNPPQ

SEQ ID NO: 23438 - DNA, 1150 bp, Panicum virgatum
  misc_feature: Ceres CLONE 1827862
  misc_feature: Encodes the peptide sequence at SEQ ID NO. 23439
cttctctcttgctcttcctccgcgcgtccaaaccccatcatcccaagttcccaacccaattcccagtttcccacacgcctgctgccgcggccccaaatctagtagcacggccgccgcggcttctgaggcggcaccggcgcttccggcgatggcctcctccaactccagctccgccgccgccgccgccgccgccgccgcctcggccgctgacgggggcgacgacctcgatcagctcctcgacagcgcgctcgacgacttcaccagcctcgatctctccgcctccgccgctcccaaaagcagcggcagcgaggcctccgcgtcggcgtcggggtcggggtcgggtgccaaggggccggtgcttgggctggggctggggctgccggaccccaaggccccgaagcggcgcggggcgaaggcgccgccgccgccgccgaggggcgagtgcgcgaaggaggcgctcgagaagctcacgcgcgagacgcgggaggcggtgcgcgggctcgagacggccaccgggggtgtcccgtcgctggacaacgaggccatgatggaggagttcgtcaagcagttcgaggagttcgcaggggcgcaggatatggactctattgttgaaacaatgatgcagcaacttttgtccaaggaaattcttcatgagcctatgaaagacattgtggaaaaatatccaaaatggcttgaggataacaaagataaaataagcaaagaagaatatgagcgttacaacaatcagctcgaactcatggtgaagcttattgaggtctatgaaaatgatcctgagaacatgactaagatttttgacatcatgcaaaacatgcaagaatgtggtcagccccccagtgatcttgttcaagatattgtacctgatctggacctgagcaagttgggacagctgtctcctgagatgcttgaatcagcaccaaattgttgtgtaatgtgatgaatgaagaattccattttggatgcaaattccatggagttttttttccttttttttctttacatttacgagcccccttttggcttctgtagcttaaagataattttcatctggataatgtgtaaagtctcacagttgtataatgatttaagtgttctttatgattctcaagtggaagttatgttctttcccgtc

SEQ ID NO: 23439 - protein, 268 aa, Panicum virgatum
  misc_feature: Ceres CLONE 1827862
  misc_feature (34)..(268): Pfam Name: Pex19 Pfam Description: Pex19 protein family
MASSNSSSAAAAAAAAASAADGGDDLDQLLDSALDDFTSLDLSASAAPKSSGSEASASASGSGSGAKGPVLGLGLGLPDPKAPKRRGAKAPPPPPRGECAKEALEKLTRETREAVRGLETATGGVPSLDNEAMMEEFVKQFEEFAGAQDMDSIVETMMQQLLSKEILHEPMKDIVEKYPKWLEDNKDKISKEEYERYNNQLELMVKLIEVYENDPENMTKIFDIMQNMQECGQPPSDLVQDIVPDLDLSKLGQLSPEMLESAPNCCVM

SEQ ID NO: 23440 - DNA, 574 bp, Panicum virgatum
  misc_feature: Ceres CLONE 1827867
  misc_feature: Encodes the peptide sequence at SEQ ID NO. 23441
gagaacctatcgattccctggtaggtgtctccgtctagcgctttccactcgatccgaactctatccccaccggtttcctctctccttttgctcctcttttcctcttccatggagggcaaggacgactcctactctcctctggtctggcgcgccgcagccaggggctcctgctcctcctgcggtgggccatccctcctcctccaccccccaggcgggccgagggggcccgccgccgatggttcctcccggcgcctctgggggcgcgccgcctaaatctcatgcgcggcgggggaggggccgtcggcgtcatccccactcaccggcgtcggggatcggggcgtataccacttcgcggccgacccggagacgctaccgctcaacgtactccatcgtgcacatgtgcgactcctcgactaccacggctcaggaatgagcatcatgcagatggatcaccgcgggaaggagttcgacgacgccatcaacaaggatgaggccgatctgcgcgcgctcctcgcggtgctcgaaagccacgtcgtactctttgtccagggaggcgctaccacgcagttcgcca

SEQ ID NO: 23441 - protein, 48 aa, Panicum virgatum
  misc_feature: Ceres CLONE 1827867
  misc_feature: SWISSPROT Homolog: EC 2.6.1.52 Phosphoserine transaminase
MSIMQMDHRGKEFDDAINKDEADLRALLAVLESHVVLFVQGGATTQFA

SEQ ID NO: 23442 - DNA, 1521 bp, Panicum virgatum
  misc_feature: Ceres CLONE 1827915
  misc_feature: Encodes the peptide sequence at SEQ ID NO. 23443
atcggcttcgcttcatcgcccatcgctaggcggcgcgccaacccccggattctgacacctcctctccccgctcgctcctatagatcccgtcccctttcccattccgcaccgagcaactcaaaaccctcctctcctctcctctcccacccacccacgatggccgccgccgccacatccactgctcactcactcctcctccagcgccccaccgcgccgagggctcccgccgccgccgcttcctccctgcgcctcccggcgcgcgccgccaagatctcctgcgcggcggtggcggcgccgtccgcgtcctcccccctcaccggcgccggggaccggggcgtctacaacttcgcggcgggcccggcgacgctcccgctcagcgtcctcaagcgggcgcaggcggagctcgtcgactaccacggctccgggatgagcatcatggagatgagccaccgcgggaaggagttcgacgccgccatcaagaaggccgaggccgacctgcgcgcgctcctcgcggtgcccgacacccacgccgtgctcttcctccagggcggcgccaccacgcagttcgccgccgtgccgctcaacctctgcgccggcccctccgaccccgccgacttcgtcgtctcggggtcctggagcgacaaggccttcaaggaggccaagaaattctccgccgcctccgccgcctggtccggcaaggacgccaagtacaccgccctcccgcccttcgacgacatcaagcagaacccggaggccaggttcctccacatctgctccaacgagactatccacggcgtcgagttcaaggactacccggagccccgcaacaagtccggcatcctcgtcgccgacatgtcctccaacttctgctccaagcccgtcgacgtctcccgcttcggcgtcatctacgccggcgcgcagaagaacgtcggcccctcgggggtcaccatcgccatcgtgcgcaaggacctcatcggcaacgcgcagcccatcaccccagtcatgcttgactacaagacgcacgccgacaacgcctcgctctacaacaccccgccctgcttcgccatctacatctgtggcctcgtcttcgaggacctgctcgcgcagggcggccttgcggaggtcgagaagaagaacgcctacaaggctggcatcctctacgacaccattgacgccagcagcgggtactacatctgccccttggagaagtcagtgcggtcgctgatgaacgtgcccttcactctggccaaggggccggactttgagaagcaattcatcgccgaggcggccaaggagggcatggtgcagctcaaggggcacaggtcagtcggcggagtgcgcgcatccatctacaatgccatgccgctggctggcgtggagaagcttgtcgcgttcatgaaggatttccaagctaggaacccttgattggcttgtgcttatgatcatttggtattgctactatttagcaggatgttttgttcttcataacataagtgagctttgtgcaagagctgctttgcc

SEQ ID NO: 23443 - protein, 422 aa, Panicum virgatum
  misc_feature: Ceres CLONE 1827915
  misc_feature (61)..(410): Pfam Name: Aminotran_5 Pfam Description: Aminotransferase class-V
  misc_feature: SWISSPROT Homolog: EC 2.6.1.52 Phosphoserine transaminase
MAAAATSTAHSLLLQRPTAPRAPAAAASSLRLPARAAKISCAAVAAPSASSPLTGAGDRGVYNFAAGPATLPLSVLKRAQAELVDYHGSGMSIMEMSHRGKEFDAAIKKAEADLRALLAVPDTHAVLFLQGGATTQFAAVPLNLCAGPSDPADFVVSGSWSDKAFKEAKKFSAASAAWSGKDAKYTALPPFDDIKQNPEARFLHICSNETIHGVEFKDYPEPRNKSGILVADMSSNFCSKPVDVSRFGVIYAGAQKNVGPSGVTIAIVRKDLIGNAQPITPVMLDYKTHADNASLYNTPPCFAIYICGLVFEDLLAQGGLAEVEKKNAYKAGILYDTIDASSGYYICPLEKSVRSLMNVPFTLAKGPDFEKQFIAEAAKEGMVQLKGHRSVGGVRASIYNAMPLAGVEKLVAFMKDFQARNP

SEQ ID NO: 23444 - DNA, 624 bp, Panicum virgatum
  misc_feature: Ceres CLONE 1827917
  misc_feature: Encodes the peptide sequence at SEQ ID NO. 23445
gttcagttaatccgcccccttcctctccccttccccctcgcctcctctcttctccacacacggcttcctcccctgcccccgctcctcaccatcaggccatcaccaccagttcaccaccaccaccaccaccaccaccaccaccactcctcttccgactcgcgcagccgcggaccgaggcgcccgcgcgagccctacctgactgccggaggcgggggcggcgcggcgcggcgcggcgatgacgcggcggtgctcgcactgcagccacaacgggcacaactcgcggacgtgccccaaccgcggggtcaagatcttcggggtgcgcctcaccgatggctcggccatccgcaagagcgccagcatggggaacctctccctcctctccgccggatccaccagcggcggcgcctcccccgccgacgggcccgacctcgccgacggcggcgggggctacgcatccgacgacttcgtccaggggtcctcctccgccagccgcgagcgcaagaagggtgttccttggactgaagaagaacaccggaggtttttgctgggattacaaaagcttggaaaaggtgattggcgaggcatttctcgtaatttcgtggtctcaaggacacccactcaagt

SEQ ID NO: 23445 - protein, 129 aa, Panicum virgatum
  misc_feature: Ceres CLONE 1827917
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
  misc_feature: The sequence is a functional homolog of SEQ ID NO 317 in the 11/479,226 US patent application
  misc_feature: The sequence is a functional homolog of SEQ ID NO 1023 in the 11/479,226 US patent application
  misc_feature: The sequence is a functional homolog of SEQ ID NO 440 in the 10/412,699 US patent application
  misc_feature: Useful for making plants with modulated nitrogen use efficiency
MTRRCSHCSHNGHNSRTCPNRGVKIFGVRLTDGSAIRKSASMGNLSLLSAGSTSGGASPADGPDLADGGGGYASDDFVQGSSSASRERKKGVPWTEEEHRRFLLGLQKLGKGDWRGISRNFVVSRTPTQ

SEQ ID NO: 23446 - DNA, 687 bp, Panicum virgatum
  misc_feature: Ceres CLONE 1827954
  misc_feature: Encodes the peptide sequence at SEQ ID NO. 23447
agttgcgaatgtccaaagcgttgtgcagtgtggtagcagtggcaatcggcgccggccggcatgggagcggagaaggacaagaaggtggaggtcaagacggccgtgtacaaggtgcacgtccactgcggccagtgcgcgcgcgacatccagacgcagttcaccgagttccaaggggttgaggaggtgaaggtggacgccggggcagggaaggtgacagtgaagggcttcgccttcgacgtcgagaagctcagggcgaaggtcgagaagggttgccggaagaaggtcgagctggttgttcctgccaagaaggatgacgtcgtcatcgaggtcaagaccaagaaggaggagttgaaggtcatcacagtaaaggtccccttgcattgccccgattgtgcagtcagggtcaaagagatcctcctggagcacaagagtatctacgaggccaagacggacctcggcaagaacacgtgcaccgtcgagggcaccatcgacgagaagaagctcgtcgagtacatctaccagagaacgcgcaagacgggcatcgtcgacaagatcgagaagaaggtgatcgtcaaggaggagaaggtggaggtgaagaagaaggacgagaagaaggaggccgtcaaggagaaggtcaaggaggtcgtcgccccctacttcatcccctgcacgcacccgcggttcgtc

SEQ ID NO: 23447 - protein, 208 aa, Panicum virgatum
  misc_feature: Ceres CLONE 1827954
  misc_feature (14)..(77): Pfam Name: HMA Pfam Description: Heavy-metal-associated domain
MGAEKDKKVEVKTAVYKVHVHCGQCARDIQTQFTEFQGVEEVKVDAGAGKVTVKGFAFDVEKLRAKVEKGCRKKVELVVPAKKDDVVIEVKTKKEELKVITVKVPLHCPDCAVRVKEILLEHKSIYEAKTDLGKNTCTVEGTIDEKKLVEYIYQRTRKTGIVDKIEKKVIVKEEKVEVKKKDEKKEAVKEKVKEVVAPYFIPCTHPRF

SEQ ID NO: 23448 - DNA, 1193 bp, Panicum virgatum
  misc_feature: Ceres CLONE 1827956
  misc_feature: Encodes the peptide sequence at SEQ ID NO. 23449
accctgttcccagcgcagcaggagaaaagaatcgtctcgtctcgtctcgtctcgtctattctcttcatccccgcagtacggattcccgaccaggttccagaaaaacccccgtccaattcgcgagatggcggagcagcccaacccccagccccaagtggaggagaaggaggtggtggtggagcagcagcagcaggcgccgaagagggcccccaagctgaggtacctggatttcgtccatgtggcggcggcgcaggccgtggtgtgcctggcggggctctacgggctcgccaagagccacgccggcccgctccgccccggcgtcgacgccgtcgagtccgcggtgaatggcgtcgtcggccccgtctacgatcgcttccacagcgtgcccctcgacgtcctcgccttcgtcgaccgcaaggtggatgacaccgtgcacgagctggacaagcacctccctggcgcgctgaaggccgcgtcggcgcaggcctacgcggtggcccgcggcatcccggaggtggcgcgcgagctggccgccgaggcgcagcagtccggcgtgaagggcgcggcccgcgcggcgctggccaaggtggagcccgaggccaaggacgtgtacgggcgcgtggagccggtggccagggacctgtacgtgcgctacgagcccgcggcggagcacctcgccgtctccacctggcgctcgctcaacggcctcccggtgttcccgcaggtcgcgcagatcgtcgtgcccaccgccgcgtactgggccgagaagtacaacaaggtgatcgccgccgcggccaaccagggctacactggagccaagtacctcccggccatccccaccgagcgcatcgccaaggtgttctcttcgtcgacgccggattcggagcctttggccgagacccagtagtgtgttgatgcctggagcgcgttagtatattaccctgccctgcctatggccctatggttacactctggattccccctcccctccaactgatctgaataagacagtgagaatccggggggctaaagatggtggtaatgttgtgctagatatggtgatggggcgctgtcatggtctcatggaccatgatgatgatgctgtactccagaagtccactagctctgctttgtgtggttctctgcttcttgctttttgtataaaatttcgttcgatgtcgcgatctcttgct

SEQ ID NO: 23449 - protein, 260 aa, Panicum virgatum
  misc_feature: Ceres CLONE 1827956
  misc_feature (22)..(250): Pfam Name: REF Pfam Description: Rubber elongation factor protein (REF)
MAEQPNPQPQVEEKEVVVEQQQQAPKRAPKLRYLDFVHVAAAQAVVCLAGLYGLAKSHAGPLRPGVDAVESAVNGVVGPVYDRFHSVPLDVLAFVDRKVDDTVHELDKHLPGALKAASAQAYAVARGIPEVARELAAEAQQSGVKGAARAALAKVEPEAKDVYGRVEPVARDLYVRYEPAAEHLAVSTWRSLNGLPVFPQVAQIVVPTAAYWAEKYNKVIAAAANQGYTGAKYLPAIPTERIAKVFSSSTPDSEPLAETQ

SEQ ID NO: 23450 - DNA, 479 bp, Panicum virgatum
  misc_feature: Ceres CLONE 1827958
  misc_feature: Encodes the peptide sequence at SEQ ID NO. 23451
agaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacgacgaggtcctcgagtccaagatcatcctcgatcgggagacccagaggtcccgcggcttcggcttcgtcaccttctcgagcgagcaggcgatgcgcgacgccatcgaggggatgaacggcgaggagctggacggccgcagcatcaccgtcaacgaggcccattcccgcggcggcccgcgctccggcggcggcggcggctacgggcgccgcgagggcggcggtggctacggcggcggcggcggcggcggcggctgcggtctcctcgagggcgcccccgccgggcatctgctccctgc

SEQ ID NO: 23451 - protein, 129 aa, Panicum virgatum
  misc_feature: Ceres CLONE 1827958
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYDEVLESKIILDRETQRSRGFGFVTFSSEQAMRDAIEGMNGEELDGRSITVNEAHSRGGPRSGGGGGYGRREGGGGYGGGGGGGGCGLLEGAPAGHLLP

SEQ ID NO: 23452 - DNA, 1430 bp, Panicum virgatum
  misc_feature: Ceres CLONE 1827960
  misc_feature: Encodes the peptide sequence at SEQ ID NO. 23453
gcagatccaatcgcaacttcgcaagttccaaagcttcccagccgaaaccctcccccgctcccataaaaaaaaaagaaaccctcccacgctgcgaccatgtctgccgccgtcgccgcccccgtcctgcgcgaggacgacagggggatcccccgatcccttcccctcctcgcggcgctcgtggaggcggaggcccgccgctacgccgccgccgtcgcctcccgacccgccgagaccggcctcgtccgcgccttccgcggcggcgcagcccccagggtccccatccgcgccttcctggagcggattcacctgctgacccggtcgatgccgtccacccgcggcatggtccggatcgacggcgcctgcttcgtgctcgccggcatctacctgactcgcttcgtccgcagccccgccggcagggaggcggggatcctggtggagccggccaccgcgcaccgcctggtggccgccgcgatcttcgtcggcgccaagttcggctgccacccgcccaggaggtggaccgcggtgttcgaggccagctcggaaggagcgatccgctccggcgagatggcgggcctcgagaaccgcttcctgcgcgctattgagttccgcctgttcgtggtcagccatgggttcgacgggttttgccagatcctagagcgggggcctcgggcgccaagcggcggctgcgcctgcaagaagaggcaggctgacgcggcggccggagaggaggacgagcgccgccgcgtccgcgctcgcctgccgccccctgtcgtcttgtccaattaggatttgaatttcaaattttgcattcaattcaattaagaattcttgtggttttagtttcttttgattgctcgtctgtctattttgctgcagatgtgcaaagctgcgagtagaagatctcccgggtggagaaggcgtcgtctagcgtccgatcagggttcagctgatcgtcaccggagtctagagtggagaggagtcaagcaaattttagcggctgttggctcagggaaagagtttattactagtacgtggttttcaagatttggagtcaataaaaagagcacagtaatgtgtgtgcaaagctacgagtagaagatctccaggttggagaaggcgtcgtctagcgtctgatcagggttcagctgatcgtcaccatagtctggagtggataggtggagaggagtcaagcaaattttagcggctgttggctcagggaaacagtttattactttatactgctggagctactgctaactcagtgagagtttattgtcctttagttctgtcagatgtcacttacaagtggagtactggatttacttgtgattaggatgttgttcttcattaccggatttctgtctaattcttttcttctgtgtaagactttcagatcaataaaagggggaataatgtgttgctctttctgc

SEQ ID NO: 23453 - protein, 229 aa, Panicum virgatum
  misc_feature: Ceres CLONE 1827960
  misc_feature (11)..(172): Pfam Name: Cyclin Pfam Description: Cyclin
MSAAVAAPVLREDDRGIPRSLPLLAALVEAEARRYAAAVASRPAETGLVRAFRGGAAPRVPIRAFLERIHLLTRSMPSTRGMVRIDGACFVLAGIYLTRFVRSPAGREAGILVEPATAHRLVAAAIFVGAKFGCHPPRRWTAVFEASSEGAIRSGEMAGLENRFLRAIEFRLFVVSHGFDGFCQILERGPRAPSGGCACKKRQADAAAGEEDERRRVRARLPPPVVLSN

SEQ ID NO: 23454 - DNA, 1032 bp, Panicum virgatum
  misc_feature: Ceres CLONE 1827970
  misc_feature: Encodes the peptide sequence at SEQ ID NO. 23455
acacggatccatccatctctcctttgctctttcccttcaattcaactcgtctcacagaactctttccgagagatcgagacaatccggcggagctaagcaacggcgatggcttttagcccgagggctcgcgtgctggcggcggggaggatcgacgatggcctggaggtgacgtggggggacgggcgcgggagcgtgtcgccggacggccaggtcctgacgctgtcgctggaccgcacctccggctccgggttccgctccagggacacctacctcttcgcgcgcgccgacgtgcagatcaagctcgtccccaacaactccgccggcaccgtcactaccttctacttcatctcggaggggccgtgggacgtccacgacgaggtggacctcgagttcctgggcaacgtgagcgggcagccctacacgctgcggcatcggcgcaccgccgacttccacacctactccatcgagtggacgcagcagcacatcctcgtgctggtggacgggacgccgatccgggagttcaagaaccacgcggaccgcggcgtggcgtacccgtcgacgcagcggatgcggctgtacggctcgctgtgggacgccgaagactgggccacgcagggcggccgcgtcaagacggactggtcgcaggcccccttcgcggcgcagtaccgcaacttcacggccgcggacgcctcctcctcctcggcgtcgccggcggcggcgggcgggtacgggcaggagatggacgcggcggcgcagcaggccatgaagtgggcgcgggacaactacatggtgtacgactactgcgccgacggcaagcggttcccgcagggcgtcccgcccgagtgctccatgccgtaaccgtagcgtagcgtccagatgggctaagagccggcgcgctttgattgcgaagtcgtcgatcggagggagcaagcattaggggcaggttacacgcatatgctaggttacagaatccattggtctcattcattgtttatatattcatcgacatcgattctttggtgtgaagaatac

SEQ ID NO: 23455 - protein, 250 aa, Panicum virgatum
  misc_feature: Ceres CLONE 1827970
  misc_feature (15)..(180): Pfam Name: Glyco_hydro_16 Pfam Description: Glycosyl hydrolases family 16
  misc_feature (195)..(247): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Useful for making plants with altered cell wall content and/or composition
  misc_feature: Useful for making plants with altered carbohydrate content
MAFSPRARVLAAGRIDDGLEVTWGDGRGSVSPDGQVLTLSLDRTSGSGFRSRDTYLFARADVQIKLVPNNSAGTVTTFYFISEGPWDVHDEVDLEFLGNVSGQPYTLRHRRTADFHTYSIEWTQQHILVLVDGTPIREFKNHADRGVAYPSTQRMRLYGSLWDAEDWATQGGRVKTDWSQAPFAAQYRNFTAADASSSSASPAAAGGYGQEMDAAAQQAMKWARDNYMVYDYCADGKRFPQGVPPECSMP

SEQ ID NO: 23456 - DNA, 1297 bp, Panicum virgatum
  misc_feature: Ceres CLONE 1827972
  misc_feature: Encodes the peptide sequence at SEQ ID NO. 23457
agggaaggaagcgaagcgagacagagagagagaaagaggaggggaattttgtagctagctagctagctagctgtgctagggtttgcttgctcatcgcctccctcctccccatcggctagggatagggcaagctatgatccccaactcgtcgtcccctcctctcctcgtattctgaatctcgttcgcaatcgaattcggattcgattgggagggcaccccaccccgctgccgcctacatactatggttcacgccccgcgccgcccatcgccgtcgtcctcctcgccgatgctccacaggaacctccgcgcgctcggccccggcttgaatcccttcgctcccttcggcatgggcaactactccctcgcttcctcctcccgctaatcatctccgccaatcctcctctcctccgattccgatctctccccgattgctgctgctgctgctgctgctaaatcccgtcccggctcgcgaatcgcctccccccatctgtttccttgctccattggtttggatctgagagccgacgcgggctacaagaatagcatggtgcaggtgcgcaggtcgctcagcatgacccgcctccggggctgccacgccgctgatgaccgtggctggaacccgctccatgttgccgctcgcaagggagacctcaaggaggtccgacgtctcctggatgaggggatgaatgtcaatgcacctgcatggggaccgaaatctccgggtgctaccccactccatctggctgctcggggtgggcatgttaaaatcatggatgaactactggagcgtggtgctaatattgatgctcgaacaaaaggggcctgtggctggacacctctacacattgctgccaaggaaaggaacaagaaagctgtgagattcctgattgagaatggtgcattcctgcctcctgagatgaacgatcacaggttcaatcctcccctccattactgttctggattagaatgggcgtatgagatgaagcgcatgcaagacgagagcgactcccctggcgagacctccttaagctcggacaactagatggaatttgagaagatggactgagggtcatcattgagctgcttgcttgatgtcgcaggaattgccacgttagcaagtacaatgcatgtagtctgctgcattgaatgattattgatgataccgtacatgtaattacccttttattgcattgtattcttgtgcttttgtaccggtacgtgtatctacatgtcgtatcttgggatacgcgtgaacatgttatatggccatctgggtattcattatttttgatcggtt

SEQ ID NO: 23457 - protein, 165 aa, Panicum virgatum
  misc_feature: Ceres CLONE 1827972
  misc_feature (59)..(91): Pfam Name: Ank Pfam Description: Ankyrin repeat
  misc_feature (94)..(126): Pfam Name: Ank Pfam Description: Ankyrin repeat
  misc_feature (22)..(54): Pfam Name: Ank Pfam Description: Ankyrin repeat
  misc_feature: SWISSPROT Homolog: EC 2.7.11.1 Non-specific serine/threonine protein kinase
MVQVRRSLSMTRLRGCHAADDRGWNPLHVAARKGDLKEVRRLLDEGMNVNAPAWGPKSPGATPLHLAARGGHVKIMDELLERGANIDARTKGACGWTPLHIAAKERNKKAVRFLIENGAFLPPEMNDHRFNPPLHYCSGLEWAYEMKRMQDESDSPGETSLSSDN

SEQ ID NO: 23458 - DNA, 629 bp, Panicum virgatum
  misc_feature: Ceres CLONE 1827973
  misc_feature: Encodes the peptide sequence at SEQ ID NO. 23459
ggccactagccactcgcttcgtccgttctcgctcatcagtcatcaccaccagagcaagctcttccgtgggcttcgccgctccgagcctccgacccgtcctctccgtccggcgatcgcagcgcgcggccggccgggcgggatagatggggcggtcgccgtgctgcgagaaggaggccgggctgaagaacggcccctggacgccggaggaggaccagaagctgctcgccttcatcgagcagcacggccacggctgctggcgctcgctgccggccaaggctgggctgcggcggtgcggcaagagctgccggctccggtggaccaactacctgcggccagacatcaagcggggcaagttcacgctccaggaggagcagaccatcatccagctccacgcgctcctcggcaacagtaaaaacgctgaccacgcatcgcgtccgcgtgcaatccgcaggtggtcggcgatcgcgacgcacctgcccaagcgcacggacaacgagatcaagaactactggaacacgcacctcaagaagcgcctcgccaagatgggcatcgaccccgtcacgcacaagccccgcgccgacgccggcggcgcctcgtccggcgcgcgctacagggccgccgcgcacctc

SEQ ID NO: 23459 - protein, 161 aa, Panicum virgatum
  misc_feature: Ceres CLONE 1827973
  misc_feature (15)..(62): Pfam Name: Myb_DNA-binding Pfam Description: Myb-like DNA-binding domain
  misc_feature (68)..(127): Pfam Name: Myb_DNA-binding Pfam Description: Myb-like DNA-binding domain
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 824 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 271 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 442 in the 10/412,699 US patent application
  misc_feature: Useful for making plants with altered carbohydrate content
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 569 in the 10/374,780 US patent application
  misc_feature: The sequence is a functional homolog of SEQ ID NO 1002 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1010 in the 11/435,388 US patent application
  misc_feature: The sequence is a functional homolog of SEQ ID NO 1004 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: Useful for making plants with altered cell wall content and/or composition
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1073 in the 10/374,780 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 58 in the 10/666,642 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 788 in the 11/435,388 US patent application
  misc_feature: The sequence is a functional homolog of SEQ ID NO 792 in the 11/435,388 US patent application
  misc_feature: Useful for biocontainment applications
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: Useful for making plants with modulated low light sensitivity
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 822 in the 10/412,699 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 836 in the 10/412,699 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 743 in the 10/666,642 US patent application
  misc_feature: Useful for making plants with altered terpenoid content
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 796 in the 11/435,388 US patent application
  misc_feature: The sequence is a functional homolog of SEQ ID NO 790 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: Useful for making plants with modulated biomass
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1917 in the 10/374,780 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1681 in the 10/374,780 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1572 in the 10/374,780 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 446 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 2178 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1564 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1566 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1692 in the 11/479,226 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: Useful for making plants with modulated flowering time
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
MGRSPCCEKEAGLKNGPWTPEEDQKLLAFIEQHGHGCWRSLPAKAGLRRCGKSCRLRWTNYLRPDIKRGKFTLQEEQTIIQLHALLGNSKNADHASRPRAIRRWSAIATHLPKRTDNEIKNYWNTHLKKRLAKMGIDPVTHKPRADAGGASSGARYRAAAH

SEQ ID NO: 23460 - DNA, 479 bp, Panicum virgatum
  misc_feature: Ceres CLONE 1828013
  misc_feature: Encodes the peptide sequence at SEQ ID NO. 23461
acgccggcccctgccacttgcacccaagcccccaaacacgctgcggcgctccctccccccactccgtctcccgcaatggcagcgccgccgctccagcccgtgccgccgcccgcggccgtgaacggcgacgcgttccgagtgggtttcatcggcccgggcaacctggccgagagcatcgcccgcggcgtcgcggcgtcgggcgtcctcccggcctccgccatctgcaccgcgccccaccgccgccccgagcgcggcacggccttcgcctccatcggcgcctgcctgctcgacaccaatgcccaggtcgacggcgacagtgatgtgattgtcatctccgtcaagcctcagaccgtaaagtatgctcttcttgaactgcagccactgctgtcagatgaaaagcttctggtgtctattgctgctggcgtcaagatgaaagacttccaggattggtctggacaacggagaattattacagtaac

SEQ ID NO: 23461 - protein, 134 aa, Panicum virgatum
  misc_feature: Ceres CLONE 1828013
  misc_feature: SWISSPROT Homolog: EC 1.5.1.2 Pyrroline-5-carboxylate reductase
  misc_feature: Useful for making plants with modulated drought sensitivity
MAAPPLQPVPPPAAVNGDAFRVGFIGPGNLAESIARGVAASGVLPASAICTAPHRRPERGTAFASIGACLLDTNAQVDGDSDVIVISVKPQTVKYALLELQPLLSDEKLLVSIAAGVKMKDFQDWSGQRRIITV

SEQ ID NO: 23462 - DNA, 623 bp, Panicum virgatum
  misc_feature: Ceres CLONE 1828021
  misc_feature: Encodes the peptide sequence at SEQ ID NO. 23463
cattttatggattctgtggttctagatcaactcaatttcctttgcctaatgtgaaggacccttgccacaatggcagtcatcttgcaagcacttattctgcccttgctcttctgaagattttaggctacgatctagcaaatattgatagcaagtcacttttattgtctatgaaaaagctccaacaaccagatggaagcttcatgcctactcacattggtgcggaataggacctgcgctttgtgtactgtgcagctgcaatctgctcaatgctagatgactggacaggaatgaacaagctaaaggccaaggaatacatttttaactgccagtcatatgatggaggctttggcatggttcctggttccgaatctcatggtggaggaacttattgtgctgttgcagctctccatctaatgggctttgttcaagtcgatttggcatctaatttaagagaatctacatctattgacatacacatgctccttgattggtgtcttcagagacaagtgattgatggaggattccaagggagaataaacaagcccagtgacacctgctatgctttttgggttggtggtatcctaaagatcattggcgcttaccatttgattgatcattatgct

SEQ ID NO: 23463 - protein, 74 aa, Panicum virgatum
  misc_feature: Ceres CLONE 1828021
  misc_feature: SWISSPROT Homolog: EC 2.5.1.59 Protein geranylgeranyltransferase type I
FYGFCGSRSTQFPLPNVKDPCHNGSHLASTYSALALLKILGYDLANIDSKSLLLSMKKLQQPDGSFMPTHIGAE

SEQ ID NO: 23464 - DNA, 366 bp, Panicum virgatum
  misc_feature: Ceres CLONE 1828051
  misc_feature: Encodes the peptide sequence at SEQ ID NO. 23465
aagcagagcgaaccctgctgttagctaccccagccccccccaccggcagccagaccccagcagagccatggcgggggcggagccgccgctgcggtcgttcgtggaggtgccggccggctcccacttccccatccagaacctgcccttcggggtcctccgccggcgggggtcccgggcgcccccgcgccccgcggtggcaatcggggacctggcgctccacctcccccccctccccgacccccggctcttctaccggcccccgctcgccggctccccgtgcttccaccaggagaccctcaacatgttcttggggatgggccggcccggcgtggaaggaggcgcgccccccgctccctaaaatcctat

SEQ ID NO: 23465 - protein, 96 aa, Panicum virgatum
  misc_feature: Ceres CLONE 1828051
  misc_feature: SWISSPROT Homolog: EC 3.7.1.2 Fumarylacetoacetase
MAGAEPPLRSFVEVPAGSHFPIQNLPFGVLRRRGSRAPPRPAVAIGDLALHLPPLPDPRLFYRPPLAGSPCFHQETLNMFLGMGRPGVEGGAPPAP

SEQ ID NO: 23466 - DNA, 1329 bp, Panicum virgatum
  misc_feature: Ceres CLONE 1828053
  misc_feature: Encodes the peptide sequence at SEQ ID NO. 23467
attcatgcgccgtcgcagaaaaaaaaaaaagaaaagaaaaatagagtcccggcagagcggcgcagtcggctgtagtcgcagtcggccgccggccacgcgcgtggccgtgaaccctagatgacgccggcgaacggtgcggcagcgccagaagcggtggcggaggcagcgctggcccccgaggtggagtccgaggccgacgcgttccagcgccaggtcgacgacctcgtcgccaagaccgacgtgctggagaggcgggtgaacgaggtggtggacttctacgatggcaagaagcaaggcagcggcggccggaagggcggcaggcatggggcatacgggagggggatgcccgacattatgcgccagttcggcgtgattttacgagagatcaccgatgataatgatgcatggccatttcgggagccagtggatgttgtgggactgaaccttcatgactattacaagattattaccaaacctatggacttctctactattcaaaataaaatggaagggaaggatgttaccacttacaaaaatgttcgagaaatatatgcagatgttagattaatttttgccaacgcaatgacgtacaatgatgatgagaatattgtccacttgcttgctaaatcattgcttgagaaatttgaagagaagtggcggcaatttcttcctaaagttgagagtgaggaaaaaagacaaaaggaagaggaatcaaagggtgttgtagccaccaatacttctcgagaagcagcaattgcaaagttagcaaaagatactgatgaggagctgaatcagatcaataaacagctggaggaactccggaaaatggtggtcaacagatgcaggaaaatgaccacagatgagaagaggaaactgggtgcaggtctctgccacttgtctccagacgatcttaacaaggcactagaaattgttgcacaagacaacccaagcttccaaattaaagcagaagaagtggatctcgacatggatgctcagagcgagacaacactgtggaggctgaaattctttgtgcgggaagcgctggaaagacaggccaatgctgcttctgggaagatggatgagaacgccaagagaaagagggaaatatgcaatgccctggccaaaactgcttcaaaacgaatcaagaagcagccttagcagtccagacctttctttgactgccactgattgttcagaatgtttttgaagtaggagtagccttggtaaaacaatctttgcccttttgtgtgcagtggtcgtgtacatagtatgcattggtcagtaactcgtgagtgtttcgaaattgcaaaatgtcaggtgattgcttcc

SEQ ID NO: 23467 - protein, 346 aa, Panicum virgatum
  misc_feature: Ceres CLONE 1828053
  misc_feature (79)..(171): Pfam Name: Bromodomain Pfam Description: Bromodomain
  misc_feature: SWISSPROT Homolog: EC 2.3.1.48 Histone acetyltransferase
MTPANGAAAPEAVAEAALAPEVESEADAFQRQVDDLVAKTDVLERRVNEVVDFYDGKKQGSGGRKGGRHGAYGRGMPDIMRQFGVILREITDDNDAWPFREPVDVVGLNLHDYYKIITKPMDFSTIQNKMEGKDVTTYKNVREIYADVRLIFANAMTYNDDENIVHLLAKSLLEKFEEKWRQFLPKVESEEKRQKEEESKGVVATNTSREAAIAKLAKDTDEELNQINKQLEELRKMVVNRCRKMTTDEKRKLGAGLCHLSPDDLNKALEIVAQDNPSFQIKAEEVDLDMDAQSETTLWRLKFFVREALERQANAASGKMDENAKRKREICNALAKTASKRIKKQP

SEQ ID NO: 23468 - DNA, 670 bp, Panicum virgatum
  misc_feature: Ceres CLONE 1828063
  misc_feature: Encodes the peptide sequence at SEQ ID NO. 23469
gaacacgccggccgcggccgcctccaccagacgcgcccgcaccttgctctgctgcgccggcgattccccgccgccagaggcgaagttccgtttcccgttcgcgccggtcccctgcccgccgccatgacagagtactgggtgagccagggaaacaaatggtgtgacttctgcaagatttttatagccaataatccctttagcatcagaacgcatgaacttggtaagcgtcacaaggacaatgtcagcaaaagattgtcaacgatgcaaaaggagagtgatgcaaaggacaaggaacagcagcaagctgcccgagcccttcagcagatagaagcaaaagctaaaaagagctatcaaaaggatttggagaatagccagaggaatgtggatggagacacttctgcagcacctggagatggatgggtatttgactcaacatcaggatactactatgacaaatctactggacttcactacgattcaaactccggcttctattattctgatggtttagggaaatgggttactcaagaagaggcgtacaaatctgtgcaaacttccaaaacagatgttggtcaatcctcaacatcacaaacaaaagctcctgctgcagaaacggctgttccggctattaaaggaggtccagctccaggtcgggttgtcacaaagccac

SEQ ID NO: 23469 - protein, 182 aa, Panicum virgatum
  misc_feature: Ceres CLONE 1828063
  misc_feature (8)..(44): Pfam Name: zf-U1 Pfam Description: U1 zinc finger
MTEYWVSQGNKWCDFCKIFIANNPFSIRTHELGKRHKDNVSKRLSTMQKESDAKDKEQQQAARALQQIEAKAKKSYQKDLENSQRNVDGDTSAAPGDGWVFDSTSGYYYDKSTGLHYDSNSGFYYSDGLGKWVTQEEAYKSVQTSKTDVGQSSTSQTKAPAAETAVPAIKGGPAPGRVVTKP

SEQ ID NO: 23470 - DNA, 1136 bp, Panicum virgatum
  misc_feature: Ceres CLONE 1828067
  misc_feature: Encodes the peptide sequence at SEQ ID NO. 23471
ggatacccgaacacgccggccgcctctaccagacgcgcccgcaccttgctcggctgctccggcgattccccgccgccagaggcgaagttccgtttcccgttcgcgccggtcccctgcccgccgccatgacagagtactgggtgagccagggaaacaaatggtgtgacttctgcaagatttttatagccaataatccctttagcatcagaacgcatgaacttggtaagcatcacaaggacaatgtcagcaaaagattgtcaacgatgcaaaaggagagtgatgcaaaggacaaggaacagcagcaagctgcccgagcccttcagcagatagaagcaaaagctaaaaagagctatcaaaaggatttggagaatagccagaggaatgtggatggagacacttctgcagcacctggagatggatgggtatttgactcaacatcaggatactactatgacaaatctactggacttcactacgattcaaactccggcttctattattctgatggtttagggaaatgggttactcaagaagaggcgtacaaatctgtgcaaacttccaaaacagatgttggtcaatcctcaacgtcacaaacaaaagctcctcctgctgcagaaacggctgttccggctattaaaggaggtccagctccaggtcgggttgtcacaaagccactgaacctgatgagacctatcaagggtgctcctgctccgtcagtggttgctgctaacaagaggaagagggaggacaaaaagcctaaggtgatctccaaggaggaggaagcggctctcaaagcctgggaagcagccaggaagagagtagaggatagagagaagccactgatgggattatacagaacttactgaggcgtctgctgtccttcctagactattctccccatatggcccaaacgattgcactacctgatgttgtaagaaacgttgacaaatgctgttcattgagagaacgggcagggtttcaaagaagcaactcgtttgcaatatgcgtcaaccgtgtgtgcctgtctgcctgtacaatgcctaagcggttcttgcgtgggccgagttccctgctgcagatgtaaaaggatatgttcacatcgtttttcacaaatggatagtgtggcgtgtgctccg

SEQ ID NO: 23471 - protein, 246 aa, Panicum virgatum
  misc_feature: Ceres CLONE 1828067
  misc_feature (8)..(44): Pfam Name: zf-U1 Pfam Description: U1 zinc finger
MTEYWVSQGNKWCDFCKIFIANNPFSIRTHELGKHHKDNVSKRLSTMQKESDAKDKEQQQAARALQQIEAKAKKSYQKDLENSQRNVDGDTSAAPGDGWVFDSTSGYYYDKSTGLHYDSNSGFYYSDGLGKWVTQEEAYKSVQTSKTDVGQSSTSQTKAPPAAETAVPAIKGGPAPGRVVTKPLNLMRPIKGAPAPSVVAANKRKREDKKPKVISKEEEAALKAWEAARKRVEDREKPLMGLYRTY

SEQ ID NO: 23472 - DNA, 476 bp, Panicum virgatum
  misc_feature: Ceres CLONE 1828098
  misc_feature: Encodes the peptide sequence at SEQ ID NO. 23473
agtcccccggcccagcccgcgaccgaagaaccgagccccccggaccggccgcggccaacccccgccgagctccgctccatcctggatccggagatgggccaccgctactgggaggagaccccgcgccacctccagtaccaggagccccgcctctacctggaggcgcaggaggaccccctgtcctgctaccactcccgctcgccggacgggtcccactccccttcctccctcggctcccgcaggtgatggtaagggagccggcagcggcggcgccggccgcgccgcggatggggcccacaagaacatcatcatggagcgcgaccgccgccgcaagctcaacgagaagctctacgcgctgcgcagcgtcgtgccccacatcaccaaggtcagtttcagttgctgatcgtggccgcccagcggcattgccggcggcgagcagagcttgttccaagttctgacgacggggagcactggca

SEQ ID NO: 23473 - protein, 30 aa, Panicum virgatum
  misc_feature: Ceres CLONE 1828098
  misc_feature: The sequence is a functional homolog of SEQ ID NO 1195 in the 11/479,226 US patent application
  misc_feature: The sequence is a functional homolog of SEQ ID NO 538 in the 10/412,699 US patent application
  misc_feature: Useful for making plants with modulated biomass
  misc_feature: Useful for making plants with modulated flowering time
  misc_feature: The sequence is a functional homolog of SEQ ID NO 744 in the 10/412,699 US patent application
  misc_feature: Useful for making plants with altered lignin content
  misc_feature: The sequence is a functional homolog of SEQ ID NO 1177 in the 11/479,226 US patent application
  misc_feature: The sequence is a functional homolog of SEQ ID NO 528 in the 10/412,699 US patent application
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: The sequence is a functional homolog of SEQ ID NO 2366 in the 10/374,780 US patent application
  misc_feature: The sequence is a functional homolog of SEQ ID NO 928 in the 10/225,066 US patent application
  misc_feature: The sequence is a functional homolog of SEQ ID NO 148 in the 10/225,068 US patent application
  misc_feature: The sequence is a functional homolog of SEQ ID NO 216 in the 10/374,780 US patent application
  misc_feature: The sequence is a functional homolog of SEQ ID NO 228 in the 10/225,066 US patent application
  misc_feature: The sequence is a functional homolog of SEQ ID NO 56 in the 10/286,264 US patent application
  misc_feature: The sequence is a functional homolog of SEQ ID NO 714 in the 10/412,699 US patent application
  misc_feature: The sequence is a functional homolog of SEQ ID NO 862 in the 11/435,388 US patent application
  misc_feature: Useful for making plants with modulated cold sensitivity
  misc_feature: The sequence is a functional homolog of SEQ ID NO 108 in the 11/375,241 US patent application
  misc_feature: The sequence is a functional homolog of SEQ ID NO 2888 in the 10/374,780 US patent application
  misc_feature: The sequence is a functional homolog of SEQ ID NO 1238 in the 10/412,699 US patent application
  misc_feature: The sequence is a functional homolog of SEQ ID NO 943 in the 10/374,780 US patent application
  misc_feature: Useful for biocontainment applications
  misc_feature: The sequence is a functional homolog of SEQ ID NO 116 in the 10/374,780 US patent application
  misc_feature: The sequence is a functional homolog of SEQ ID NO 386 in the 10/412,699 US patent application
  misc_feature: The sequence is a functional homolog of SEQ ID NO 596 in the 10/225,066 US patent application
  misc_feature: The sequence is a functional homolog of SEQ ID NO 894 in the 11/479,226 US patent application
  misc_feature: The sequence is a functional homolog of SEQ ID NO 184 in the 10/666,642 US patent application
  misc_feature: The sequence is a functional homolog of SEQ ID NO 1842 in the 10/412,699 US patent application
  misc_feature: The sequence is a functional homolog of SEQ ID NO 2082 in the 10/374,780 US patent application
  misc_feature: The sequence is a functional homolog of SEQ ID NO 746 in the 10/412,699 US patent application
  misc_feature: The sequence is a functional homolog of SEQ ID NO 158 in the 10/225,068 US patent application
  misc_feature: The sequence is a functional homolog of SEQ ID NO 2692 in the 10/374,780 US patent application
  misc_feature: The sequence is a functional homolog of SEQ ID NO 446 in the 11/435,388 US patent application
MERDRRRKLNEKLYALRSVVPHITKVSFSC

SEQ ID NO: 23474 - DNA, 647 bp, Panicum virgatum
  misc_feature: Ceres CLONE 1828099
  misc_feature: Encodes the peptide sequence at SEQ ID NO. 23475
gcactaatatctttcaatacgttgtaggttgtggcccttaaagttattcccaataaacagactggacagtctgaaggatatggatttgttgagttctaccgccctgctgcagctgaaaaagttcttgaaggtttttctggtcatataatgcccaatactgaccaaccttttaggttaaattgggcatcatttagcatgggagataggcgctcggatgttgcttcagatcattccatattcgtaggcgatcttgcttctgatgtcaatgatgctacacttctggagactttctccagcaggtactcctctgtcaaaggtgccaaagttgttattgatgctaacactggcagatccaagggctatggtttcgtgagatttggagatgacagtgagaagacacatgccatgactgagatgaatggtgtatattgctcttctaggcccatgagaattggccctgcaactcccagaaaatcatcaggtacttctggatcaaatggttcatctgcccgttcagatggaggagacttgacaaacacaactgtatttgtcggcgggctcgacccaaatgttagtgaagaggaccttaggcagaccttctcccagtatggcgaaatatcttctgtaaagattccagtcggtaaaca

SEQ ID NO: 23475 - protein, 166 aa, Panicum virgatum
  misc_feature: Ceres CLONE 1828099
  misc_feature (30)..(102): Pfam Name: RRM_1 Pfam Description: RNA recognition motif. (a.k.a. RRM, RBD, or RNP domain)
  misc_feature: Useful for making plants with altered terpenoid content
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MPNTDQPFRLNWASFSMGDRRSDVASDHSIFVGDLASDVNDATLLETFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGK

SEQ ID NO: 23476 - DNA, 810 bp, Panicum virgatum
  misc_feature: Ceres CLONE 1828105-R
  misc_feature: Encodes the peptide sequence at SEQ ID NO. 23477
gcccccgagctacctcaccggcgagttccccggtgactacggctgggacaccgcggggctgtccgctgaccccgagaccttcgccaagaaccgcgagctggaggtcatccactcccggtgggccatgctcggcgcgctcggctgcgtcttccccgagctgctcgctcgcaacggcgtcaagttcggcgagtccgtctggttcaaggccggctcccagatcttcagcgagggcggcctcgactacctcggcaaccccagcctcatccacgcccagagcatcctcgccatctgggccgtccaggtcgtgctcatgggcgccgtagagggctaccgcattgccggcggcccgctcggcgaggtcgtcgacccgctctaccccggcggcagcttcgaccccctcggcctggctgacgaccccgaggccttcgccgagctcaaggttaaggagctcaagaacggccgcctcgccatgttctccatgttcggattcttcgtccaggccatcgtcaccggcaagggcccgctcgagaacctcgccgaccacctcgccgacccggtcaacaacaacgcctgggcctacgccaccaacttcgtccccggcaactaagctccgatccattggcaatgcaacttcattgtcttccggagggggcgtacgtggatccattgatgctgcaagctgccgcgtgtgcgtctcttgtttcacgttgcatttcaggggcaagtcgagatgatgagttgccgttgtacactaagatgaacgatgatgcttgtgcaatagtagtggttttgttccttgttggttgatcg

SEQ ID NO: 23477 - protein, 201 aa, Panicum virgatum
  misc_feature: Ceres CLONE 1828105-R
  misc_feature (1)..(168): Pfam Name: Chloroa_b-bind Pfam Description: Chlorophyll A-B binding protein
PPSYLTGEFPGDYGWDTAGLSADPETFAKNRELEVIHSRWAMLGALGCVFPELLARNGVKFGESVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 23478 - DNA, 565 bp, Panicum virgatum
  misc_feature: Ceres CLONE 1828105
attcttgggggaaatagttttcctggatgaggtttcggaagggggggggggttattcttgaaatctttgacggcttggtgtttccccccgattaaacctgtctttgaaataatatactccttgcgggcttccaccatctagtaggtttgaaggcgaatttgttgaggcatcggaggctacattcaccagtgcaagcaaaattttggtttagagcaaaggatggcagcacagctagtctttttcagtgcttccaattgccaatgcccattaggcatttcaccgaaaaatgttaggaaggcacttcttggtgaaagtgcaagaatttttcagagaaacaagtggttttctagtggtccatatcgctcttctcgactggagtgctctgcaaactcccgtcgagtggggccacggcgtacgtggatccattgatgctgcaagctgccgcgtgtgcgtctcttgtttcacgttgcatttcaggggcaagtcgagatgatgagttgccgttgtacactaagatgaacgatgatgcttgtgcaatagtagtggttttgttccttgttggttg

SEQ ID NO: 23479 - DNA, 637 bp, Panicum virgatum
  misc_feature: Ceres CLONE 1828109
  misc_feature: Encodes the peptide sequence at SEQ ID NO. 23480
aagctgctccaggactggcttccctggaaggcctcggttgacacttgacaccagcaactcaaccattctccctgtgtcatcaccagcaacaggaagatggggtcgttagatgccacacgagctgagctcggcctcgttgttctgtacctgaacaaagccgaggctagggacaagatctgcagggcgattcagtacggctcaaagttcataagcaacgggcagcccggcaccgcgcaggatgtcgatagatccaccaccttagctcgaaaagttttccgtctcctcaagtgggtcaatgatcttcatgctcttatcagcccacctgctaaaggggctcctctcacactggtcctgcttggcaagtctaaaaatgcactgctttcgacgttcttattcctggatcaaattgtgtggttaggacgaacaggaattatcaagaacaaggaggcgacggaccgggttgccaggatatccctgtactgttggatggcttcttctgcctgtgttagtctagtcgagcttggagagcttaagaggctatcgaaatcaatgaggaagcttgcaagagagctgaggcacactgataaatacgagccacgcattttgcagaacgaacagtaccagaacaaaatgaagc

SEQ ID NO: 23480 - protein, 180 aa, Panicum virgatum
  misc_feature: Ceres CLONE 1828109
  misc_feature (11)..(178): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLLKWVNDLHALISPPAKGAPLTLVLLGKSKNALLSTFLFLDQIVWLGRTGIIKNKEATDRVARISLYCWMASSACVSLVELGELKRLSKSMRKLARELRHTDKYEPRILQNEQYQNKMK

SEQ ID NO: 23481 - DNA, 1661 bp, Panicum virgatum
  misc_feature: Ceres CLONE 1828112
  misc_feature: Encodes the peptide sequence at SEQ ID NO. 23482
aagcaagctccacctcagctcatctcccacctccaacctccgcctcgtcttcgaataccagtcactagcgaaagagggcaagatcgagagccgaggggtgaattcgctcaccactcacacaccatgccgtcccacgagaaggccctcgccgcggcggcgtcggccgcggcggccctcatgctggtgcgcagcgtggcgaacgagctgctgcccgacgaggtgcgcgacgcgctgcgctccggcgccagctacctgcgctcgcgcgtgtcctcgcggcacaccatcaccgtcgagaggaagctcgacaccttcacccacaaccatgtctacgaggccatccggacctacctcgcggggcacgcgaacataagggcgcagcaacacctgtgcgtcagcagcatggacgaggacgagaagatgacggtagccctagcggacggtgaggagatggccgacgtgtacgacggcgccgagttcaggtggtgccacatctaccgcagcgtccccacaggaaactccggcggtggcggtggaggcaatggcaagcagctcgaggcccactcctttgaggtgaccttccacaagaagcacaaggagaaagccctcaaagagtacctcccgttcatcgtggccacggccaaggccatgaggcaacaagagagagccctccagatacacatgaacgagggctcggacgtctggtctccgatggacctccaccacccatcgaccttcgacacgcttgccatggaccccaagctgaagcagtccatcgtcgatgacctgaacaggttcatcaagagaaaggattactataagagaatcggcaaggcatggaagcggggttacctgctctacggcccacctgggaccggcaagtccagcctgatcgcggccatggccaatcatctccggtttgacatctatgatctcgagctgaccgcagtccagagcaactcggacctcaggatgctccttgtcggcattagcagccgatcgattcttgtggttgaggatatcgactgcaccatcaaactgcagcagcgggagggaggcgaggaggataccaattcagattcttcagacccagaaaagggaagagacaaggtgacactttctggactgctcaactttgttgatgggctgtggtcagcgggcggggaggagaggatcatcgtcttcacgaccaattacaaggagcggcttgacccggcgctgctgcggcctggcaggatggacatgcacatctacatgggctattgcacacccgagtcgttccggatccttgccaaaaactaccacttgatcgactaccatgccatgtatccggagatagagaagctgatcgaggaggtgatggtgacccctgcagaggttgctgaggttctgatgaggaatgacgacgctgatgtcgcgctccatgatcttgtcgatgtcctgaagtcaaaattgaatgatgccagtgtgaagaccgaacacgtcagtgcaaataaccaggaggatgacggagacgatgtctaaaataggaaaccactagctcaatttctgttagaaacagaagatgggaattagaagtgggtgtcgacactaacaatgaccaacggcaattatgttactttttgaaagagaaacaatgggaaatatgtgattgttcgagtatt

SEQ ID NO: 23482 - protein, 465 aa, Panicum virgatum
  misc_feature: Ceres CLONE 1828112
  misc_feature (241)..(417): Pfam Name: AAA Pfam Description: ATPase family associated with various cellular activities (AAA)
  misc_feature: SWISSPROT Homolog: EC 3.6.4.3 Microtubule-severing ATPase
MPSHEKALAAAASAAAALMLVRSVANELLPDEVRDALRSGASYLRSRVSSRHTITVERKLDTFTHNHVYEAIRTYLAGHANIRAQQHLCVSSMDEDEKMTVALADGEEMADVYDGAEFRWCHIYRSVPTGNSGGGGGGNGKQLEAHSFEVTFHKKHKEKALKEYLPFIVATAKAMRQQERALQIHMNEGSDVWSPMDLHHPSTFDTLAMDPKLKQSIVDDLNRFIKRKDYYKRIGKAWKRGYLLYGPPGTGKSSLIAAMANHLRFDIYDLELTAVQSNSDLRMLLVGISSRSILVVEDIDCTIKLQQREGGEEDTNSDSSDPEKGRDKVTLSGLLNFVDGLWSAGGEERIIVFTTNYKERLDPALLRPGRMDMHIYMGYCTPESFRILAKNYHLIDYHAMYPEIEKLIEEVMVTPAEVAEVLMRNDDADVALHDLVDVLKSKLNDASVKTEHVSANNQEDDGDDV

SEQ ID NO: 23483 - DNA, 693 bp, Panicum virgatum
  misc_feature: Ceres CLONE 1828118
  misc_feature: Encodes the peptide sequence at SEQ ID NO. 23484
atcgcatcatactatcatagtccagacaagaagaacgagacagctagcctagccatggcgaagcgctggtgccttcgcttcgccacgctcctggcggcgctcctcccggccgccgcctgcctcgacttcggcttctacgacaggacgtgcccctccgccgaggccatcgtgcagcagaccgtcgccgccgcgttcaggaacgactccggcgtcgctccggcgctgatccgcatgcacttccacgactgcttcgtcagaggctgcgacggctcggttctgatcgactcgacgacgaatccgaacaacacggcggagaaggacgcggcgcccaacaaccccagcctccggttcttcgacgtgatcgaccgcgccaaggcggccctggaggcgcagtgccccggcgtcgtctcctgcgccgacatcctcgccttcgccgcccgggacagcgtcgccctcgccggcggcctcggctaccagctgccggccggccgccgcgacggccggatatcccgcgacacggacgcgctcaacgacctgcccccgcccttcttcaacgccacccagctggccgacagcttcgcctccaagaacctcaccgtcgaggacctggtcgtcctctccggcgcccactccatcggcgtctcccactgcagcagcttcgccggcgtccccaacaaccttgccgaccggctc

SEQ ID NO: 23484 - protein, 212 aa, Panicum virgatum
  misc_feature: Ceres CLONE 1828118
  misc_feature (39)..(211): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated phosphate use efficiency
  misc_feature: Useful for making plants with modulated nitrogen use efficiency
MAKRWCLRFATLLAALLPAAACLDFGFYDRTCPSAEAIVQQTVAAAFRNDSGVAPALIRMHFHDCFVRGCDGSVLIDSTTNPNNTAEKDAAPNNPSLRFFDVIDRAKAALEAQCPGVVSCADILAFAARDSVALAGGLGYQLPAGRRDGRISRDTDALNDLPPPFFNATQLADSFASKNLTVEDLVVLSGAHSIGVSHCSSFAGVPNNLADR

SEQ ID NO: 23485 - DNA, 1317 bp, Panicum virgatum
  misc_feature: Ceres CLONE 1828126
  misc_feature: Encodes the peptide sequence at SEQ ID NO. 23486
gatccggccacctccccgcccgtctccccctccctcctgcagccggcgccccgcccccgccgtccacgtccgcccgcgccggcgcgcggcggagctccgccgtccggacctcgtccccgtcccctgaattccaacaggtaacagcataattcggtgtggaaacatggcgtcaaagaaagtagagttggatcacaaggatatggtccacgactctgctattgattactacggcaagcgccttgctactgcttcctcagactctaccgtgaagatcgtcggcattggtactgcaactgccccatcccaggttcttgcaacgcttactggccactatggtcctgtatggcgtgttgcatgggcccatccaaagtatggtacagtccttgcatcctgcggctatgatggccgtgtcattgtttggaaggaggatgctcgaggcaattggtctcaagtccatgtgtttactgaccacaagtcgtctgtcaactccattgcttgggctccgtacgaggttggcctgtgccttgcctgtgcgtcttgtgatggaagaatatctatcttgactatgcgagctgatgggggttgggatacttcaaccattgagcgagcacaccctgttggcgcgactgccatctcttgggctccagcaactgcacttggttcactggctagctcaggggagcttgtttataagcttgtctctggagggtttgactctgtcgttaaagtctggggatttgtcaacggtagctggaagctggagagtgctcttatctctgacatgcacagtgattgtgttcgggatgtcgcatgggcaccagttttgggcttggccaagtcaacgattgccagcagttcccaagatgggaaggtcgtcatctggaccaaggggaaagatggagacaagtgggagggaaagctcatgcgggactttgggtctcctgtctggagggtgtcttggtccttgactgggaacatactgtccatagctgctggtgagaacaacattacactctggaaggaagggtcagatggtcaatgggaggaggtgatgaaggttgaaccctaggctgtgacagtttcaagtcacttgcagatccatgtttcgacagagacaagtttgcctttgtgttttactagttcgtcgataaacactatattcacatatttttagtactttctcatgagcaattatactcttggatgaatggggtgtgcattagaatgccactttctgattggtgaacctgcttagttctgtatatcttcaactttgtttttgctatgggtgaaacatcacagctaccaccagcttac

SEQ ID NO: 23486 - protein, 301 aa, Panicum virgatum
  misc_feature: Ceres CLONE 1828126
  misc_feature (47)..(87): Pfam Name: WD40 Pfam Description: WD domain, G-beta repeat
  misc_feature (94)..(134): Pfam Name: WD40 Pfam Description: WD domain, G-beta repeat
  misc_feature (199)..(241): Pfam Name: WD40 Pfam Description: WD domain, G-beta repeat
  misc_feature: SWISSPROT Homolog: EC 2.3.1.48 Histone acetyltransferase
MASKKVELDHKDMVHDSAIDYYGKRLATASSDSTVKIVGIGTATAPSQVLATLTGHYGPVWRVAWAHPKYGTVLASCGYDGRVIVWKEDARGNWSQVHVFTDHKSSVNSIAWAPYEVGLCLACASCDGRISILTMRADGGWDTSTIERAHPVGATAISWAPATALGSLASSGELVYKLVSGGFDSVVKVWGFVNGSWKLESALISDMHSDCVRDVAWAPVLGLAKSTIASSSQDGKVVIWTKGKDGDKWEGKLMRDFGSPVWRVSWSLTGNILSIAAGENNITLWKEGSDGQWEEVMKVEP

SEQ ID NO: 23487 - DNA, 1285 bp, Panicum virgatum
  misc_feature: Ceres CLONE 1828132
  misc_feature: Encodes the peptide sequence at SEQ ID NO. 23488
tttccattcgaagcgcagcctcgtttcgattcccaattccccacccaccaccatcgtctctccattccacacccccatggccggctacccgccgcccggctccggctacccctacggccccgccgcaggggggagcggaggctacggcgccccgccgccgtacggctcctcccccggcccctccgccccgccctacggcgacaagccccccaaggaaggcaagacctcctcctcctccgcgccgccctactacggcgccccgccctacggcgacaagccccccaaggaaggcaagacctcctcctccgcgccgccctactacggcgccccgccctcctcccagccctacggcggcggcagcggaggctacggcgcccagcagtacggtgcgccctacggcgccccgccgccctcgtccgcccctccctacggcgcgccgccgcacgcgcccgcgccctacggggccccgccgccggcgtacggggccccgggcgggtatggcgggagccccttcgcgtcgctggtcccgtccgcgttcccgcccgggaccgaccccaacgtggtggcctgcttccaggcggcggaccgcgacggcagcgggatgatcgacgacaaggagctgcagtccgcgctctccggctacaaccagagcttcagcctccgcaccgtccacctcctcatgtacctattcaccaacaccaacgtccgaaagatcgggcccaaggaatttacttctgtgttttacagtcttcagaattggagagcaatatttgaaaggttcgatcgtgatcggagtggtaagattgactcatctgaactccgtgatgctcttctcagtctgggatattctgtctctccaactgtgctggacctgcttgtgtctaaatttgacaagactgggggcaagagcagagcaattgaatatgataacttcattgaatgttgtctcactgttaagggactgactgagaagttcaaggagaaggacacggcatactccggatctgcgacttttacttatgaggctttcatgctgaccgtgctccctttcctcatcgcctagtggcgcagttcagagcaaaagctaaacataccatgccagttgtgtaaaaaatgttcggagagttgttttggatttgactagtgttgctggggttgcgaatcataaagttgatgggtggttatgtttaacttagaaaatgctacaactgatatatagcgttggatctgtttgttcaacaataagcatctactccctctctttcaaaatatatatcgttctgat

SEQ ID NO: 23488 - protein, 328 aa, Panicum virgatum
  misc_feature: Ceres CLONE 1828132
  misc_feature (227)..(255): Pfam Name: efhand Pfam Description: EF hand
  misc_feature: SWISSPROT Homolog: EC 3.4.22.52 Calpain-1
MAGYPPPGSGYPYGPAAGGSGGYGAPPPYGSSPGPSAPPYGDKPPKEGKTSSSSAPPYYGAPPYGDKPPKEGKTSSSAPPYYGAPPSSQPYGGGSGGYGAQQYGAPYGAPPPSSAPPYGAPPHAPAPYGAPPPAYGAPGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFIECCLTVKGLTEKFKEKDTAYSGSATFTYEAFMLTVLPFLIA

SEQ ID NO: 23489 - DNA, 678 bp, Panicum virgatum
  misc_feature: Ceres CLONE 1828161
  misc_feature: Encodes the peptide sequence at SEQ ID NO. 23490
atcagacaggctcagatcggcccattagacaagtgaagaagaaaacctaccggacgctgcgccgcctcctcccccttgaagcttcttctcagcggcggccgagggagaagatggttgcggcgatcagggtccccaagacccaacgcgccaggcgggagctcctcaagcacgcgcccaagctcgtcgagactggcaaaaagacgcttatcctccatggtacaaagactagtgctgtgttgaactcagtgctgtcagatatctaccacctgaagcgagataatgccatgaagtacaccaagaagaatgacagcattcggccgtttgaaagtggtggggaatcttctctggagtttttctccctcaagacagactgcagccttatagcgtatggttctcattcaaagaagaggcccgacaatctcattttgggaaggacatatgaccaccacatatatgaccttgttgaagtaggtgttgagaactacaaatcgatggaatcttacgtttatgataagaagctggcaccaaaacttggatcgaagcctttctttgccttcataggggaacactttgagagtgtcgaagagctgaagcatttgaaagaagtgctgcttgatcttttcaggggagaggttatagagaatctaaaccttgttggtgtagatcggatctatgtgt

SEQ ID NO: 23490 - protein, 189 aa, Panicum virgatum
  misc_feature: Ceres CLONE 1828161
  misc_feature (32)..(189): Pfam Name: Brix Pfam Description: Brix domain
  misc_feature: Useful for making plants with modulated biomass
MVAAIRVPKTQRARRELLKHAPKLVETGKKTLILHGTKTSAVLNSVLSDIYHLKRDNAMKYTKKNDSIRPFESGGESSLEFFSLKTDCSLIAYGSHSKKRPDNLILGRTYDHHIYDLVEVGVENYKSMESYVYDKKLAPKLGSKPFFAFIGEHFESVEELKHLKEVLLDLFRGEVIENLNLVGVDRIYV

SEQ ID NO: 23491 - DNA, 678 bp, Panicum virgatum
  misc_feature: Ceres CLONE 1828162
  misc_feature: Encodes the peptide sequence at SEQ ID NO. 23492
gagtcccctgagagcggcgcagtcggccgccggccacgcgcccggccgtgaaccctagatgacgccggcgaacggtgcatcagcgccagaagcggtggtggaggcagcgctgccccccgaggtggagtccgaggccgacgcgttccagcgccaggtcgacgacctcgtctccaagaccgacgtgctggagaggcaggtgaacgaggtggtggacttctacgatggaaagaagcacggcagcggcggtcgtaagggcggcaggtatggggcatacgggagggggatgcccgaccttatgcgccagttcggcgtgattttacgagagatcaccgatgataaggattcatggccatttcgggagccagtggatgttgtaggactgcaacttcatgactattacaagattattaccaaacctatggacttctctactattcaaaataaaatgaaagggaaggatgttaccacttacaaaaatgttcgagaaatatgtgcggatgttagattaatttttgccaacgcaatgaagtacaatgatgacgagaatattgtccacttgcttgctaaatcattacttgagaaatttgaagagaagtggcagcaatttcttcctaaagttgagagtgaggaaaaaagacaaaaggaagaggaatcaaagggtcttctagccaccaattc

SEQ ID NO: 23492 - protein, 206 aa, Panicum virgatum
  misc_feature: Ceres CLONE 1828162
  misc_feature (79)..(171): Pfam Name: Bromodomain Pfam Description: Bromodomain
  misc_feature: SWISSPROT Homolog: EC 2.3.1.48 Histone acetyltransferase
MTPANGASAPEAVVEAALPPEVESEADAFQRQVDDLVSKTDVLERQVNEVVDFYDGKKHGSGGRKGGRYGAYGRGMPDLMRQFGVILREITDDKDSWPFREPVDVVGLQLHDYYKIITKPMDFSTIQNKMKGKDVTTYKNVREICADVRLIFANAMKYNDDENIVHLLAKSLLEKFEEKWQQFLPKVESEEKRQKEEESKGLLATN

SEQ ID NO: 23493 - DNA, 675 bp, Panicum virgatum
  misc_feature: Ceres CLONE 1828178
  misc_feature: Encodes the peptide sequence at SEQ ID NO. 23494
aaaaaaattcgcatctgctcctccactccactcatctcttctccgaggcgagcgcaaacccgcctcgcttctcgtcaaaccctagcgccccgctcggccgcgtcgctgccccgccccggatcaagcccgcacagcgcccgagcgtgcgtctccctcccggattcgagcggcgggcggcgggatggggtccgactccaaggagctgctcgggatcgagcccctcgagctccggttcccattcgagacaaagaagcagatctcatgctctatgcagctaacgaacagaacggatgactatatcggcttcaaggttaagacgacgagcccgaagaagtactgcgtccgaccaaacagcggcattgtgccaccacggtccacctgcgatgtcattgtgtcaatgcaagcgcaaaaggaggcaccacccgatatgcaatgcaaggacaagtttctcgtgcaaagtgttattgtggctgaaggcacgtcagcaaaggacataactggagatatgtttaccaaaaaatcgggtaatgtggtggatgaggtgaagttgagggttgtctacgtcccaccacccaagccgccatccccagtgcgtgagggatctgaagaaggctcgtcacctagacattcattgtctgatggaagcaacttgaattatcaagagatgcagacaac

SEQ ID NO: 23494 - protein, 164 aa, Panicum virgatum
  misc_feature: Ceres CLONE 1828178
  misc_feature (8)..(115): Pfam Name: Motile_Sperm Pfam Description: MSP (Major sperm protein) domain
MGSDSKELLGIEPLELRFPFETKKQISCSMQLTNRTDDYIGFKVKTTSPKKYCVRPNSGIVPPRSTCDVIVSMQAQKEAPPDMQCKDKFLVQSVIVAEGTSAKDITGDMFTKKSGNVVDEVKLRVVYVPPPKPPSPVREGSEEGSSPRHSLSDGSNLNYQEMQT

SEQ ID NO: 23495 - DNA, 1362 bp, Panicum virgatum
  misc_feature: Ceres CLONE 1828184
  misc_feature: Encodes the peptide sequence at SEQ ID NO. 23496
aaaacggtgtcgcgtgccggaaaccgggtcgaaccaacaagcgagttgggcgttgggacgatcgatccatcgtttcttcccaaaacgcattttcctcgacctcccgatcgatctgcggtgcccgcctccgccctgacgcaggtggtgcgccaagagccagcggtcctcctgccgtcgttgctgcccgaggtttccccaaccccgaagggcccagcggcggcgtggtcatcccctccatcccgtcgacaccgccagaccttgcctgcggcggcggcggacaatcccaccaacggcggctcctggaggctgaactagctgcgcgcgctgtgcccgactggcgactgtccgtgcggtcggcgctggcggcttggcgcactgcagtgctgctgcctgctggtgccagcgtgcatcccagcggtgcggcgtgggagcgggagtgcggcacgccggtgcgtcgccttgcgaaggcgaatctccgccgcacgcgctcgtagaagcagccaagcaggatagaaggaggaggcatctgcacacctacaaggcaacaagggataccaggaagggcaacctcttgggccttggcagtttatcgatggtatttggttattagagtgagcagtcttcgagggcacttcacctgttcttgagcagggtctcggacgccccagagtccagaaccttctagaagcatcaggatagctagagcattgctccaaccccagcaccagccatgtcggagaagctggcccctgggaagcgccacgccttcatgcacaatgggcagaaggtgttcgagtgggaccagacactggaggaggtgaacatgtacattgagctccccaagggcgtacccaccaagctcttccgctgcaccatccaggcgggccacatggagcacaacctggcgcaccccgtgaagacagactcctcgttctggacaatagaggatggtgagatgcatatcacactgcaaaaaagagagaaagggaagacatggtcatctccaatacaagggcaaggtctcttggatccatatgctgcagatcaagagcaaaaacggcttatgctgcaaaggtttcaagaagagaacccagggttcgacttttctcaggctcagttcagtggaacctgccctgacccaaggaccttcatgggaggaatacgctccgactgaaacgtccagcctgaacggcgtaattcttgctatgttcctgctgctatcttcagcatcttgttagatgcagcagccgtagctaatgtcctaatccttacgtaaattggttggtgtttttttttgagagccaaaattggttggtgtttacccttgaaataatgaattagtgatgatgtgtgacccattcc

SEQ ID NO: 23496 - protein, 147 aa, Panicum virgatum
  misc_feature: Ceres CLONE 1828184
  misc_feature (19)..(82): Pfam Name: CS Pfam Description: CS domain
MSEKLAPGKRHAFMHNGQKVFEWDQTLEEVNMYIELPKGVPTKLFRCTIQAGHMEHNLAHPVKTDSSFWTIEDGEMHITLQKREKGKTWSSPIQGQGLLDPYAADQEQKRLMLQRFQEENPGFDFSQAQFSGTCPDPRTFMGGIRSD

SEQ ID NO: 23497 - DNA, 699 bp, Panicum virgatum
  misc_feature: Ceres CLONE 1828196
  misc_feature: Encodes the peptide sequence at SEQ ID NO. 23498
caaatatttcaatccagtggttccgcatacacccaaaagaaagcaacaaagagatcatttccggtgccacaagaccagtatatgccctagagccacatgacgttggacgctatttgcaagctgaaatcgatgttggtggtgaaattgccgtagcaaagacagctgggcctgtagaccctgatgctggattggtagaatatgtggagacactcgtaaggaaacctgaaactgagttcaatgttgttgtgcttcaattgaacggcattgagcagccaaaagagtcagttcatgttctcaatgtcggaaggctgcgaatgaggcttactaaagggaagtcagtagttgccaaggaattctattcctcatcaatgcagttatgtggtgttagaggtggtggcgaagcagcctcacaggcaatgttttggcaacccagcaacgacctcagcttggtgctggccttcgagaccgctcgggaacgcaacacagccatcatgcttgctcggcgattcgccatagattgcaatatcatccttgctgggccaggcgacaaaactccctggtgaaaggaacctgtagtgctccgccgatccaacggttcctgtcggcccgcgacctgcgcagtgatgtacatttgcgtgcacagcgtgtttgcaccagttcctctagttttctcgttcagtctgggctgtcctgctcttc

SEQ ID NO: 23498 - protein, 186 aa, Panicum virgatum
  misc_feature: Ceres CLONE 1828196
  misc_feature: Useful for making plants with altered alkaloid content
  misc_feature: Useful for making plants with altered terpenoid content
NISIQWFRIHPKESNKEIISGATRPVYALEPHDVGRYLQAEIDVGGEIAVAKTAGPVDPDAGLVEYVETLVRKPETEFNVVVLQLNGIEQPKESVHVLNVGRLRMRLTKGKSVVAKEFYSSSMQLCGVRGGGEAASQAMFWQPSNDLSLVLAFETARERNTAIMLARRFAIDCNIILAGPGDKTPW

SEQ ID NO: 23499 - DNA, 675 bp, Panicum virgatum
  misc_feature: Ceres CLONE 1828202
  misc_feature: Encodes the peptide sequence at SEQ ID NO. 23500
gtccaacttcgcagaccggtccaaatccccaacagaaatttgcgcccgggcccttcgccggagatggcgtcggagctgacgaaccggcgcggcgccgcggcgcacggctccgcctccaacggcggggagtactccccgaagccctccaagccgttctcctggctctcccgcgccgtccgctacgccgccgctgagcaccgccccgtcttcgccctcgccggcatgctcttcgccgccgccctcttcaccttctcctccacatccacctcgtcctaccccgccgcgtcggccggattcggccacctcgccatcggcgggcacccgtccttccgcgagtcctccgtcggcggtaaggtgcccctgggcctgcggcggcgcgcgctgcgggtgctcgtgacgggcggcgccggcttcgtggggagccacctggtggaccggctggtggagcgcggcgacagcgtcatcgtcgtggacaacttcttcacggggcgcaaggggaacgtcgcgcaccacctccggaaccccaggttcgaggtgatccgccacgacgtcgtcgagcccatactgctcgaggtcgaccagatctaccaccttgcctgcccggccagccccgtgcactacaagtacaacccaatcaagaccatcaagacaaatgtagttgggacactgaatatg

SEQ ID NO: 23500 - protein, 203 aa, Panicum virgatum
  misc_feature: Ceres CLONE 1828202
  misc_feature: SWISSPROT Homolog: EC 4.1.1.35 UDP-glucuronate decarboxylase
  misc_feature: Useful for making plants with altered carbohydrate content
  misc_feature: Useful for making plants with altered cell wall content and/or composition
MASELTNRRGAAAHGSASNGGEYSPKPSKPFSWLSRAVRYAAAEHRPVFALAGMLFAAALFTFSSTSTSSYPAASAGFGHLAIGGHPSFRESSVGGKVPLGLRRRALRVLVTGGAGFVGSHLVDRLVERGDSVIVVDNFFTGRKGNVAHHLRNPRFEVIRHDVVEPILLEVDQIYHLACPASPVHYKYNPIKTIKTNVVGTLN

SEQ ID NO: 23501 - DNA, 596 bp, Panicum virgatum
  misc_feature: Ceres CLONE 1828210
  misc_feature: Encodes the peptide sequence at SEQ ID NO. 23502
attaatttttcgctctgcccttgtagatctctatacagcagagcgcagcaggataggtgtacccgctcctgtgtggtcgacttggcggtcgtcgccgccggaccggtgctcccccactacctcccgctgctccgaggcgggctccccaagggcagtttccgctggcccctcaacggctacaccaacggtttcctccacgcccacccgtccaacaccgccggcggcttcctcaaagagcacgtcgccaggtacgggacggtgttccactcgcaactcttcgggtcacccgcgggggtctcctgccaacacgaacacaatcacttcgagctgcaaaacgaagagcatctgttcgagtgcagctaccccggcgccatccgcaccatcttctgccagacctccgcgctggtggtcaccggcgagcgccaccggcagatccggagcatgttcctcgccctagtcgcctccacggtgctcaaggcctcctacgtcaccagcatcgactagtccccgcgatccctcatcgcgtcctggcgcggccgcgagaccatctgcttctgctagaaggctaccaagttcccctacaaggtgatcatgga

SEQ ID NO: 23502 - protein, 167 aa, Panicum virgatum
  misc_feature: Ceres CLONE 1828210
  misc_feature: SWISSPROT Homolog: EC 1.14.13.77 Taxane 13-alpha-hydroxylase
  misc_feature: Useful for making plants with modulated oxidative stress sensitivity
INFSLCPCRSLYSRAQQDRCTRSCVVDLAVVAAGPVLPHYLPLLRGGLPKGSFRWPLNGYTNGFLHAHPSNTAGGFLKEHVARYGTVFHSQLFGSPAGVSCQHEHNHFELQNEEHLFECSYPGAIRTIFCQTSALVVTGERHRQIRSMFLALVASTVLKASYVTSID

SEQ ID NO: 23503 - DNA, 1096 bp, Panicum virgatum
  misc_feature: Ceres CLONE 1828218
  misc_feature: Encodes the peptide sequence at SEQ ID NO. 23504
atcgcacactccgcgctgctcctcacctcgcctggctagtcttccgtttcaactttcaaggatccgaagcgctcctcttccttttctcggccctggttcgctcgctgcgctgggtgcgtgatcgccggagcgagaagctgccgtgggtggctggaggatatgtaggggcgacatggcggttcatctggtgctggcttgagattcttgggtgcgaggtttgatttgggttttggtggtaggcgggagttgctggtacagtaggaaaagtggaggaaacgatgagctttagtgccgtgaacatggaggaggagagcggcactgcggcggccgcggcggcggcggaggagatccggcggctgccggcggaggtgaactgggagatgctggacaagtcgcggttcttcgtcctcggcgcggcgctcttctcgggcgtgtccgcggcgctgtacccggccgtggtggtcaagacgcacctgcaggtggcgccgccgcccgcggcggccaccgcgaccgccgccgccatcctccggcgggacggcccgagagggttctaccgcgggttcggcgcgtcgctggccggcacggtgcccgcgcgcgcgctctacatggcggcgctcgaggccaccaagagctcggtcggctccgcggccgtccggctcggcgtctccgagcccgccgcgtcggcggcagcctccgcggccgcgggcgtctccgccgccgtcgccgcgcaggtcgtgtggacccccgtggacgtcatcagccagcggctgatggtccagacctccgccacctgccgctaccgcggcggcgcggacgcgttccggaagatcctcgtcgccgacggcgtccgcggcctgtaccgtgggttcggcctctccatcctgacctacgcgccgtccaacgccgtgtggtggtcgtcctacgccatggcgcagcggttcctctggcgcgtcgtcggcgccgagcgctccgagagctacccgtccctgatggccgtgcagggcgcgagcgccgcgctggccgggggcgcgtccgcgctggtgaccatgccgctggacaccgtgaagacgcggctccaggtgatgggggcggacgc

SEQ ID NO: 23504 - protein, 272 aa, Panicum virgatum
  misc_feature: Ceres CLONE 1828218
  misc_feature (135)..(226): Pfam Name: Mito_carr Pfam Description: Mitochondrial carrier protein
  misc_feature (40)..(124): Pfam Name: Mito_carr Pfam Description: Mitochondrial carrier protein
MSFSAVNMEEESGTAAAAAAAEEIRRLPAEVNWEMLDKSRFFVLGAALFSGVSAALYPAVVVKTHLQVAPPPAAATATAAAILRRDGPRGFYRGFGASLAGTVPARALYMAALEATKSSVGSAAVRLGVSEPAASAAASAAAGVSAAVAAQVVWTPVDVISQRLMVQTSATCRYRGGADAFRKILVADGVRGLYRGFGLSILTYAPSNAVWWSSYAMAQRFLWRVVGAERSESYPSLMAVQGASAALAGGASALVTMPLDTVKTRLQVMGAD

SEQ ID NO: 23505 - DNA, 620 bp, Panicum virgatum
  misc_feature: Ceres CLONE 1828220
  misc_feature: Encodes the peptide sequence at SEQ ID NO. 23506
actcctccccaacccccccctcaagccccccagcgaagggtcccccatgtcggcagcggaccacaggctcccagtgatacgaggccgcccacgttctcctcttccggcaggagctgctcgaccacccccgagtgccagccgtctcccagacctcgacggtccagaagggcacccttcttcggcagggccgggaccgggccgacggccgagcggggcgcccaccggcagctgtggttcgcctccaggcgctccctctcctacctcgatggcacgctgcctcgcgactaccggctcgacccgctggggctgactgacccggagggcaccggggggttcatcgagccccagaggctggccgacggcgaggagatcgacggccggttcgccaagctgggcgcggccggcgccatcgacccggacatcttcggcaagctgggcatcatcccggcggagacggcgctgccgcggttcaagaccggggacatcccgcccgcgggcacctaccactactgggccgactcgtacacgctcttcctcttcaacatggcgctcatgggcttcgccgagcaccgccgcctccaggactggtacaacccgggctccatgggcaagcagtactt

SEQ ID NO: 23506 - protein, 206 aa, Panicum virgatum
  misc_feature: Ceres CLONE 1828220
  misc_feature (83)..(205): Pfam Name: Chloroa_b-bind Pfam Description: Chlorophyll A-B binding protein
TPPQPPPQAPQRRVPHVGSGPQAPSDTRPPTFSSSGRSCSTTPECQPSPRPRRSRRAPFFGRAGTGPTAERGAHRQLWFASRRSLSYLDGTLPRDYRLDPLGLTDPEGTGGFIEPQRLADGEEIDGRFAKLGAAGAIDPDIFGKLGIIPAETALPRFKTGDIPPAGTYHYWADSYTLFLFNMALMGFAEHRRLQDWYNPGSMGKQY

SEQ ID NO: 23507 - DNA, 1487 bp, Panicum virgatum
  misc_feature: Ceres CLONE 1828225
  misc_feature: Encodes the peptide sequence at SEQ ID NO. 23508
gccgcctgctcctccagtccttccttcctcctccccctgccccctacccgcgagtgaattccggaatccccaatcaatccacagagagagagagagagagagagagagagagagagagaggcaggcgacgcggcctcccccgattcccagttccccctctcggccggccgcgaccggattcgtcccgccatccctcgcagccttcgatccgagccgcgggggggtgcgcccgccgatcgagcggcggtagggcaggggagggagggaggaggatgagcttccaggacctggaggcgggcaacgtccgcggggcgccgctgggcggcgcgcggcggaacggccggggccccgcggggggcggcgccggcgcgtcgcaggccgccgcgtcgggcgtcttccagatcaacaccgccgtcgccacgttccagcgcctcgtcgacacgctcggcacgcccaaggacacccccgacctccgcgacaggatacataaaacacggcaacacataacacaactagtgaaggatacatcggacaagcttaaacaagccagtgaggcggatcatcgtgtcgaagttagcgctaccaagaagattgctgatgcaaagctagctaaggatttccaagcagtccttaaagaattccagaaagctcaacggttagcagtagagagagaagctgcatatgcaccttttatttctcaagcaggtctgccacagagctacaactcaagcgaggtgaatgatggtgctgataagttggctgagcagcgaacacagcttctggaatctagaaggcaagagcttgtcttcttggataatgaaattgtgttcaacgaggccatcattgaggagagggatcaggggatacaagagattcaacaccaaattactgaagtaaacgaaatcttcaaagatcttgctgtgctagtccacgatcaaggagcaatgattgatgacattgactcccatatagagaatgcagttgttgcaacttcacaggcaaaagggcagctttcaaaagctgctaaaactcagaagtcaaactcttcactgatatgcttgttgctggtcattttcggagttgtcctgctcatagtgataatagtccttgcagcctaaaaagcttgaagggcacctgaggctccgaaatctgatcaagctgagcgcgaagaattccttcataagttatttttgctatgcggtcaggaatgtatcctggtttccgcctggaggtggtggttggcgttctggttgtggtatggtggtctatgtggtgttggtgtgcgcctggaatgcatcagttcatctaagcataatcgtttcctgtcagcgtagtgcctcttgtctcacagcctgctttgtttatatctgtaatgtaacgtggatgaatgcgtgctgtagaacaaggaggtttacattatctgtggcatgacatttcttgattccgtaagaaatcatttgcaatatatcaatttggtgttccttctc

SEQ ID NO: 23508 - protein, 281 aa, Panicum virgatum
  misc_feature: Ceres CLONE 1828225
  misc_feature (193)..(255): Pfam Name: SNARE Pfam Description: SNARE domain
  misc_feature (22)..(124): Pfam Name: Syntaxin Pfam Description: Syntaxin
MSFQDLEAGNVRGAPLGGARRNGRGPAGGGAGASQAAASGVFQINTAVATFQRLVDTLGTPKDTPDLRDRIHKTRQHITQLVKDTSDKLKQASEADHRVEVSATKKIADAKLAKDFQAVLKEFQKAQRLAVEREAAYAPFISQAGLPQSYNSSEVNDGADKLAEQRTQLLESRRQELVFLDNEIVFNEAIIEERDQGIQEIQHQITEVNEIFKDLAVLVHDQGAMIDDIDSHIENAVVATSQAKGQLSKAAKTQKSNSSLICLLLVIFGVVLLIVIIVLAA

SEQ ID NO: 23509 - DNA, 1199 bp, Panicum virgatum
  misc_feature: Ceres CLONE 1828257
  misc_feature: Encodes the peptide sequence at SEQ ID NO. 23510
agcatcccgaccgcacccagctccctctctcccctcccccgcccgcccgtcttccagctccaagccggcaagctgcgccgccacagcgagcagcgttggacgccgcggccgctcgagaggttcgacaaaccggaccacggacaagatgatgccctcgagccagcccgatttttcgccgtcgcagttcacctcctcccagaatgccgccgccgactccaccaccccttccaagatgcggggcgcatcaagcactatgccactcaccgtcaagcagatcgccgacgcgcatcaatctggcaccggcgagaagggcgctcccttcgtcgtcgatggcgtagagacggctaatattcgacttgtggggatggtcaatggcaaagcagagcggacgacagatgtgtcattcacgctcgatgacggcactggtcgcctcgatttcattagatgggtgaatgacgcttcagattcgtctgaaactgctgctattcagaatggtatgtatgtctcggtgattggtagtctcaagggacttcaagagaggaagcacgctactgctttcgcaatcaggcctataactgatttcaatgaggttacgctgcatttcattcaatgtgttcggatgcacgtagagaatactaaattaaaggtaggcagtcctgcacgaaccagttcttctatgggagcatcagtttcaaatggattcagtgaatcaagcacaccagcatcattgaaatctaatccagcaccggtgaccagtggtgcaagtggaaccgacgggactgatttaaacacacaggtgctgaatattttccgcgaaccagccaacattgagagtgagcatggggtgcacattgatgaaataatcaagcggttcaaattgcctgagaataagataagggaggcaattatgtataatgcggatgtcgggcatatttactcaacaatcgatgattttcactacaagtcagctttcaccgactgaagttgtagccaaaatcaagcatatttacatcgcatcttagaggactatgtatcatttgagagatctgactccacctccttgtactgaccagctaagaaggctgcttgatgatgttaaacctctctaagatgatcctatatgtatgggttatggaaatgtactgctgttgtgtcaatcggatgatttgtatcatgcatctgatgaagttgtgacagcg

SEQ ID NO: 23510 - protein, 278 aa, Panicum virgatum
  misc_feature: Ceres CLONE 1828257
  misc_feature (160)..(270): Pfam Name: RPA_C Pfam Description: Replication protein A C terminal
  misc_feature (69)..(143): Pfam Name: tRNA_anti Pfam Description: OB-fold nucleic acid binding domain
MMPSSQPDFSPSQFTSSQNAAADSTTPSKMRGASSTMPLTVKQIADAHQSGTGEKGAPFVVDGVETANIRLVGMVNGKAERTTDVSFTLDDGTGRLDFIRWVNDASDSSETAAIQNGMYVSVIGSLKGLQERKHATAFAIRPITDFNEVTLHFIQCVRMHVENTKLKVGSPARTSSSMGASVSNGFSESSTPASLKSNPAPVTSGASGTDGTDLNTQVLNIFREPANIESEHGVHIDEIIKRFKLPENKIREAIMYNADVGHIYSTIDDFHYKSAFTD

SEQ ID NO: 23511 - DNA, 568 bp, Panicum virgatum
  misc_feature: Ceres CLONE 1828267
  misc_feature: Encodes the peptide sequence at SEQ ID NO. 23512
aaacccccaatccccgcctccccctcgcgagcgagcgccaggcggagccccccgcgcccagcaggaggagcagccgcccgggcgaggcgagagatggtggggaccgcccgcggcggagcggcggaggcggtgcggcggtgggtggaggccggcggcgggcacctcgtgctggacggcgggctggccacggagctcgaggcccacggcgcccacctccacgacccgctctggagcgcccagtgcctcctcgtatccccgcgcctcatccgcaaggtccatatggactacctagaagctggtgcaaacattataagcacaacatcatatcaggccacgattcaaggatttgagtcaaagggtttttcaaaagaacaaagtgaaaacttactaacaaagagtgttgagattgctcgggaagctcgtgagatgttcctgaaggaacatttaaatcaatccattcctgcacaaaaacctattctggttgcagcttctattggaagttatggggcttatcttgctgatggctctgagtacagtggggactatggtgaagttggtacaataagat

SEQ ID NO: 23512 - protein, 158 aa, Panicum virgatum
  misc_feature: Ceres CLONE 1828267
  misc_feature: SWISSPROT Homolog: EC 2.1.1.10 Homocysteine S-methyltransferase
MVGTARGGAAEAVRRWVEAGGGHLVLDGGLATELEAHGAHLHDPLWSAQCLLVSPRLIRKVHMDYLEAGANIISTTSYQATIQGFESKGFSKEQSENLLTKSVEIAREAREMFLKEHLNQSIPAQKPILVAASIGSYGAYLADGSEYSGDYGEVGTIR

SEQ ID NO: 23513 - DNA, 643 bp, Panicum virgatum
  misc_feature: Ceres CLONE 1828287
  misc_feature: Encodes the peptide sequence at SEQ ID NO. 23514
aagccgccaaagaaagaagacgcagcccaggcagaggagaaaacaacagcgaggcaggcgaagctcccgagggagggagctgtaggcaggcagccacgcaagcaactaccaagtcgaggatcagaggagcaggggacaattcggatcgatcgatcgatcgggcggcgatgtcggggcggcgaccggcgacatgggagcaggccggggacgagtacgactacctgttcaaggtggtgctgatcggggactcgggcgtgggcaagtcaaacctcctctcccgcttcacccgcaacaccttctccctcgattccaagtccaccatcggcgtcgagttcgccacccgcaccatcaaggtggaaggcaagacgatcaaggcgcagatctgggacacggccgggcaggagcggtaccgggcgatcacgagcgcctactaccgcggcgccgtgggcgcgctcctggtctacgacgtgaccaaggcggcgaccttcgagaacgtgaggcggtggctccaggagctccgcgaccacgccgacgccaacaccgccgtcatgctcatcggcaacaagaccgacctcgcccacctccgcgccgtcgctcaggagggcgccgccgcgttcgccgagcgggagggcctctccttcgt

SEQ ID NO: 23514 - protein, 158 aa, Panicum virgatum
  misc_feature: Ceres CLONE 1828287
  misc_feature (21)..(157): Pfam Name: Ras Pfam Description: Ras family
  misc_feature (21)..(135): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered terpenoid content
  misc_feature: Useful for making plants with altered alkaloid content
  misc_feature: Useful for making plants with modulated oxidative stress sensitivity
MSGRRPATWEQAGDEYDYLFKVVLIGDSGVGKSNLLSRFTRNTFSLDSKSTIGVEFATRTIKVEGKTIKAQIWDTAGQERYRAITSAYYRGAVGALLVYDVTKAATFENVRRWLQELRDHADANTAVMLIGNKTDLAHLRAVAQEGAAAFAEREGLSF

SEQ ID NO: 23515 - DNA, 1085 bp, Panicum virgatum
  misc_feature: Ceres CLONE 1828307
  misc_feature: Encodes the peptide sequence at SEQ ID NO. 23516
agcactggaaaatcgatgacttaaattccagagagaggaaaaagaaaaaaaatcccgatccccgccgccgcgccgcgagatcgccgggcgccgccatgtccactccagccgccgcctacttcgccgccgccgcgcgcaagcagtacttctgctaccaatgcaaccgcaccgtcctcatcgcggcctccgccgccgccgccggggagctctcctgccccgactgccgcggcgacttcctcgaggaggtcaccgtcccggcccccaccttcatcccgctccccttccccttccccttcgcctccaccacggtccccgccgccagcgccgcccccgccccagccgccggctccggcgggtccccttccctgtcgtcctcgtcctcctccgccgcgaccaacccgtcccagcccaacgacatctccgccatcctcaacaccttcctcggactcggcgagcagtccggcaggttcggcggcggcgtgcgctccgccgccggcacggcgacccccgagaacgagtccgagcccttcgacccggtcatgttcttccagaattacctccataacctcatggagggaggggccaacatccaggtcctcctcgacgacgccagcctcagcctcggcccgggccacgggcgcgtcggcggggcaagcttcggggactacttcattggcccgggccttgagcaactcatcgagcagctcgccgagaacgaccctaaccgctatggcacaccgccagccgccaagtcggctctctccgctctccccgacgttgtcgtgactcacacaatggttgccgcggcggagggcgctgaatgtgccgtgtgcaaggatgatttctctcctggggaggtggctaagcagatgccctgcaagcacatctaccacgccaactgcatcatgccctggctggagcttcacaactcgtgccctatctgtcgttttgagctccccactgatgatccagattatgaggggcggaaggcctctaatccgcagccgcctgttggaattgctgcggttgcatctgggagctctactgctgctgaggaagggatggaggagagggaggagaatgct

SEQ ID NO: 23516 - protein, 329 aa, Panicum virgatum
  misc_feature: Ceres CLONE 1828307
  misc_feature (243)..(283): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MSTPAAAYFAAAARKQYFCYQCNRTVLIAASAAAAGELSCPDCRGDFLEEVTVPAPTFIPLPFPFPFASTTVPAASAAPAPAAGSGGSPSLSSSSSSAATNPSQPNDISAILNTFLGLGEQSGRFGGGVRSAAGTATPENESEPFDPVMFFQNYLHNLMEGGANIQVLLDDASLSLGPGHGRVGGASFGDYFIGPGLEQLIEQLAENDPNRYGTPPAAKSALSALPDVVVTHTMVAAAEGAECAVCKDDFSPGEVAKQMPCKHIYHANCIMPWLELHNSCPICRFELPTDDPDYEGRKASNPQPPVGIAAVASGSSTAAEEGMEEREEN

SEQ ID NO: 23517 - DNA, 200 bp, Panicum virgatum
  misc_feature: Ceres CLONE 1828307-R
agttagtctgtttgttatggaacaatccgttcgatctagttgtgtcctcggtgttcgttaggggtcatgtacacaaagcgcaaaaactgccccctgcagcagaatttgcgcgttgagaacttttatgtgcagatttgttgattggtcccacttcattaaacagtgaacaccagatctatcttaacccgtgggaatgtgct

SEQ ID NO: 23518 - DNA, 1848 bp, Panicum virgatum
  misc_feature: Ceres CLONE 1828315
  misc_feature: Encodes the peptide sequence at SEQ ID NO. 23519
accccctttctctcgttccattgctctcccatccgtcgcttcgatccaactggtggcggctccggcggcggccggcgaccagcgcgatcgggcaccctcccggccccccatgccctgaaagcgcaatccgaagcctgacgcgccggtttcgccatggccaccattgcctccatggagcccttcaaccggctggtgaggctggcggcgcgcgccttctacgacgacatctccatgaagggcgacaaccagcccaagacctcccgcggggataaccgcggcatggccgtcgtcgtcctcgacgcgctcaccagacggcagtgggttcgggaggaagatttggcgaaagcgttgaagctccactcgaaacagctgcggcgcattctccgcttctttgaagaggagaagctagtcacaagggatcacaggaaggagtctgcaaaaggagcaaaagcacataatgttgcggctgctgcagcttccagcgagggcccaccagtcactgagggagaagaaaaaattaagatgcacacgcattcgtactgttgcttggattatgctcagatttgtgatgttgtaaggtaccggattcaccgcatgaagaaaaaaatgaaggatgaattggacagtagaaatacaattcaacactacatatgtcctagctgtaataaaaggtattcagcctttgatgcattgcaattagtaagctacacggatgagtacttccattgtgaaacctgcaacggtgaactggttgcagagagtgacaagcttgcttctgaggaaatgggagatggcgatgacaatgttagaaagcgtaggcgtgagaaattgaaggacatgcaacaaagaattgaagagcaattgaagccattggttgcacaacttgaaagagtgaagaatctacctgctcctgagtttgggagtctgcagacatgggaaagagcaaatattggcgcttttgcaaatggtgactctagtgcagctgattcatctaggaactcacaagggcaatatgggacaccaatgccatacatgggtgacacaaaggttgaagttgtagttgatgatggtgagaaggaaaatggtactgaatcaggaaaaaatggttcggacctgaaagtcttacctccatggatgatcaaagatggcatgaatcttacaaaggaacaaagaggagagaccagcaaggaatcaaaatttgatgaaaaatcagaagccaaggatgacaaaaaacaggactcaaaagatgatcaaattatacaggaggaatacataaaggcttattatgaggccttgaggaaaaagcaggaagaggaagaagcaaagaggagaatgcaggaagaaggtgagacttttgtctctgattctcaatctgaacgccaggtgggcaagaaatacaagcgggaggatgaagatgaaggtattgaatgggaagagcagcaacctacagggactgcaaccgagcaatacaaattggcagatttaaatgcggaggcccaagaatctggcgatgatgaagatgaagttgagtgggaagatggttaatacttgccggtggcccccagctcccattgggattttggtgaaatagttcgatcccagcaaagaaaaatgttgacagcactgcactaatgagtttgattctgttgcgcttaatgatgaaaaacttgttcacgtaaaaggccagttcctatggattttcagttgaaggatgtgtaaaatatattcctatattttaggaggaaatgaacatttttccctgtaattctgaagggttgcgcactattatttgtggatgcttttacatgccagcaaaagaaatttcaaagttctgagagttaaatgggc

SEQ ID NO: 23519 - protein, 463 aa, Panicum virgatum
  misc_feature: Ceres CLONE 1828315
  misc_feature (36)..(246): Pfam Name: TFIIE_alpha Pfam Description: TFIIE alpha subunit
MATIASMEPFNRLVRLAARAFYDDISMKGDNQPKTSRGDNRGMAVVVLDALTRRQWVREEDLAKALKLHSKQLRRILRFFEEEKLVTRDHRKESAKGAKAHNVAAAAASSEGPPVTEGEEKIKMHTHSYCCLDYAQICDVVRYRIHRMKKKMKDELDSRNTIQHYICPSCNKRYSAFDALQLVSYTDEYFHCETCNGELVAESDKLASEEMGDGDDNVRKRRREKLKDMQQRIEEQLKPLVAQLERVKNLPAPEFGSLQTWERANIGAFANGDSSAADSSRNSQGQYGTPMPYMGDTKVEVVVDDGEKENGTESGKNGSDLKVLPPWMIKDGMNLTKEQRGETSKESKFDEKSEAKDDKKQDSKDDQIIQEEYIKAYYEALRKKQEEEEAKRRMQEEGETFVSDSQSERQVGKKYKREDEDEGIEWEEQQPTGTATEQYKLADLNAEAQESGDDEDEVEWEDG

SEQ ID NO: 23520 - DNA, 689 bp, Panicum virgatum
  misc_feature: Ceres CLONE 1828321
  misc_feature: Encodes the peptide sequence at SEQ ID NO. 23521
attccctcgttcctctgttcctcctcctcggccctcgcccagcccggccggcgcccgcgctccgcatgtcaatccatgggctgatcctggaagtcagagtcaccgggtgccggaagctgcgggacacggagttcttcacccgccaggacccctacgtcgtgctcgagtacgccaccaccaagctccgcacccgcacctgtaccgatgggggaagaaacccaactttcgatgagaagttccatatacccctcattgaagggctccgcgagttgaatgttatcgtttggaacagcaacacattatcccacgatgacttcatcggcagtggcagagtatatctgcacaaggtgctcgcaaatggatatgatgattcctcatggccacttcagacacgccacatgagatctgctggggaagtgaagctcattatgcatgttgatgtctcagcaatgaacaaaatgggtaaaagtatcggtgcagcaagtacacattctgttcctccaccttcagtgccagccggagtcccagtcccagctgcagccgcagcaccagcactagcatcagcagttccatacactggggttccaccctcatatccacctgctccagcatatcctgcggcatctgcataccctgcttacccaactcctagccaatcaccatataccactacagaatatccaccacct

SEQ ID NO: 23521 - protein, 207 aa, Panicum virgatum
  misc_feature: Ceres CLONE 1828321
  misc_feature (8)..(89): Pfam Name: C2 Pfam Description: C2 domain
  misc_feature: SWISSPROT Homolog: EC 3.1.1.4 Phospholipase A(2)
  misc_feature: Useful for making plants with altered carbohydrate content
  misc_feature: Useful for making plants with altered cell wall content and/or composition
MSIHGLILEVRVTGCRKLRDTEFFTRQDPYVVLEYATTKLRTRTCTDGGRNPTFDEKFHIPLIEGLRELNVIVWNSNTLSHDDFIGSGRVYLHKVLANGYDDSSWPLQTRHMRSAGEVKLIMHVDVSAMNKMGKSIGAASTHSVPPPSVPAGVPVPAAAAAPALASAVPYTGVPPSYPPAPAYPAASAYPAYPTPSQSPYTTTEYPP

SEQ ID NO: 23522 - DNA, 702 bp, Panicum virgatum
  misc_feature: Ceres CLONE 1828339
  misc_feature: Encodes the peptide sequence at SEQ ID NO. 23523
aacccccgcatttttcttgtaatccggggacacagccaagaagagggagacgcggccggtgcggcggcggcggcggccatggcgatccccctcgtgctcgtcgtgctcccactcggccttctcttcctcctctccggcctcatcgtcaacgctgtccaggctgtcttgttcttgtctataaggcccttgtcaaagagcttgtatcggcggatcaacagattcttggctgagctgctatggcttcagctaatctggcttgtggactggtgggctggtgttaaggtacaattgcatgcagatcaagaaacttatcagctaatgggcaaagagcatgcccttataatatcaaatcaccggcgcgatattgattggcttattggatggattttagcacagcgttcaggatgtcttggaagcacactagctatcatgaagaaatcttcaaagttccttcctgtcattggctggtccatgtggtttgctgaatacctctttttggagagaagttgggcaaaggatgaaaacacacttaaggttggtttgcagacccgaggcctccccaaagactgccaaaatattttttgtaagctgtaaatcttgctcatttgacctgatgaataatgcaacatcatcagcgtacagagagagtctctgtcctgtggaaagcagagggatttgtatcagcagtaagtattatgcgtg

SEQ ID NO: 23523 - protein, 171 aa, Panicum virgatum
  misc_feature: Ceres CLONE 1828339
  misc_feature: SWISSPROT Homolog: EC 2.3.1.51 1-acylglycerol-3-phosphate O-acyltransferase
MAIPLVLVVLPLGLLFLLSGLIVNAVQAVLFLSIRPLSKSLYRRINRFLAELLWLQLIWLVDWWAGVKVQLHADQETYQLMGKEHALIISNHRRDIDWLIGWILAQRSGCLGSTLAIMKKSSKFLPVIGWSMWFAEYLFLERSWAKDENTLKVGLQTRGLPKDCQNIFCKL

SEQ ID NO: 23524 - DNA, 641 bp, Panicum virgatum
  misc_feature: Ceres CLONE 1828349
  misc_feature: Encodes the peptide sequence at SEQ ID NO. 23525
agtacgaatagtgcgcagttgcagttttgagctggaagatggccacggcagacaccgccgcgcccagcgccgggaggtggactcttcacagcacggcggccctcgtcaccggcggcacccgcggcatcgggcgtgcggtggtggaggagctggcggcgctgggggcggccgtgcacacctgctcccgcagggaggaagagctgctcgagcgactgaaggagtgggaggccaaggggttccgcgtcacctgctccgtctgcgacgtgtcggttggggagcagcgcgagcgcctgctccgcgacgtcgtgggccgcttcggcggcaagctcaacatccttgtaaacaatgtgggaacgaactttacaaagccaaccactgaatattcaacagacgaatattcatttataatggccacgaatcttgagtcttcataccatctttgccaactcgcacaccctctgctcaaagcatctgggtcaggcagcatcgtcttgatatcgtcggtctccggagtggtgggagtatctagtggttccatctatgccatgacaaaaggtgtaatgaaccagctggccaagaacctagcatgtgaatgggccaaggacaacataagaaccaactctgttgcaccttggtacatc

SEQ ID NO: 23525 - protein, 200 aa, Panicum virgatum
  misc_feature: Ceres CLONE 1828349
  misc_feature (19)..(187): Pfam Name: adh_short Pfam Description: short chain dehydrogenase
  misc_feature: SWISSPROT Homolog: EC 1.1.1.236 Tropinone reductase
MATADTAAPSAGRWTLHSTAALVTGGTRGIGRAVVEELAALGAAVHTCSRREEELLERLKEWEAKGFRVTCSVCDVSVGEQRERLLRDVVGRFGGKLNILVNNVGTNFTKPTTEYSTDEYSFIMATNLESSYHLCQLAHPLLKASGSGSIVLISSVSGVVGVSSGSIYAMTKGVMNQLAKNLACEWAKDNIRTNSVAPWY

SEQ ID NO: 23526 - DNA, 378 bp, Panicum virgatum
  misc_feature: Ceres CLONE 1828351
  misc_feature: Encodes the peptide sequence at SEQ ID NO. 23527
agggagctctccccatccatgctaagatgtgacggagggcgcgcctcgctcactccagtgaacctgatccccaggggacacccctccctagcccctgcctccaggccggcactgcgtcgccgaccaagagaggaggagacgaataagattccctggcctcggctgctgccctgatcccgtcctccttccttcccaagaactccgaatggggcgccaacaggcaggctgcggcgcccaagccggtcaccgcgtccatggcggtcgtccgcgcccccgcctacaccgatgaactcgtcgagactgcgaacacggcggcgtcgccggggagggggatctttgccatggacgagtcaaacgcgacgtgcgggaagcggctgg

SEQ ID NO: 23527 - protein, 41 aa, Panicum virgatum
  misc_feature: Ceres CLONE 1828351
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MAVVRAPAYTDELVETANTAASPGRGIFAMDESNATCGKRL

SEQ ID NO: 23528 - DNA, 661 bp, Panicum virgatum
  misc_feature: Ceres CLONE 1828353
  misc_feature: Encodes the peptide sequence at SEQ ID NO. 23529
gggacagctgagctgcatcgtcagacacccaatctactactttcctgtcctggttgtggttgaggcaggcgaggaagtaggaaccgagatcgatccacatccactctgtgcatccagcgccaacagcagcagctgctgcagaccatgtggacggataggccgctggtccgggacgccggcgccgccgtgctcaccggagtcgccgcggctgtcgtgctccgcttctgggaggaagtagccaaccgcgcgctgctggaccagtgaccttatccaagaccaagaagaagccaggtctagagcgcaagggcaaagtggtcgccgagatcaaagacgccgtcgaacaatacagcagcgcctatgtcttcacctacgacaacatgaggaaccagaagctcaaggacctcagggagcagctcaaatcctctagtaggatatttcttgccggaaagaaggtcatgcagatagcattggggcgctcgcctgctgatgaagctaaaacaggcctgcataaactttccaagttccttcaaggtgattctggtctgttctttactaatcttccaagggatgatgtggagaggctgtttcaagaatttgaggagcatgattttgcaaggacaggaagtaccgcaacagaaacggtggaacttaaggaaggccc

SEQ ID NO: 23529 - protein, 94 aa, Panicum virgatum
  misc_feature: Ceres CLONE 1828353
  misc_feature: Useful for making plants with modulated nitrogen use efficiency
MRNQKLKDLREQLKSSSRIFLAGKKVMQIALGRSPADEAKTGLHKLSKFLQGDSGLFFTNLPRDDVERLFQEFEEHDFARTGSTATETVELKEG

SEQ ID NO: 23530 - DNA, 469 bp, Panicum virgatum
  misc_feature: Ceres CLONE 1828354
  misc_feature: Encodes the peptide sequence at SEQ ID NO. 23531
cgtacgccgtgccccgcctatcgccgaagccctaggggggcgccaccgattgccggcatggacgacgccgcggcggccgccgtggagctgcgcgaggcccaccgcctggcgggccacaacgagcgcttgtgggcgctcgcctggaaccccgccggcgccggccccgtcctcacctcctgcgggggcgacgagaccgtgaggatctgggagcgcgccccccacggcgcctggcactactctcacgtgctgcaggacacgaaaaaccgggcggtgaggaccagcgcctgggccccccacggcaggctgatggcctcctcgagcttcgacgccaccaccgcggcgtgtaagtccttcagcacgaactaccactgcgacccctctctggaggggcaagataatttacgtgaaaaactcgacgagcagatcatcccgttagaagctcataacgggcctccggaacctgatgatg

SEQ ID NO: 23531 - protein, 137 aa, Panicum virgatum
  misc_feature: Ceres CLONE 1828354
  misc_feature (11)..(51): Pfam Name: WD40 Pfam Description: WD domain, G-beta repeat
MDDAAAAAVELREAHRLAGHNERLWALAWNPAGAGPVLTSCGGDETVRIWERAPHGAWHYSHVLQDTKNRAVRTSAWAPHGRLMASSSFDATTAACKSFSTNYHCDPSLEGQDNLREKLDEQIIPLEAHNGPPEPDD

SEQ ID NO: 23532 - DNA, 538 bp, Panicum virgatum
  misc_feature: Ceres CLONE 1828383
  misc_feature: Encodes the peptide sequence at SEQ ID NO. 23533
ataaataaatgctccaccaccacagcagcagcatcatgcagaggatatgatgcgggcgcagccggcggaggtggacggcgacgccccggcgctgcggtccgccgcggacgccgcgcgcatggtgtgggacgagtcgaagcgcctgtggggcatcggcctccccatcggcgtgggcacactcagcatgtacgccatcagctccgtgacccagatgttcatcggccacctcggcaacctccccctcgccgccgcctccatcggcctctccgtcttcgccaccttcgcgctcggcttcctcctcggcatgggcagcgcgctcgagacgctctgccgccaggccttccgcccccgccaggtcgccatgctccgcgtctacctccagcgctcctggatcatcctcctcgccaccgcgctgctcatgtcgccgctcttcgtcttcgccggcccgctgctcctgctcatcggccaggacccggaggtcgcgcgggaggtcggcaggttcgcgctctacatcctcccctccgtcttcgccatggcc

SEQ ID NO: 23533 - protein, 163 aa, Panicum virgatum
  misc_feature: Ceres CLONE 1828383
  misc_feature (39)..(163): Pfam Name: MatE Pfam Description: MatE
MMRAQPAEVDGDAPALRSAADAARMVWDESKRLWGIGLPIGVGTLSMYAISSVTQMFIGHLGNLPLAAASIGLSVFATFALGFLLGMGSALETLCRQAFRPRQVAMLRVYLQRSWIILLATALLMSPLFVFAGPLLLLIGQDPEVAREVGRFALYILPSVFAM

SEQ ID NO: 23534 - DNA, 681 bp, Panicum virgatum
  misc_feature: Ceres CLONE 1828384
  misc_feature: Encodes the peptide sequence at SEQ ID NO. 23535
gcacgcacgcaagtacccaaccgcgacccacctgctcctctcccctctccccacctcgccgctgcctctcccgcttccggcggccaccgcgcccattgtgaccgcgcggggcacggagcgaccgggctggtctagggcccttcccttcggaactccaccaagaagcagagggggcggggcgccagctttcttggatcgattgctcccgagctgacgaagcagaggattactcgtcccgtgcggctgccatgtctgtggagctcatcctgtggctcttctccttcgcctccgtcatggtcctcatcggcctcaccgcataccagcttatctgtttgtctgatttggagtatgactatatcaacccatatgattcatcatctcgcatcaatgcggtggtccttatagaatacttacttcaagcagccctgtgtgcttcattcctcttgacgctacattggttcccctttttagtcatggcacctgtaacttactaccatgtgaaactgttcatggctcggaaacatctggtagatgtcactgaaatttttagacaattaaatggcgagaagaagtacaggatgatcaagcttggcttctacttctgcctatttattattactatttacagccttgtgatgacagctgtgatgctgtttattgacgaggatgtaaatctggtag

SEQ ID NO: 23535 - protein, 144 aa, Panicum virgatum
  misc_feature: Ceres CLONE 1828384
  misc_feature (4)..(127): Pfam Name: Cornichon Pfam Description: Cornichon protein
MSVELILWLFSFASVMVLIGLTAYQLICLSDLEYDYINPYDSSSRINAVVLIEYLLQAALCASFLLTLHWFPFLVMAPVTYYHVKLFMARKHLVDVTEIFRQLNGEKKYRMIKLGFYFCLFIITIYSLVMTAVMLFIDEDVNLV

SEQ ID NO: 23536 - DNA, 1224 bp, Panicum virgatum
  misc_feature: Ceres CLONE 1828394
  misc_feature: Encodes the peptide sequence at SEQ ID NO. 23537
gtgtccacgccgctgcgctgcgccccaaatccgaatcccccaaccccaaaccaaacccccaattcctcagggaggcgaattcgagtgaggtcagatcagaccccgcagccatcaggggatccaaatccaaatccatctgatcagatctctccgacccccatccccatggcgatcgtgtacgcgctggtggcgcgcggcaccgtcgtgctggccgagttcgccgccgtctcgggcaacgccggcgccgtcgcccgccgcatcctcgagaagctgccgcccgacgccgactcccgcctctgcttcgcgcaggaccgctacatcttccacgtcctccgcgccgacgccggcatcaccttcctctgcatggccaacgacaccttcggaaggaggatcccctttctctacctggaggatatccagatgaggttcatgaagaactacggcagagtcgcgcactccgcgctcgcctatgccatgaacgatgagttctccagggtcctccaccaccaaatggagttcttctccagcaaccccagcgccgacacgctcaaccgtctccgtggagaagtcagcgagatacacaccgttatggtcgacaacatagagaaaattctagacagaggtgaccgcatctcactccttgtcgacaagacatccaccatgcaagacagcgctttccacttccgcaagcaatccaagaggctccgcagagcgctttggatgaagaatgccaagcttctagctgtgttgacggttgccatagtagtgctactctacttgctcatttctgctttctgtggaggcctttccctaccatcatgcagatcatgaataatggctgtccctcgttcggagcatacacggttccccaccgtattgagcgcctgagctcgcagagccagaacggatgctttgagaagtaggcttgcaatgtggtttccagttagagggagtttgttttttgccggcatgagctttctgaagtgattcctgcaaaaacgggttcagaatgtacagtagtgaacagttgtttcaaggagcggagttgccctttgctgtacttatctctttcctgatgtggcctttcgtggatgagtctaatgtcttggattgtgcttgtgtggatgggtttggggtctagtgctgcctgctatctatatatattacatgtgtactctgcagtgaatgttaattgtatacttttgttagcagtctatcagaatt

SEQ ID NO: 23537 - protein, 221 aa, Panicum virgatum
  misc_feature: Ceres CLONE 1828394
  misc_feature (124)..(212): Pfam Name: Synaptobrevin Pfam Description: Synaptobrevin
  misc_feature: Useful for making plants with modulated heat sensitivity
MAIVYALVARGTVVLAEFAAVSGNAGAVARRILEKLPPDADSRLCFAQDRYIFHVLRADAGITFLCMANDTFGRRIPFLYLEDIQMRFMKNYGRVAHSALAYAMNDEFSRVLHHQMEFFSSNPSADTLNRLRGEVSEIHTVMVDNIEKILDRGDRISLLVDKTSTMQDSAFHFRKQSKRLRRALWMKNAKLLAVLTVAIVVLLYLLISAFCGGLSLPSCRS

SEQ ID NO: 23538 - DNA, 649 bp, Panicum virgatum
  misc_feature: Ceres CLONE 1828395
  misc_feature: Encodes the peptide sequence at SEQ ID NO. 23539
atgccggaaagaggaggggaggggagaagcgaacgcgtcagccaaaccctagcccagtgcgagacgggcgggagctccaccgcgtcggtcgccgccgccgccgcttctcaacatggccgattccccgcgcaggaggtactcaaggtccccttccccttacagccgggggcacccgaaagcaaggtctaggtcacggtctccagctcggtctcagtctaggtcacctgtgcctgatcctagatctcagggaaggtcaagatctataagccatgagagggaggaggaggctgttaaccgtggaaatactttatatgtgactggactctcttctagggtgactgaaagggaaattaaagattatttctcgaaggaaggaagggtggttggttgccatgttgttcttgaaccccatacacgtgtttcgcgtggatttgcctttgtcaccatggactctgtggaagaagctgaccgttgcatcaagtatcttaacaattctgtgatggaaggtcgaaacattacagttgaaaagtcacgccgtggtcgcccaatgacgtcaactcccggaagctatcttggccaccggtatgagcgcagagaacgtgggagatactgtcgtggctatggtggtggtcgtgatgagtattatggg

SEQ ID NO: 23539 - protein, 178 aa, Panicum virgatum
  misc_feature: Ceres CLONE 1828395
  misc_feature (66)..(137): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MADSPRRRYSRSPSPYSRGHPKARSRSRSPARSQSRSPVPDPRSQGRSRSISHEREEEAVNRGNTLYVTGLSSRVTEREIKDYFSKEGRVVGCHVVLEPHTRVSRGFAFVTMDSVEEADRCIKYLNNSVMEGRNITVEKSRRGRPMTSTPGSYLGHRYERRERGRYCRGYGGGRDEYY

SEQ ID NO: 23540 - DNA, 531 bp, Panicum virgatum
  misc_feature: Ceres CLONE 1828408
  misc_feature: Encodes the peptide sequence at SEQ ID NO. 23541
aagccacacaatcacaatcccaacgagtaaggcccctgtctcagccctctccgcgaagatggtcgtgttcgccaaagcagcgctagcgctcctcgcctgcgtcctctgctgctacgcccccaccccgtcctcggccgccgccgccgacttcctccggtgcctctcggcgtccgtgccgagccagctcgtgttcacccccggctcgccttccttcacctccgtcctggcgtcctccgtccggaacccaaggttcctaaccctcggcacggtgcgcccgctctgcgtcgtcgcggccgccaacgcctcccacgtccaggccgcggtcctctgcggccgccgccacggggggcgcctccgcgtgcgcagcggcgggcacgactacgaaggcctctcctacccgtccgtgcgcccggaggagttcgcggtcgtccaccttgcccgcctccgcgacgtgggcgtcgaccgcgccgccgccgccgggcgggtgggctccggcgccaccgtccgggagctctactacgccgtggccgc

SEQ ID NO: 23541 - protein, 157 aa, Panicum virgatum
  misc_feature: Ceres CLONE 1828408
  misc_feature: SWISSPROT Homolog: EC 1.21.3.3 Reticuline oxidase
MVVFAKAALALLACVLCCYAPTPSSAAAADFLRCLSASVPSQLVFTPGSPSFTSVLASSVRNPRFLTLGTVRPLCVVAAANASHVQAAVLCGRRHGGRLRVRSGGHDYEGLSYPSVRPEEFAVVHLARLRDVGVDRAAAAGRVGSGATVRELYYAVA

SEQ ID NO: 23542 - DNA, 362 bp, Panicum virgatum
  misc_feature: Ceres CLONE 1828412
  misc_feature: Encodes the peptide sequence at SEQ ID NO. 23543
aagcgcccccccccccccccccgcccaccgcctgaccccctccgctcccctccctagtcctccgagagaccttcccccagcgagtcccactcccaaaggccgccatgaggtcctctctgctgaaatccccgtcccagctcctccccccccgccgcggctactcctcctctgcccacccggagcggaaggtggccatcctgggcgcggctggtggcatcgggccgccgctctccctcctcatgaagctcaacccgctcgtctcctccctctccctctacgatatcgcggggaccgtcggcgtcgctgccgacgtgtcccacatcaacacccccgccctggtgaaggggttcatgggggatgac

SEQ ID NO: 23543 - protein, 85 aa, Panicum virgatum
  misc_feature: Ceres CLONE 1828412
  misc_feature: SWISSPROT Homolog: EC 1.1.1.37 Malate dehydrogenase
MRSSLLKSPSQLLPPRRGYSSSAHPERKVAILGAAGGIGPPLSLLMKLNPLVSSLSLYDIAGTVGVAADVSHINTPALVKGFMGD

SEQ ID NO: 23544 - DNA, 677 bp, Panicum virgatum
  misc_feature: Ceres CLONE 1828426
  misc_feature: Encodes the peptide sequence at SEQ ID NO. 23545
atctgcatcgttcctcctcacccagccttgcagattgcaggatctccagcacctccacgcctcgatccagatccagcagctgaaagatggatgcgaacagacgccagagtggaattcagcagttgttggctgcagagcaagaggctcagcaaattgtaaatgcagctagggcagccaaatcggcaaggcttagacaagccaaggaggaagctgagagggaaatagctgaataccgctcccaaatggaggctgaattccagagaaaagttgcagagagtagtggtgactccggtgcaaatgttaaacgtcttgagcaagagacagcggcaaaaattgaacaactcaatcaacaggctgcaagtatctcccctgaagtcattcagatgctgctgaggcatgtgaccacagtgcattttactcctaattctttatatcagagaggagtaataaaggatttgtcacttataactgtaattctgtgttcttgttcacagaataagctgctgcagtttagcagcaaacctgtctattactatcaaaacttggtggtcatttggtaaaaaaaaaaaaaaaaattcccactccaacaagagccgccagttcgacaaaccccggccccgcagcaaggatttctgcaccgaatcccttcgtgacccaatgggggaggcttcgccgtc

SEQ ID NO: 23545 - protein, 157 aa, Panicum virgatum
  misc_feature: Ceres CLONE 1828426
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLAAEQEAQQIVNAARAAKSARLRQAKEEAEREIAEYRSQMEAEFQRKVAESSGDSGANVKRLEQETAAKIEQLNQQAASISPEVIQMLLRHVTTVHFTPNSLYQRGVIKDLSLITVILCSCSQNKLLQFSSKPVYYYQNLVVIW

SEQ ID NO: 23546 - DNA, 346 bp, Panicum virgatum
  misc_feature: Ceres CLONE 1828440
  misc_feature: Encodes the peptide sequence at SEQ ID NO. 23547
tgagcgttgctgacaccgtcatctactaccagctcgctcttgagtggcccggagagtactgcgaggagaccagcgccgggtgctgcacggcgacgaccgatatgtcggcgagcgaccgacttctccgtctcccgcttcaccgcctacgacgcgacgaccaaagctccggtgtcgggctgcaacaacgctgctcctttcgaccgaaaccagattaccgacatccagggcccgtaccagtactggagcagcatcacgtgccccaccaacaacggcaggaagaactgggaaaacacctggaatcagtccggcgcctgctccggcctcgaggagaaggactacttctagg

SEQ ID NO: 23547 - protein, 113 aa, Panicum virgatum
  misc_feature: Ceres CLONE 1828440
  misc_feature: SWISSPROT Homolog: EC 3.1.27.1 Ribonuclease T(2)
ALLTPSSTTSSLLSGPESTARRPAPGAARRRPICRRATDFSVSRFTAYDATTKAPVSGCNNAAPFDRNQITDIQGPYQYWSSITCPTNNGRKNWENTWNQSGACSGLEEKDYF

SEQ ID NO: 23548 - DNA, 505 bp, Panicum virgatum
  misc_feature: Ceres CLONE 1828457
  misc_feature: Encodes the peptide sequence at SEQ ID NO. 23549
accagcttaccctttcatctgttactttttatctagacgcagcctgctcaactatggccgtgtctgaggcggcggtcgacggcgtcatcttcccgccggtggcacagcaggagggctccggccgctcgcacttcctcggcggcgcacgtgagcgagggatggagattggcgcctacttcttcaagttcacggtcatcggcgtgtacctggaggagggcgaccccgtgaccaccctggccaagaagtgggctgcgaattccacccacgagcacgccgccgacatcaccttcttccgcgacgtcgtgacgggcgacttccagaattccacgagggtgacgatgatcatgccgctcacagccaatctccactcgcacaaagcgacgcataactgcgaggcgaaccggaaggccatcggcgcatacacggacgccgagggcgcctccgagaacaaattcaaggaggccttcaagaccgagacgctaccgccgggcgcgtccatcctctt

SEQ ID NO: 23549 - protein, 150 aa, Panicum virgatum
  misc_feature: Ceres CLONE 1828457
  misc_feature (1)..(150): Pfam Name: Chalcone Pfam Description: Chalcone-flavanone isomerase
  misc_feature: SWISSPROT Homolog: EC 5.5.1.6 Chalcone isomerase
MAVSEAAVDGVIFPPVAQQEGSGRSHFLGGARERGMEIGAYFFKFTVIGVYLEEGDPVTTLAKKWAANSTHEHAADITFFRDVVTGDFQNSTRVTMIMPLTANLHSHKATHNCEANRKAIGAYTDAEGASENKFKEAFKTETLPPGASIL

SEQ ID NO: 23550 - DNA, 569 bp, Panicum virgatum
  misc_feature: Ceres CLONE 1828465
  misc_feature: Encodes the peptide sequence at SEQ ID NO. 23551
cccgaccacgtgacaccctcgcgcgcccaccacacctccgggctccggctgccccgccccgcctccctcgcgccgggaatggcctgctcccgcctcgccgcggcgccatccgcggggcccgccgcggcccgggcgcgctcgccggcgtcttcgacggcacccgccttcgcgcgcgtcccggcggcgcaccgttacacgagcggcgggctgtcagtcaggggcgggaaggcggcgtcccccgtggccgtcggcgcggggccggccgcggcggcgccggtggcgggcctggacggccgcccggccaccgcgaagcatcccatcatcgtcatcgataactacaacagctttacctaccacctgtgccactatatgggggagcttggattaaacttcgaggtatatcgcaatgatgaactgaccatagaggatgtcaaaagcaacaacccaataggaatacttatttctccaggggctggcgaaccgcaagattctggtatatcattgcagactgttcttgaattgcgcccaaccatcccaatttttggagtttgcatgggtctgcagtgcat

SEQ ID NO: 23551 - protein, 163 aa, Panicum virgatum
  misc_feature: Ceres CLONE 1828465
  misc_feature: SWISSPROT Homolog: EC 4.1.3.27 Anthranilate synthase
MACSRLAAAPSAGPAAARARSPASSTAPAFARVPAAHRYTSGGLSVRGGKAASPVAVGAGPAAAAPVAGLDGRPATAKHPIIVIDNYNSFTYHLCHYMGELGLNFEVYRNDELTIEDVKSNNPIGILISPGAGEPQDSGISLQTVLELRPTIPIFGVCMGLQC

SEQ ID NO: 23552 - DNA, 1431 bp, Panicum virgatum
  misc_feature: Ceres CLONE 1828489
  misc_feature: Encodes the peptide sequence at SEQ ID NO. 23553
agccaccaccaccagcgccgcctccgttgttcgtttgctccacgggacggcggccggcgcagcaattctttcttccgtacacacaccatatatatatatccgctcgccgccgccataatgtctgctgccgccaccgcttgcatgcctctggtccctcctccgtctcctctccagggatcgaccgggaagccggcaatggcggccgccgaggtcggcgagaggcggaagcccggtggcatggagactgacatgactcagagccatggcagcgaggagcagcggcgagccatggacaacggcgatggcgaagtgacgatgagcgagccgcgggcggtggtgcggacgctggcgtgcgagcgcaagccctacgtggagggcttcgcgctctggcggatcatcggcaggcctgagctgccagagttggatcctatcctttctttcgacgagttcgagttttctgcaccagctgcctttcctgaccatacccacagagggtttgagaacgtcacctatatgctcaagggaggcgtcagttaccatgacttttcagggcacaagggcaccatcaaagaaggagatgttcagtggctgacggctgggcgcggcgtcgtgcacgcggaggtgcccgccggcaatggcgtgcagcggggcatcaacatctgggtcaacctctccgccaacgacaagatgatggagccgaggtaccaggacctggcgagccacgacatccccgccgccgccacgggcgacggcggcgtctccgtcaaggtcatcgcgggcgagtgcctgggcgcgcgctccccgctgcggccgcgcaccccggcgctgtgcctcgacgtcgccctgcggcccggcgcgcgcctccgccagcccgtcccgcgcgggtggagcgcgtgcgcctacgtcatcgccggcgaggccgtgttcggcgacgcctccgctggggcgcgcacgctcgtcgtgttcggcgccgacggcgacggcgtggacgtgcgggccgcggaggggctcgccgcggcggggggcgcgagggtgatgctcgtggcggcgcggcctcacggcgaggcggtggtgcgggacgggcccttcgtcatgaacacccgggaggaggtggagcaggcgcgggaggacttccgccgccgccagaacggcttcgagatggccgacggctggacctccgaccacgccgccaccgccgccatgcgctgatactctcaatttggaatcaatgttcgtgcaagtgggtggctatgaattgtatctggattcctacatacgtggaccccgtttggcattgcagtgggagcacgatgatctagtaccaacgagcacggttctaaagttcggcaaaattaattctaagaatttcagacttgtcaaccagagaaattttagccaaaattaaagttaacactacactgttggtttgcg

SEQ ID NO: 23553 - protein, 363 aa, Panicum virgatum
  misc_feature: Ceres CLONE 1828489
  misc_feature (87)..(183): Pfam Name: Pirin Pfam Description: Pirin
  misc_feature (238)..(345): Pfam Name: Pirin_C Pfam Description: Pirin C-terminal cupin domain
MSAAATACMPLVPPPSPLQGSTGKPAMAAAEVGERRKPGGMETDMTQSHGSEEQRRAMDNGDGEVTMSEPRAVVRTLACERKPYVEGFALWRIIGRPELPELDPILSFDEFEFSAPAAFPDHTHRGFENVTYMLKGGVSYHDFSGHKGTIKEGDVQWLTAGRGVVHAEVPAGNGVQRGINIWVNLSANDKMMEPRYQDLASHDIPAAATGDGGVSVKVIAGECLGARSPLRPRTPALCLDVALRPGARLRQPVPRGWSACAYVIAGEAVFGDASAGARTLVVFGADGDGVDVRAAEGLAAAGGARVMLVAARPHGEAVVRDGPFVMNTREEVEQAREDFRRRQNGFEMADGWTSDHAATAAMR

SEQ ID NO: 23554 - DNA, 1675 bp, Panicum virgatum
  misc_feature: Ceres CLONE 1828536
  misc_feature: Encodes the peptide sequence at SEQ ID NO. 23555
aaggcgaaatccgcacacaacacgagagacacaacccacagagatagagagagaatgtcatctcctttagtgaccggcgggtgctttgctcttaagtccaagattaatggcaaatacttgcgctactcgcctgagaaagagaaaatccttgaggtgagtggggaagatgtcctcagtccctacactaggtttcgtgcagagctatccagggagcacgacggccacgttcacatcagatgctgctacaacaacaagtactgggtcgcccgtgaggttaaccagcagtggtgcctcatgggtgatgcaaatgagccccaagaggacctatcagatccttcttgcacggtgctccggcatgaacccagcagtgttcacgtcgacgatgtcaacttggagcacgccaggctcaaaacaagtgtttacatgctcgccgatgctcatccaaccgaaaagaccctcagagctggctccttgctgctaggaaacaaagataaaccagcagatgaagaagatgcctacatgtttagtgtcatcaatctagaaggacaaatgctactgcccaaacacgtttgtttcaagggtgacaatggcatgtacctcagggcgaggaaggttgaatgggacctcaactacttggagttttcgtcggatgacattgctgatccaacagtgagaaacatcattcacacaaacagcgatggcaccatccgcatatactcgagtcactatggtaagttctggaggcgcagccccaactggatctggggagactctaatgacaccaccagtaggaatcttgacacggtgttccgagtgctcttgcttgggggcggcaaatgtgcacttcagaacctcggcaacaacaactactgcaagaggttgaccaccgaaggcaagacgaattgcctcaacgctgcggttcctaccatcacaagggaggcacagctagagctgcatgaaactgtcctatctcgtaggatctatggtgttgagtaccgcttcaaagatgttaatattcatggcctcaagccccgtactttttacactaaaacaattactaacaacacaagtgggccccacaagaatacgctaaccatatcttacagtgtaacgacggagaggagatgggattcaaatgtctcatggaagcttggtgtgacaaccaccatcacggctggggttccagaaatcgcagagacatcagttgagatctcaagtgagtttagtggatcatacacctggggagaaactacatatgacaaagtaaagcaatcaaatgaagaacaaattgaggtgcctgcacacagcaaggtgacagttcgagtggtggcaacagagggaatatgtgagtttcccttctcatacatccaagaggatattttaacaaccggagagaaagttgttaccaagatgcatgatgggatctaccgtggagtcaacagctatggtttcgagacacaggtcaacgaatagaagatctgagaagacaactcaataatgcaatctgagaagcccgcatattgccagtatgatgggatctaccgtgtgcttttatttgatgtgttttatgttgcgtgtgcgctattatgtactgtactttgtaataatactttccttaactcgttaaggggagacggtttgttggattattaagaatgatttcactactttgcac

SEQ ID NO: 23555 - protein, 472 aa, Panicum virgatum
  misc_feature: Ceres CLONE 1828536
  misc_feature (166)..(302): Pfam Name: Agglutinin Pfam Description: Agglutinin
  misc_feature (10)..(161): Pfam Name: Agglutinin Pfam Description: Agglutinin
MSSPLVTGGCFALKSKINGKYLRYSPEKEKILEVSGEDVLSPYTRFRAELSREHDGHVHIRCCYNNKYWVAREVNQQWCLMGDANEPQEDLSDPSCTVLRHEPSSVHVDDVNLEHARLKTSVYMLADAHPTEKTLRAGSLLLGNKDKPADEEDAYMFSVINLEGQMLLPKHVCFKGDNGMYLRARKVEWDLNYLEFSSDDIADPTVRNIIHTNSDGTIRIYSSHYGKFWRRSPNWIWGDSNDTTSRNLDTVFRVLLLGGGKCALQNLGNNNYCKRLTTEGKTNCLNAAVPTITREAQLELHETVLSRRIYGVEYRFKDVNIHGLKPRTFYTKTITNNTSGPHKNTLTISYSVTTERRWDSNVSWKLGVTTTITAGVPEIAETSVEISSEFSGSYTWGETTYDKVKQSNEEQIEVPAHSKVTVRVVATEGICEFPFSYIQEDILTTGEKVVTKMHDGIYRGVNSYGFETQVNE

SEQ ID NO: 23556 - DNA, 1232 bp, Panicum virgatum
  misc_feature: Ceres CLONE 1828541
  misc_feature: Encodes the peptide sequence at SEQ ID NO. 23557
aggcgctgagcgtcctcacccccaaaatcctctcccggcacgctcctccctccctctcttatcccctccctcccccctcgcgcggcgccaccatggcctcctccgtcgcggcgtccctccgcgcgctcgcctccagcacccccgcctccctcgcgaagcccagcgccaccccgtcccccttcctcgtcctcctcgccccgaccccgccccgccgcccgctcggcctccgctccgcccgccgcctgccgctcgcaccgctcgccgcctccgactccttcgagtcctccgtcggcgtcgactacgcggagccggccgccgccgagtccggtcgggaggaggaggaggacgctgccgccagggcgtccgccgccgtcaaggaggccgcggacgagggtgacggcgaggaggtcggggagtacgtcgagccgcccgaggaggccaaggtctacgtcggcaacctgccctacgacgtcgacagcgagcgcctcgcgcagcttttcgagcaggccggtgtcgtcgaggtctcggaggtcatttacaacagagaaacagatcggagccgtggatttggttttgtcactatgagtactgtcgaggaggctgagaaggctgtggagatgttccatcactatgatatcaatggaagacttcttactgtaaataaagcagctcctagaggctctcgtgtggaaagacctcccagacaatttggtggtccttctttcaggatttatgtgggcaatctgccatggcaagtggatgactctaaattggtgcagttgttcagcgagcatggcaaagtggttgatgccagagttgtctatgaccgagaatctgggcgctcgcggggatttggttttgtcactatggcaacacaggatgaattggatgatgctattgctgcccttgatggacagagtttggatggccgtgccctgcgagtgaatgttgcagaggagcgaccccggcgaggtttctagtgaggctgtgtgggggtggacagcaggcttgttccataggacagggtggtctgatactggtttagaccctgcattctcttttcttgtgttctgggctcccgatcaccctgtcttattgtgaagggggaagtgttctctgctatttcattaactgttggttgtgctcatgagttcatgtattgtaggctactgttatggtgcacctagctcaatttgtcgatgcaattcgaaattttgtctgacatctgttcg

SEQ ID NO: 23557 - protein, 295 aa, Panicum virgatum
  misc_feature: Ceres CLONE 1828541
  misc_feature (213)..(284): Pfam Name: RRM_1 Pfam Description: RNA recognition motif. (a.k.a. RRM, RBD, or RNP domain)
  misc_feature (118)..(189): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASSVAASLRALASSTPASLAKPSATPSPFLVLLAPTPPRRPLGLRSARRLPLAPLAASDSFESSVGVDYAEPAAAESGREEEEDAAARASAAVKEAADEGDGEEVGEYVEPPEEAKVYVGNLPYDVDSERLAQLFEQAGVVEVSEVIYNRETDRSRGFGFVTMSTVEEAEKAVEMFHHYDINGRLLTVNKAAPRGSRVERPPRQFGGPSFRIYVGNLPWQVDDSKLVQLFSEHGKVVDARVVYDRESGRSRGFGFVTMATQDELDDAIAALDGQSLDGRALRVNVAEERPRRGF

SEQ ID NO: 23558 - DNA, 1780 bp, Panicum virgatum
  misc_feature: Ceres CLONE 1828560
  misc_feature: Encodes the peptide sequence at SEQ ID NO. 23559
gacccagccagctaaccaaccactgctccgctgccctggtcgtctacctccctttcctctcctcgctccctcgatccagttcccctctctttcactcgttaggaaaggaaatagccggatcgatccgctgctgctgctgctgctgctgctaaagggcaaagggaagaacagcaattgcttaattggagtcggtaacatatgatgagatgggggaacagtgggcaggccgcggattccttctaccaggtccgcccggattgcagccaaaacgtccccagcaccaagttcaagatcaaggccggcaagacattgagcgtgcggaaatggcacgctgcgtttacgcgtgaaggctgcttggacatcgcttctgttctaagccgcatacagagagggggtgtccaccctgccatcaggggggaggtttgggagttcttgcttggctgctatgatcctgggagcaccttcgatgagcgggaccagattaggcacaggagaaggatgcagtatgctagatggaaggaagagtgccgagagatggattctcacgttagcagtggtaaaattatcactgccccaatcatcactgaggatggattccctatcaatgatccattggttttactcgaggctacgcaaggtacttccagcagcagcagcagcagcagcaccaccagagttgaggtcagcgactccacgaaccgtgtcactgataggcaaatcgttgactggaagcttacgctgcatcagatcggccttgatgttctacgcactgaccgctccatggtattttatgagaacaaagaaaatcttcaaaagttgtgggatattctagctgtatatgcatggattgacaaagaagtcggttattgccaaggaatgagtgatttatgttcgcccatgatagtactgctgaacgatgaagcagatgcattttggtgctttgagaggttgatgcgtaggctgagagggaatttcagatgcacacagcagtctgttggagtggaaaaccagcttcagcatcttgcttctatcattcaggtgctcgacccgaagttacatgaccacctagaaacacttggtgggggtgactatctctttgcatttcgcatgttcatggtattgttccggcgagaactatcgtttggggactccttgtacctttgggagatgatgtgggctctagaatatgatcctgacatctttacttatgacgaaactggagttgcaactcacaaaattgaaggatctaaaccaaaggtaaaatcaatacgtcagtttggcaagtacgagagagagaatatgaagaatggggtaaatgatggtgatggacctgtccctatttcggttttcctggttgctagtgttctgaaagagaacagtccaaagcttctgcaagaagctcaagggattgatgacgttatcaggatattgaacaatgttaacgggcatttggatgcgaaaagaacctgtgctgttgcactgaagcttcataggaagtacctcaaaaagatgcagggaaagaaaacctaagaccgatggtgagataccgatacagcatatgtgacttaccacacggggttgtaaagagcatgatgtagagattttagagtacagtagttgtttttgtaaaacagtgttgaccccatgattgttctcggcttccatgtattgagtgagtgaagactgaataatgtaatcatccactgtaatagggcttggggttcaacgatgcaagttgaaatgtattactcgtcaacacatgaaaattgtactacttctg

SEQ ID NO: 23559 - protein, 443 aa, Panicum virgatum
  misc_feature: Ceres CLONE 1828560
  misc_feature (150)..(344): Pfam Name: TBC Pfam Description: TBC domain
  misc_feature: SWISSPROT Homolog: EC 3.1.2.15 Ubiquitin thiolesterase
MMRWGNSGQAADSFYQVRPDCSQNVPSTKFKIKAGKTLSVRKWHAAFTREGCLDIASVLSRIQRGGVHPAIRGEVWEFLLGCYDPGSTFDERDQIRHRRRMQYARWKEECREMDSHVSSGKIITAPIITEDGFPINDPLVLLEATQGTSSSSSSSSTTRVEVSDSTNRVTDRQIVDWKLTLHQIGLDVLRTDRSMVFYENKENLQKLWDILAVYAWIDKEVGYCQGMSDLCSPMIVLLNDEADAFWCFERLMRRLRGNFRCTQQSVGVENQLQHLASIIQVLDPKLHDHLETLGGGDYLFAFRMFMVLFRRELSFGDSLYLWEMMWALEYDPDIFTYDETGVATHKIEGSKPKVKSIRQFGKYERENMKNGVNDGDGPVPISVFLVASVLKENSPKLLQEAQGIDDVIRILNNVNGHLDAKRTCAVALKLHRKYLKKMQGKKT

SEQ ID NO: 23560 - DNA, 1138 bp, Panicum virgatum
  misc_feature: Ceres CLONE 1828567
  misc_feature: Encodes the peptide sequence at SEQ ID NO. 23561
atccatccgtcggtggcacaccacccttctctccctcttcctctccctctccattagctcgcgcgcgcgtagggtttcccgcaccagtcgcccctcgcgccgccgccgaggccgagcacgccggaccgcgggactgcttcggggcgccgccgaccgcgcgcggctctcctcccgcctcgggcgacggccctccgccaggctcgcccgaccgcagcaaggcgccgccgccgccgcatcagtactcctctaggccgtgaaaggtgacttctaaggttttctacactggcaccttcgtctacggcttcctgctcaccgccggaagctactcagtacaacttccgtgtgaaacgagcgaagcgagaaaccaagcataagcaggattgcaatggccacatcagcataccctccacctcctccattttaccgactttacaaggattacgagcaggatccctcatctgcaccagaacctccaccgccaattgatggaaaatatgaagtatttggtgttacgcgcgaaataaatgaggtgttgccaagcttggagagtcaaggtatccgtcagctttatccaaagggccccaatattgatttcaagaaggagctaaggaccctcaacagagagcttcaattgcatattttggagctggcagatattttagtggagagaccatctcagtatgctcgcagggtagaagatatttcagtcatattccagaacttacaccatctgctcaattccctacggcctcatcaggcaagggccacattgattcacatgcttgagagccaaattcagcgtcgcaagcaggcaattgaagatataaaacagaggagagaggaagcgcaaaagctgcttggcgaatcactgcttgtcttagacggaagccaaactaattaggctgatgccaatttggctgttacaagacaattaagtgctctgagttaaagagatctaaataatccttagattcaatagcttgcggagcaaaccaagagacgcgttgagatatttctggtttgtggtatctgttggggccttttggtattttcaactttgatcactgaatcttgtacatgctttaatggtcaatgctaacttgcttaactgtgatgtttacgttctgtactttttctc

SEQ ID NO: 23561 - protein, 171 aa, Panicum virgatum
  misc_feature: Ceres CLONE 1828567
  misc_feature (1)..(166): Pfam Name: MED7 Pfam Description: MED7 protein
MATSAYPPPPPFYRLYKDYEQDPSSAPEPPPPIDGKYEVFGVTREINEVLPSLESQGIRQLYPKGPNIDFKKELRTLNRELQLHILELADILVERPSQYARRVEDISVIFQNLHHLLNSLRPHQARATLIHMLESQIQRRKQAIEDIKQRREEAQKLLGESLLVLDGSQTN

SEQ ID NO: 23562 - DNA, 117 bp, Panicum virgatum
  misc_feature: Ceres CLONE 1828582
  misc_feature: Encodes the peptide sequence at SEQ ID NO. 23563
taaaccgagaagaacgtagccagctggactggccactgttgttaagcatcgggattggtgcagggaaatggcttgcacatctccaccacacctgccatcctgatagttcttcccccc

SEQ ID NO: 23563 - protein, 38 aa, Panicum virgatum
  misc_feature: Ceres CLONE 1828582
  misc_feature: Useful for making plants with altered carbohydrate content
NREERSQLDWPLLLSIGIGAGKWLAHLHHTCHPDSSSP

SEQ ID NO: 23564 - DNA, 1232 bp, Panicum virgatum
  misc_feature: Ceres CLONE 1828590
  misc_feature: Encodes the peptide sequence at SEQ ID NO. 23565
aatcgccatctccttcgctgcccccgctccgccgcacgtcccaccacgcctcgctccaccgctcgccgcgccgccgcccttgcacgtccctccgcacgttgaggcccggaacgtctgccggtccgccgggctcttgcgctgaggcgccgccacggagtccacccatcaaagccctcccgtcgcgcgactccccttacccgccgccgacgcaggagccgtggatccgcgccgtcctgctgcagtgccagccctgctaatgcatgagccacggatccgcgctgtcccgctgccgtcccgcctgagtgcctgaccgatgcgcacgccacggatccgccgccgcttcggcctcctcctgccccacgacggtctcggcacccagtgatcggctcccgaatagcggcgccggagtggtggccctggtagcagtggagctgtggtgcgggatggtggtgggatcatgcgtcactgtggtggcgcggccatgggatgcgtcactatgggggtgttgggcggatccgatctggtgaagattatcgagcaactcggcagaacagttattactgactatgattacgtcgttgcacacacgaacggagagctaattggaactcaagtaagtctttgggcaccgcaagcaagtcttgtatccagtgacgggctgaatctgatatcaacaaatttagttgcaaggaaatgctagtaaaggaagcaaaatcaaagtttgaaatcatttctcggagaagacaagctgaaggaatttattaatttcacccttcattacattgcagacttggatatcccaattaaaaggggtaccttcatagagttccgaagaggaatgattaatgtttctccgataggaagaaactgtagtcaagaataacgtgatgaaaattcgagaagtacgataaggtatttccccaaggttgggacaaaacgtactgcttgagatactcttgaggaatttcaagaaattcgtttctttggggataagacctacaaggtccactcttaattcttggtatgaacttcagtaaggtgatgcatctgtgcattgtgctctttgtggaaaataaaaaaaaacgtccagtagagatcaaagctgttttctttagaatttttttggtcccatcattgttgaaatacatgtcaagtgggattatggggattatgtatttccttctgtaagagatggttcagattaaaaagattattaattgtggcttgtgtcg

SEQ ID NO: 23565 - protein, 80 aa, Panicum virgatum
  misc_feature: Ceres CLONE 1828590
  misc_feature: SWISSPROT Homolog: EC 5.4.2.8 Phosphomannomutase
MRHCGGAAMGCVTMGVLGGSDLVKIIEQLGRTVITDYDYVVAHTNGELIGTQVSLWAPQASLVSSDGLNLISTNLVARKC

SEQ ID NO: 23566 - DNA, 659 bp, Panicum virgatum
  misc_feature: Ceres CLONE 1828592
  misc_feature: Encodes the peptide sequence at SEQ ID NO. 23567
tagctatctatcgtcccatctctcgggcctccttccactcatcagtacaccgccatggccgccgtgaccgccgcggccgtctctctgtcgtccttcccggctgctgccaaggcggccgcctcgacgtcgtccccgtcgtcatgcggcatcacgtacccgcggcgcagcgccgcccgggcggtgcgcgtgcaggtgtcgacgacggagaccgctgaggccggggcggcgccggtgaagacggagaagatctccaagaagcaggacgagggtgtggtgaccaacaagtacaggcccaaggagccctacgtggggaggtgcctgctcaacaccaggatcaccggcgacaaggcgccgggggagacgtggcacatggtcttcagcaccgaaggcgagatcccttacagagaagggcagtccattggcgtcatagccgacagcgtcgacaagaacggcaagccgcacaagctcaggctctactccatcgccagcagcgccctcggggatttcggcgactccaagaccgtgtcgctgtgcgtgaagaggctcgtgtacaccaacgaccaaggagagatcgtcaaaggagtctgctccaactacctatgtgacctgaagcccgacgccgcttcgcaacatggccgattccccgcgaaggaggtact

SEQ ID NO: 23567 - protein, 201 aa, Panicum virgatum
  misc_feature: Ceres CLONE 1828592
  misc_feature: SWISSPROT Homolog: EC 1.18.1.2 Ferredoxin--NADP(+) reductase
MAAVTAAAVSLSSFPAAAKAAASTSSPSSCGITYPRRSAARAVRVQVSTTETAEAGAAPVKTEKISKKQDEGVVTNKYRPKEPYVGRCLLNTRITGDKAPGETWHMVFSTEGEIPYREGQSIGVIADSVDKNGKPHKLRLYSIASSALGDFGDSKTVSLCVKRLVYTNDQGEIVKGVCSNYLCDLKPDAASQHGRFPAKEV

SEQ ID NO: 23568 - DNA, 701 bp, Panicum virgatum
  misc_feature: Ceres CLONE 1828597
  misc_feature: Encodes the peptide sequence at SEQ ID NO. 23569
ctcaccacttgcctctcttccccgagcaaacgacgacgcattcctgcctccacttctgcagcaccgtgcggtaccagctcgttcttggcctaacaaagttattagctcgagaggagagaggggaagtttccttgggcgagagagggaagggcacgcagcagcaacagcagcagcagcagcagcgcaaagcgatggagagcagcgtcgtcgtggacggcaatggaggctgcggcgggcgggtggtggtggagctgagccacatcaaggacctggtgaggcagctggagggccacctgggcggctcgcaggcgcaggagcgctgcaggctcctggcctcgcagatctcctccctcacggaccgctccatcggcctcatcacctcctacggcggccggaagcggccggcggcggcgccaagcccgctcagcgacgccacggacgcgcccttcaagcgcaccaagaagaggaggacgacagagaaggtgaagcatcaggtgagggcggccgccggcggcgacgtcccggccgacgatggccacagctggaggaagtacggccagaaggagatccttggagccaagcacccaaggggctactaccggtgcacgcaccgccacacccaggggtgcgcggcgacgaagcaggtgcagcgcgccgacgaggacccggcgctctttcacgtcgtctacatcggcgcgcac

SEQ ID NO: 23569 - protein, 169 aa, Panicum virgatum
  misc_feature: Ceres CLONE 1828597
  misc_feature (112)..(169): Pfam Name: WRKY Pfam Description: WRKY DNA -binding domain
MESSVVVDGNGGCGGRVVVELSHIKDLVRQLEGHLGGSQAQERCRLLASQISSLTDRSIGLITSYGGRKRPAAAPSPLSDATDAPFKRTKKRRTTEKVKHQVRAAAGGDVPADDGHSWRKYGQKEILGAKHPRGYYRCTHRHTQGCAATKQVQRADEDPALFHVVYIGA

SEQ ID NO: 23570 - DNA, 681 bp, Panicum virgatum
  misc_feature: Ceres CLONE 1828620
  misc_feature: Encodes the peptide sequence at SEQ ID NO. 23571
aaaaaaaaaacacaccccctccctcgccgcagacccgcagtcactgagccaagaacgaacagcgcgatgagaggaggagcggggcccacggtggcgttcatcgccggcgacccgcctcccccgcggcaggggcagcggcggccagcaagagggccaaggcggatacagcgcccaacgccaccatctcgccggggacggtcgcttctggccacccacagagcagctttggagtggtgggatggccacccataagaactttcaggatgaacagcctattcaaccaggccaaagacaatgcttcagaggctggcaccaagaaggtcgctgatgaatctgacatgcagaaagacaaggaggagagcgagaagaaagggcgggttgtcggttgggtgaaggtgaacatggatggagatatcattggaaggaaggtcgatcttaacgcccatcgttcgtataagactcttgcctcagcacttgagctaatgttcatgaagccatccatcagtctttgcacttctagtagtgcaaagtctctgaatctattggacagctcatcggaatatcagctcacctatgaggacagggatggggattggatgctcgtcggagatgtgccatgggagatgtttgtaggttcagtgaagaggctcaagatcatgagggcatcagatgcttatggtc

SEQ ID NO: 23571 - protein, 139 aa, Panicum virgatum
  misc_feature: Ceres CLONE 1828620
  misc_feature (2)..(139): Pfam Name: AUX_IAA Pfam Description: AUX/IAA family
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: Useful for making plants with altered terpenoid content
MNSLFNQAKDNASEAGTKKVADESDMQKDKEESEKKGRVVGWVKVNMDGDIIGRKVDLNAHRSYKTLASALELMFMKPSISLCTSSSAKSLNLLDSSSEYQLTYEDRDGDWMLVGDVPWEMFVGSVKRLKIMRASDAYG

SEQ ID NO: 23572 - DNA, 1946 bp, Panicum virgatum
  misc_feature: Ceres CLONE 1828675
  misc_feature: Encodes the peptide sequence at SEQ ID NO. 23573
tatgatactccggcggctacatctacacgcctgcgcctcccgccgatccctcgcgtcctccgccctctgcggaaccgcgccgcgcaccttgccttctgctgggctcctccgtcgcctccacggcgcggcgggagatggcccttcttcggattccgaccacgcctgcaggccaggtccccttacactctacaggaatctagtaagccaagggaaactcacttatgacagctaccaggaaaatgtagcttccgatttagacagcttactcagaagactccaacaatatgagatggaaatggaggattaccatgcgcacctgtacatatgggagaatagcagggagaaagagaggcgaaggcttcttgttgaggaagctgaagataagcagcgtgatggtgtatggatagatgagaaaaggggatttcttgacaagttggttacacggagaagaagaggaagcatagaacctggagttggtatgtgggtctcatacctgaaccgagagaagaaattagataaactggtgggccagagaccagttgctcctgttgctcctaaaggattgtatctctatggaaatgtaggaagtggaaagacaatgttgatggacatgttctatggggccactgaaggtgttatcaaacacaggaggaggtttcacttccatgaggccatgcttgaaatacacgatcatatgcatgatgtatggaagagacgtgatgatgacaaatctgttcagtcaagtgcttttagctggatatcaagcctcccttttgatgcaaaaattaaggagtggctgataggggaagagaagtacaaacaagagacacagcaaaagcatatccttttggctgttgctgacaagtttttggttgatagacaagcaaataaaactggagcaagcattctatgctttgatgagatacagactattgatgtattcgcagttgtggccctgtctggcattctaagcagattgttaaccacaggaactgtactggtagcaactagtaataaagcacccgaagatctgaatcaggacgggatgcaaagagacatcttccttgatttattatcaaaattagatgaaaattgcaataagattcttgtgggaactgaaaaggattaccgtcgcctaattccaacagaaggctcaactcaggttcactatttttggcctgttacttctgatacttacagcatgtatgaggctatgtggcgtgacataactaaccatgtaggaggagacattatttctgtcaccattccggtaatgtttgggagatatattgagattcctcaaagctgtaatggtgtggcaagatttgacttcgagtatctatgtggtcgcccagtcggtgctgcagattatatagcaatagccaggaactaccatactattttcatatcagaaattccagctatgagtatgaagatccgtgacaaggcaagaaggtttatcacccttattgatgagatgtacaatcatcactgccgtcttgtgtgtctagctacctcatccattgatgatcttttccaaggaactgaggaagggcccctctttgatttagagagttttcaatttgaaactgaagctgaggggacaaagctaaggagggatgttttagcagaaggcaatgttggcttgaggccttctagtagtgggcttgtggcaatactgtctggtcaagaagagatgtttgcgttccgaagggcgatatctcggcttatcgagatgcagaccccactgtatctggagcgtgtgcagcatgcccatccctccttccaactgcaggctcctgctgtagcaagcaacaatatataggacttgtgtgtttctcagtgtgctccatcggtgtgacaaaaggcagcagctcttactggatgtaccatagttaagttgtttgtttgccggaacgccgacaattaataagaagggaaaatct

SEQ ID NO: 23573 - protein, 509 aa, Panicum virgatum
  misc_feature: Ceres CLONE 1828675
  misc_feature (47)..(490): Pfam Name: AFG1_ATPase Pfam Description: AFG1-like ATPase
MEDYHAHLYIWENSREKERRRLLVEEAEDKQRDGVWIDEKRGFLDKLVTRRRRGSIEPGVGMWVSYLNREKKLDKLVGQRPVAPVAPKGLYLYGNVGSGKTMLMDMFYGATEGVIKHRRRFHFHEAMLEIHDHMHDVWKRRDDDKSVQSSAFSWISSLPFDAKIKEWLIGEEKYKQETQQKHILLAVADKFLVDRQANKTGASILCFDEIQTIDVFAVVALSGILSRLLTTGTVLVATSNKAPEDLNQDGMQRDIFLDLLSKLDENCNKILVGTEKDYRRLIPTEGSTQVHYFWPVTSDTYSMYEAMWRDITNHVGGDIISVTIPVMFGRYIEIPQSCNGVARFDFEYLCGRPVGAADYIAIARNYHTIFISEIPAMSMKIRDKARRFITLIDEMYNHHCRLVCLATSSIDDLFQGTEEGPLFDLESFQFETEAEGTKLRRDVLAEGNVGLRPSSSGLVAILSGQEEMFAFRRAISRLIEMQTPLYLERVQHAHPSFQLQAPAVASNNI

SEQ ID NO: 23574 - DNA, 1272 bp, Panicum virgatum
  misc_feature: Ceres CLONE 1828679
  misc_feature: Encodes the peptide sequence at SEQ ID NO. 23575
gtgacccgtctcgctcgcctctctgcgcgcgcgacccgcgacccctcctcctcgctcggcgctcgccgacactagctagcggcggcgcgcagcaggcagcccgagcccgcagccacctcccggctcccggggacctggatcgacgaatctccaagccgcaaggccggagggcggaggcgacgcgccgacgagaccgggccggcgcctagacctagagctggaccgttgcggtcatggggtcctacactggctgtgagccgcgttgatttggggatttggatcgccgtcggtagggtgtgaaatggtggactttctgcggcggcttgctgctggcctgctcaagtgctgcgatctcgacatacccaatcggccaaagggccttgaggagcccgagcgtctggcaagggagacagtttttaatgtaaacgaaatcgaggctttgtacgagctgttcaaaaagattagcagtgccgtggttgatgatggcttgattaataaggaagaattccaattagcactgtttaagaccaacagaaaggatagcatgtttgctgatcgggtatttgacttgttcgacaccaagcataatggaattcttgaatttgaggaatttgctcgagctctttctgtgttccatccgaatgcaccaattgatgacaaaattgattttgctttcaaactgtatgatctcaagcaacaaggcttcattgaaaagcaggaggtcaagcaaatggtggttgcaacacttgctgaatcaggaatgaatctttcagatgatattattgaaggcattattgacaagacatttgaggaagcagatacaaaacatgatgggaaaattgacaaggaggaatggcggaaccttgtcctgaggcatccatctttgttgaaaaatatgactctcccatatctccgggatattacaacaacatttccaagttttgtgttcaactctcaagtagaggatgcatgagatccttcctgaagacaccattcaagcctctggggcgccaacataacagattctgcgagggggcacttgtgtgtatttccttgaaaatgtaaattttgtgtggtggcgatgcccttctgagggttctttcttttgtatagttgaagtgttgagtatattctacccaagatttcagtatgaacaatctcttgtcatgtgtttataagatgttcttcaaatatattgtttaattaacaagttgcacctgctgggacgaaaattttaatgtgagaaatggataggcttgtgaatatgtgatc

SEQ ID NO: 23575 - protein, 223 aa, Panicum virgatum
  misc_feature: Ceres CLONE 1828679
  misc_feature (164)..(192): Pfam Name: efhand Pfam Description: EF hand
  misc_feature (83)..(111): Pfam Name: efhand Pfam Description: EF hand
  misc_feature: SWISSPROT Homolog: EC 2.7.11.17 Calcium/calmodulin-dependent protein kinase
  misc_feature: Useful for making plants with modulated drought sensitivity
  misc_feature: Useful for making plants with modulated water use efficiency
  misc_feature: The sequence is a functional homolog of SEQ ID NO 2 in US patent 7250555
  misc_feature: Useful for making plants with modulated salt sensitivity
MVDFLRRLAAGLLKCCDLDIPNRPKGLEEPERLARETVFNVNEIEALYELFKKISSAVVDDGLINKEEFQLALFKTNRKDSMFADRVFDLFDTKHNGILEFEEFARALSVFHPNAPIDDKIDFAFKLYDLKQQGFIEKQEVKQMVVATLAESGMNLSDDIIEGIIDKTFEEADTKHDGKIDKEEWRNLVLRHPSLLKNMTLPYLRDITTTFPSFVFNSQVEDA

SEQ ID NO: 23576 - DNA, 1299 bp, Panicum virgatum
  misc_feature: Ceres CLONE 1828683
  misc_feature: Encodes the peptide sequence at SEQ ID NO. 23577
cgaccggtggttgtgcgcgccatctgtgtcagctccgggctccgggggcgcccggtggctcgccagcgtaaattaacccaaacccccgtggcattctcgcgcagtgccgtagtccctcgctcctccgcctagttgcttgcctcgccataacacttgcttaattagagcggcggtttcaactttcaagaggtgggcgtagtactgctactcgccgagaggatttgactggtgcaggcgggaagtgggagagagtagctgcggctgcggcggcaatccgcgcggccgggcgggcatggggaacacgagcgccaaggaaggggagaacggccagatggcgtcgtcgccggagctggcggcgcgcaacggcggcgggagtagctcggcaggggtcaccgctgcgaggccgccgccgttgtcgccgccggacgcggtgatgctggagcaaccaccgcccgtgccctacctcttcgtgccgcaggttccagtgactccactacagagacctactgaattttctcctgttttcaaccattcaccgataaatggaacagacgaatccaccaccaaccactcccaggagaaggggattccaactctgattacatggagtcaaggaggaaatgaggtgtttctggaaggatcatgggataactggacgtcgaggagagcattagagaggtctggcaaagatcacaccatcttactggttctgccgtctggagtatatcattaccggatcattgtggacggggcattgagatacatccctgagcaaccttgtgtaactgatgagagaggacaactggccaacctcctcgatgtccatgattatgttcccgacagtctcgacagcgtagctgaatttgaagcacctccatcaccggagcacagctacgacctgcaatatccgggagatgaggaattcgccaaggagccacccaccctccctccccagcttctcatgtctgtccttggtgatactgatagcattgatgatcaagctccaaagccacagcatgtcgtcctcaaccatcttttcatcgagaaagggtggggatcgcagtcgctgctcgcccttggagtcactcaccggttcgaatccaagtatgtgagctttgtgctctacaaaccgctgaggaggtgatactgctgaagaacaaaggagtgctggccagggactgatcgaagaataattagagtgtagctgacatggtagtattgtacagaggggaactgcaggaacccctagctgttatttttttatcacgcttctgaaagtaataaaccggtttcgtcgcc

SEQ ID NO: 23577 - protein, 283 aa, Panicum virgatum
  misc_feature: Ceres CLONE 1828683
  misc_feature (194)..(281): Pfam Name: AMPKBI Pfam Description: 5'-AMP-activated protein kinase, beta subunit, complex-interacting region
MGNTSAKEGENGQMASSPELAARNGGGSSSAGVTAARPPPLSPPDAVMLEQPPPVPYLFVPQVPVTPLQRPTEFSPVFNHSPINGTDESTTNHSQEKGIPTLITWSQGGNEVFLEGSWDNWTSRRALERSGKDHTILLVLPSGVYHYRIIVDGALRYIPEQPCVTDERGQLANLLDVHDYVPDSLDSVAEFEAPPSPEHSYDLQYPGDEEFAKEPPTLPPQLLMSVLGDTDSIDDQAPKPQHVVLNHLFIEKGWGSQSLLALGVTHRFESKYVSFVLYKPLRR

SEQ ID NO: 23578 - DNA, 968 bp, Panicum virgatum
  misc_feature: Ceres CLONE 1828703-R
  misc_feature: Encodes the peptide sequence at SEQ ID NO. 23579
gggcgccggtgttcatggactgccacgccgcctcgtccggccgccaagttcaggaccaccccctcagccattggctccacgccggttgcggctttggcctacgggacctcgtgtctttcgcactgcggcagtacctacaacatcgccctcctgacagctgctctaccctctctacgacgaagacaccacttacccggggctaaagggagtcatgctcgtaacccccccggacgcgcgccccatgctcatgggacgaaaccgaggggacggcgccgtcgccgccgcctccctgggccgcggcgggctgacgctcggggacctgttcctcggccccgggctggacctgctgctggagtacctggacgacaccgacccgagccggcagggcacgccgccggccatgaaggaggccgttgccgcgctgccgacggtccgggtgcgcgaggccttcacctgccccgtgtgcctcgacgaggtcgcggccgkcggcgaggcgcgggagatgccgtgcaagcaccggttccacgacccctgcatcgtgccgtggctggagatgcacarctcctgccccgtgtgcaggcaccagctgccagcggaggagccggctgacccggccggcagcggccggcgcgctggcgacgaggccggtggcaacgcgcgcggcggcgacgggggaagcggcggcaggaggcactggttctcgtggccttttggcgggctgttctcgcaaagatcaaacgggagctcatcgtcgtcgtcttgatgcaacgaacagaataaagaaaatcttgtagaagctcgttcttgatttctactacgtgatgattgggttaatattggccattgtaaagctgcatttgtccataggtttatttgcactagttttgttcaggtggatggagattattggagaatgcatctatcaacgctgccagagcatctattcaaccaaaaactaaaatttctgc

SEQ ID NO: 23579 - protein, 183 aa, Panicum virgatum
  misc_feature: Ceres CLONE 1828703-R
  misc_feature (82)..(122): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (92)..(92): Xaa is any aa, unknown, or other
  misc_feature (117)..(117): Xaa is any aa, unknown, or other
MLVTPPDARPMLMGRNRGDGAVAAASLGRGGLTLGDLFLGPGLDLLLEYLDDTDPSRQGTPPAMKEAVAALPTVRVREAFTCPVCLDEVAAXGEAREMPCKHRFHDPCIVPWLEMHXSCPVCRHQLPAEEPADPAGSGRRAGDEAGGNARGGDGGSGGRRHWFSWPFGGLFSQRSNGSSSSSS

SEQ ID NO: 23580 - DNA, 639 bp, Panicum virgatum
  misc_feature: Ceres CLONE 1828703
actaatacccgggtcgcgtcgcgtgcggcgtcatcctcttgctaggtcgtcgccgctccgggtccggaactccggataaacccgctttccttgctgttctggatccttcttctcgcttgtttttacgcgggttgcttgctctggtcgtctggttccctgccctgaccgaggaagcagattcaggccagcttggtgatcgcgtagaagaagaggaagcagaggctccacgatctcttggctgttcttgatcaagaaggcggaggaacagagcgcaggcaagggaaggcatggacgaggcatacggcgcggcggcttccaggtacttctgccacatgtgctcgctgatcatacggcccgtgctgggcatcgaggaggtcaagtgcccccactgccactccggcttcgtggaggagatggccgtggactcgctaggaggcgccggcggcgcggcgatcccagggcgtgctgccggcgagccgatcgtggacgccccggaagccgcgttggagcgcgaggtctcgctctgggcgcccgtgctcatggacttcctcgccgcctcgtccggccgccagggccaggaccacggccgcggccacggcctcgacgccggcggcggcggcggcggaggggacctcgcgg

SEQ ID NO: 23581 - DNA, 683 bp, Panicum virgatum
  misc_feature: Ceres CLONE 1828706
  misc_feature: Encodes the peptide sequence at SEQ ID NO. 23582
aagcttcgtccttccagccaaggaaacgtagcgatacgtcatgtgcgggggagcgatcctcgccgagctcgtccccgcgcgggtgcaccggccgctcacggtcgccacgctctggccggcggccgacagcggggccaccgccggcggcaagaggaaggcggccgacgtcgacgagctcgagaccgtcaccgacgacgaggagttcgaggccgagttccagcttttcgtggacgacgacgagccgtctccggccgcctcgccggaatccggcggccgcaggtccagggctgccccttctcctgcagtttcagggcgctccgtttgcacgagcccggctccgcgcgtgaacaagtacaggggcgtccgctaccgccggtcggggaggtgggcggcggagatcagggacccgcggcaggggcggcgcgcctggctcggcaccttctgctccgccgaggaggccgcccgggcgtacgaccgcgaggcccgccggatccgcgggaagagcgcgcggctcaacttcccgctcctggacgaaggccgccgccagaggcggaccgcgccggcgccggccatggccatcgacctcaacctgccggccgtctccgacgacgacaccatggatgctgacgacgattccgacgacgctcaccgttcaggcaacaacaacatctcctcgtgacagc

SEQ ID NO: 23582 - protein, 212 aa, Panicum virgatum
  misc_feature: Ceres CLONE 1828706
  misc_feature (103)..(154): Pfam Name: AP2 Pfam Description: AP2 domain
MCGGAILAELVPARVHRPLTVATLWPAADSGATAGGKRKAADVDELETVTDDEEFEAEFQLFVDDDEPSPAASPESGGRRSRAAPSPAVSGRSVCTSPAPRVNKYRGVRYRRSGRWAAEIRDPRQGRRAWLGTFCSAEEAARAYDREARRIRGKSARLNFPLLDEGRRQRRTAPAPAMAIDLNLPAVSDDDTMDADDDSDDAHRSGNNNISS

SEQ ID NO: 23583 - DNA, 1070 bp, Panicum virgatum
  misc_feature: Ceres CLONE 1828717
  misc_feature: Encodes the peptide sequence at SEQ ID NO. 23584
accgaggaagaagcccagcccgcacaccgaggaagaaggccgcggagcctgtcagcaccgattccagcagtacagcgcggcatcggctgttccatctcctccccgcccttgccccgctctaggtcaccttgcctcgctgccgccccggccgcctcgtccgagccgaacaaggggaagagaagagaagcccgtccgcccgccatgttcaagaagttctcttcggaagatatatctgggcagaatcaagttaaggcctctgtacagcgaaggattcggcaaagcattgctgatgagtaccctagccttgaacctttgctagatgacttgctccccaagaagtcacctatgattgttgttaaatgccaaaaccatctgaatcttgtggtggtgaataatgtcccactatttttcaacatccgtgatggtccttatatgccaaccctgcgtcttcttcatcaatatcctgaaatcatgaaaaagttccaagtggacagaggtgctatcaaatttgtgctctctggtgcaaacataatgtgtcctggattgacatcacctggtggtctcttggatgatgaagtcgatgaggaaacacctgtggctataatggcggaaggcaaacaacatgcattggcaattgggtttacaaagatgtcagcgaaggacataaggaccatcaacaaagggattggagttgacaatatgcactatctaaatgatggcctatggaagatggagaagctggaataaggagaatacagtgagggatgctgaacttgcggtatggtcgtattgagatgcaaggaccagtagaactatgtatctgcacagctggtttcgtttaaacagatgaagtagccagaagctacattttccggatacaagttgagtttactccattcctttggtgttggaatgtctgttgaaacagactttgactgctttgttcagcactttatatggcagtactgaaatcctgtataatcctgtcagcttaccattgactggtgcgctttagtcaaacaatttacactgaaacggaaacaaggaaatcctcaatgcttgacatgagt

SEQ ID NO: 23584 - protein, 181 aa, Panicum virgatum
  misc_feature: Ceres CLONE 1828717
  misc_feature (92)..(170): Pfam Name: PUA Pfam Description: PUA domain
MFKKFSSEDISGQNQVKASVQRRIRQSIADEYPSLEPLLDDLLPKKSPMIVVKCQNHLNLVVVNNVPLFFNIRDGPYMPTLRLLHQYPEIMKKFQVDRGAIKFVLSGANIMCPGLTSPGGLLDDEVDEETPVAIMAEGKQHALAIGFTKMSAKDIRTINKGIGVDNMHYLNDGLWKMEKLE

SEQ ID NO: 23585 - DNA, 1365 bp, Panicum virgatum
  misc_feature: Ceres CLONE 1828725
  misc_feature: Encodes the peptide sequence at SEQ ID NO. 23586
gatcgccgtgctctccctccacatctccggtattgccgtggccagaggagagatgaagccgctgtacctgcggagcagcggcagcttcaagaggctgctgctctccatcggcggccaccggtcaccgtccaagcccgcggcgcccgccgccgacgctggtgaagaagcgaaggaaaagccgtcgccggagtccccgccgcacaggcccgcgtggcggtgcttctcctacgacgagatcaaccgcgccaccggcggcttccacgagggcaacctggtgggccggggcgggtcttcggaggtgtaccgcggcgagctccccggcggccgcgccgtggcggtgaagcgcctgatgggcgcgtcggcgtgcgagcggcgggagcgggacttcctggcggagctcggcacggtggggcacgcgcgccaccccaacgtgtgcgccctcctgggctgctgcgtcgaccgcgacctctacctcgtcttcgagttctcccgccgcggctccgtcgccgccaaccttcacgacgaggcgtcgccggcgatggggtgggcggcgcggcgcggcattgcggtgggcacggcgagggggctcgagtacctgcacaagggttgccagaggcggatcatccaccgggacatcaaggcctccaacgtcctgctcaccgacgacctccagccccagatttctgattttgggctcgccaagtggctgccgtcggagtggacgcaccgggcgatcgcgcccatcgaaggcaccttcgggtgcctggcgccggagtactacacgcacggcatcgtcgacgagaagacggacgtgttcgcgttcggcgtcttcctcctggagctcgtgaccggccggaagccggtggacggcagccaccggagcctcctcagctgggcccggccgctgctggccgacggcggcaaggtcgacgccctggtggacccgaggctcggcggcgactacgacggcgagcaggcgaggcgggtcgcgttcgtggcgtcgctgtgcgtccgggcgccggcgacgtggcggccgtccatgaccgaggtgctggagcttttggaaggcggcgagatccggcacgaccggtgggcgatgccggaggcagccgacgatgaggagccgcggtggttcgacgacctcgacgacgaggaggatgaagaagatgaggagttcaacaccccgtcctcctcttcgtcttcatccaccacgagcaattagcatgcgtcataacctaaacacaaattctgatgtgatttttttttgctagccgtcctacacgtagggtgggcccacttgtacatacaaaggttatcttcgtcaaccgtcggtgtacgaatacgaaaaggaagtactacagtgcc

SEQ ID NO: 23586 - protein, 389 aa, Panicum virgatum
  misc_feature: Ceres CLONE 1828725
  misc_feature (69)..(337): Pfam Name: Pkinase Pfam Description: Protein kinase domain
  misc_feature: SWISSPROT Homolog: EC 2.7.11.1 Non-specific serine/threonine protein kinase
MKPLYLRSSGSFKRLLLSIGGHRSPSKPAAPAADAGEEAKEKPSPESPPHRPAWRCFSYDEINRATGGFHEGNLVGRGGSSEVYRGELPGGRAVAVKRLMGASACERRERDFLAELGTVGHARHPNVCALLGCCVDRDLYLVFEFSRRGSVAANLHDEASPAMGWAARRGIAVGTARGLEYLHKGCQRRIIHRDIKASNVLLTDDLQPQISDFGLAKWLPSEWTHRAIAPIEGTFGCLAPEYYTHGIVDEKTDVFAFGVFLLELVTGRKPVDGSHRSLLSWARPLLADGGKVDALVDPRLGGDYDGEQARRVAFVASLCVRAPATWRPSMTEVLELLEGGEIRHDRWAMPEAADDEEPRWFDDLDDEEDEEDEEFNTPSSSSSSSTTSN

SEQ ID NO: 23587 - DNA, 1255 bp, Panicum virgatum
  misc_feature: Ceres CLONE 1828735
  misc_feature: Encodes the peptide sequence at SEQ ID NO. 23588
gcgcagccagcccagccagagccaggaggaggaggaggaggagcaggaacaggagcggcgccgggcggagcacgcgaggcatggatagataccacagggtagagaagcctcggaatgacacccccatcagccagaatgagatcagaatcactacacaggggaggatgaggaactatatcagctatgggatgttgttgctcgaggaaaatggccatgatgagattagtatcaaggccatgggacgggccataaataagacagttatggttgtggaattaatcaagagaagagttggaggtcttcatcagaacactgttactgaatctgttgatatcacggacacatgggaacctttggaagaaggccttcttccactagagacaactcgccatgtatcaatgattaccgtgaccctttccaagaagcctctggatacatcatctccagggtaccagccaccaatcccagctgaagaggtgaaacctgctttcgactatgatcatgaagaatcctacccccctggtcgtggaagaggtcggggtggtgggaggagaggcaggggaagaggaatgagcaatggcccccctccacctgcttacggctacaatgaagagtgggaggaggaaggagattattacaacagagggcgtgggagagggaggtcgcgaggtagaggaggaagggggcgtggcttctatggaggcggcaggcgcggtggctacggctacgactatggttatggcggcaggggcgggtactatgaagagcaggatgaatactatgacgagcctgaagaatatggcccgcccccaggccgtgggcgtggcaggggaagaaggggagcagctccctggcgcgggcgcggtggccgtgggccgccacgtggcagccgaggaggctactactagccgtgaagcgcgacatgccaaagtgtgtgtgctctgaagctggcactgatgtgcgtgcttcagttatcattagcgtttgctatccgtgctcttctatggagctcctggaccggaatggcctgtaggccctcgctactttacttcctgctgtgctgtgcctgtgccgactcattgggcaagtttttgtggctcgctcgtggttttgtagctaggttagcgagtgaagttacactcggtagtgcagtgtttctttccccacccatccagacgacatgacgcgagattgtttattctcctgttaatcggtcatcttatttcgtatggatgctgaatgcagatagtttcag

SEQ ID NO: 23588 - protein, 275 aa, Panicum virgatum
  misc_feature: Ceres CLONE 1828735
  misc_feature (17)..(87): Pfam Name: Alba Pfam Description: Alba
  misc_feature: SWISSPROT Homolog: EC 3.1.26.5 Ribonuclease P
MDRYHRVEKPRNDTPISQNEIRITTQGRMRNYISYGMLLLEENGHDEISIKAMGRAINKTVMVVELIKRRVGGLHQNTVTESVDITDTWEPLEEGLLPLETTRHVSMITVTLSKKPLDTSSPGYQPPIPAEEVKPAFDYDHEESYPPGRGRGRGGGRRGRGRGMSNGPPPPAYGYNEEWEEEGDYYNRGRGRGRSRGRGGRGRGFYGGGRRGGYGYDYGYGGRGGYYEEQDEYYDEPEEYGPPPGRGRGRGRRGAAPWRGRGGRGPPRGSRGGYY

SEQ ID NO: 23589 - DNA, 459 bp, Panicum virgatum
  misc_feature: Ceres CLONE 1828743
  misc_feature: Encodes the peptide sequence at SEQ ID NO. 23590
acattcatacgccagcccggcgcggagcccgaccgccaggcccccccaccccttgcgcccacaggaccgccaggatggccggaggagaggccggcgggcagctgaagctgctgggctcgtgggccagcccgttcctgaaccgcgtgcgggtggcgctgcccctcaagggcctccagtacgagaacctggaggaggacctccccgaccagagagagctgctcctcgcctcccaccccctccacaagaaggtccccgtcctcctccacggcggcaagccggtgtgcgagtccctcctcatcctggagtacctcgacgacgccttccccggggccggcccggccctcctcccccccgacccctaccaccgccccgttgcccgcttctgggccccctacgtcgacggccagcgctgctgggggcgacggaggaggcgcgcgcggcggcaacggcggaggcgtt

SEQ ID NO: 23590 - protein, 128 aa, Panicum virgatum
  misc_feature: Ceres CLONE 1828743
  misc_feature (8)..(81): Pfam Name: GST_N Pfam Description: Glutathione S-transferase, N-terminal domain
  misc_feature: SWISSPROT Homolog: EC 2.5.1.18 Glutathione transferase
  misc_feature: Useful for making plants with modulated biomass
MAGGEAGGQLKLLGSWASPFLNRVRVALPLKGLQYENLEEDLPDQRELLLASHPLHKKVPVLLHGGKPVCESLLILEYLDDAFPGAGPALLPPDPYHRPVARFWAPYVDGQRCWGRRRRRARRQRRRR

SEQ ID NO: 23591 - DNA, 1277 bp, Panicum virgatum
  misc_feature: Ceres CLONE 1828744
  misc_feature: Encodes the peptide sequence at SEQ ID NO. 23592
gagatatctgggctggcgctccgctcgctacccgcttctctgggcagggaagcagcctccggcgagccgccgtggcgggaactcgggcgcgatgtctgctccctcggcgccgccgcgcacggtgatctgcgtgggggacgtgcacggccacatcacgaagctggagagcctctggtccaacctccaatccgcgctccccgccggcgccttcgccaccgcgctggtcatcttcctcggcgactacaacgaccggggaccgcacacccgcggggtcctcgacttcctcctcgcgctcccgcggcgccaccccgcgcagcgcctcgtgttcctctgcggcaaccacgacctcgccttcgccgcgttcgtcggggcgctgccgccgcctcccgacggctcccccttctcggccacctgggaggagtacctccacaacgaggagcacgaggggtggttccgcgggccgggctacgaggacatgcacgtgcaggggaggcgctggggcggggtcatcaaggagaggtggaacccgaagaaggggctcccgtacaggggctccatctacgacgcgcagcccactttcgagtcctacggcgtcgcccatggttcccctgatcttgcaatggctatgccggaggagcataagaggtttctgcgtgacttggtatggatccatgaagaggaaaatgtgcccattgatacggatgaaggccaaatcatttgcaatctaattgcagttcatgctggcctagagaagtccatagatttgaatgagcagcttagagttctaagaactagagacacaagggtgccaaaggttccaatgctcagtgggaggcaggatgtttggaacacaccaaaggatctgactggcaagcgtaccatcgttgtcagcggtcaccatgggcagctccacatcgacggcctccgattcatcattgatgaaggcggtgggtattaagacaaaccaatagctgctatcgtttttccctcaaagacattgattagaagcacggagggaacaacgtcacaggattgaactggatgtcatgatcatgagcagggaggtgctgttttcccccccttgctagttgctacttgctactgcctgtggtcatgtgtcatacgcacaccaaaataattaacaggtgcaacggctatagtaaataagaggttttgggtccagacctgtgttttggcatgtatagtcacaactgttgaactgtaaactttgttatactacacctttggataccgttaaactgaacaagaagatttcc

SEQ ID NO: 23592 - protein, 288 aa, Panicum virgatum
  misc_feature: Ceres CLONE 1828744
  misc_feature (9)..(273): Pfam Name: Metallophos Pfam Description: Calcineurin-like phosphoesterase
  misc_feature: SWISSPROT Homolog: EC 3.1.3.16 Phosphoprotein phosphatase
MSAPSAPPRTVICVGDVHGHITKLESLWSNLQSALPAGAFATALVIFLGDYNDRGPHTRGVLDFLLALPRRHPAQRLVFLCGNHDLAFAAFVGALPPPPDGSPFSATWEEYLHNEEHEGWFRGPGYEDMHVQGRRWGGVIKERWNPKKGLPYRGSIYDAQPTFESYGVAHGSPDLAMAMPEEHKRFLRDLVWIHEEENVPIDTDEGQIICNLIAVHAGLEKSIDLNEQLRVLRTRDTRVPKVPMLSGRQDVWNTPKDLTGKRTIVVSGHHGQLHIDGLRFIIDEGGGY

SEQ ID NO: 23593 - DNA, 1941 bp, Panicum virgatum
  misc_feature: Ceres CLONE 1828748
  misc_feature: Encodes the peptide sequence at SEQ ID NO. 23594
atgctaattcttgttcctatccattcattcctggccacgagctctgtttcttcgctgctctccctttgtagtgccttcctctctagtctccatgagctcttatccctgctgctacttctcagacgagcttaccttgctctccctctctccatgcgacgcaagctccttctccattcgaggaagctagctagcaggcgcagcctggaggtgtgtatcccgagcgcagcctagcgtgcgctatcacgggcataggacatcacgtgcaggcgcagggctcgctgcaagcaatgggcgcttgttgtcgacggcgtgcgttgcggtgtgcggctgccattttcagagcacaaagaagcgcggcgcggccaagacaaagggatgaaggtgtgggaccagcagagcgtagggaaggattgggagctcatcgcagcagtgggaatatggctccagatgcagtttcacgcgtgaggagcaccggctcagcacacttcagctgcagcttcccttccatcaaggcctcctcgtcatctgctaggaacatcgggccgctgagggcgattgctacagaggcaccccctgccgtcccacaatattcgagtggggagaagacgaagattggcatcaacgggtttggacggattggcaggttggtcctgcgaattgcaaccagcagagacgatattgaagttgttgctgtgaatgatcctttcattgatgctaagtacatggcctatatgttcaagtacgactccactcacggtccatttaaaggttctattcatgttgtggatgattcgaccctggagatcaatgggaagaagatcacaattacaagcaaaagagatcctgctgagattccatggggtaactatggagcagaatatgttgttgaatcttctggtgtttttacgacaactgagaaagcatcagcacacttgaagggtggtgccatgaaagtggtgatatctgcaccatcagcagatgctcccatgtttgttgttggagttaatgagaacagctatgacccaaagatgaatgttgtttccaatgcaagttgcactaccaactgccttgctccacttgccaaggttgtccatgaggaatttggcattgtggagggcctcatgacaactgttcatgccacaacagccacccagaagactgttgacggtccttcgatgaaggattggagaggaggacgtggtgctggccaaaacataattcctagctccactggtgcagcaaaggctgttggaaaagtcttacctgagctgaacggaaagctcactggcatggccttccgagttccaacaccaaatgtctctgtggtggatttgacatgtcggattgagaaaaacgcttcctatgatgatgtgaaagcagcattcaaggcggcatcagagggtgcactcaaaggtattctaggctacacagacgaggacgttgtttccaatgactttgttggtgattctaggtcaagcatctttgatgccaaggctggtattggactgagctcatctttcatgaagcttgtgtcttggtacgacaacgagtggggctacagcaaccgggttctggacctgatcgcccacatggctcttgtcagcaccaagcactgatgtgctgggatccttgctcattcccccagtagcctaggaaaggctgcaattttgacggccattttctttctagctgttgtttcgaataagatgatgtggaggagcacttcgaactgagcagaaatggactcagacccatggcttgtatgttgtagaaggggtaaaatttgctcgtagtgaccaggcatctctctacggaactgttgagtgaactatatggtctgtcgacttgattcattaattgtgatatgtgccctctgtaaggtggtataatttggcagtcctcggatggagccaaaattgcaatgagcaatcatcattgacc

SEQ ID NO: 23594 - protein, 442 aa, Panicum virgatum
  misc_feature: Ceres CLONE 1828748
  misc_feature (261)..(418): Pfam Name: Gp_dh_C Pfam Description: Glyceraldehyde 3-phosphate dehydrogenase, C-terminal domain
  misc_feature (107)..(256): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGACCRRRALRCAAAIFRAQRSAARPRQRDEGVGPAERREGLGAHRSSGNMAPDAVSRVRSTGSAHFSCSFPSIKASSSSARNIGPLRAIATEAPPAVPQYSSGEKTKIGINGFGRIGRLVLRIATSRDDIEVVAVNDPFIDAKYMAYMFKYDSTHGPFKGSIHVVDDSTLEINGKKITITSKRDPAEIPWGNYGAEYVVESSGVFTTTEKASAHLKGGAMKVVISAPSADAPMFVVGVNENSYDPKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAFKAASEGALKGILGYTDEDVVSNDFVGDSRSSIFDAKAGIGLSSSFMKLVSWYDNEWGYSNRVLDLIAHMALVSTKH

SEQ ID NO: 23595 - DNA, 161 bp, Panicum virgatum
  misc_feature: Ceres CLONE 1828750
  misc_feature: Encodes the peptide sequence at SEQ ID NO. 23596
gaacgagatgctgacgcctgagctcggcgaggatggctacggcggcgtggaggccgcgcgtcacccccgtgcacacggagatcatcctccgcgccactccgccccctcacgtgctgctggagaagggcccccggatacgggagctgagcgccgtagtccag

SEQ ID NO: 23596 - protein, 42 aa, Panicum virgatum
  misc_feature: Ceres CLONE 1828750
  misc_feature: Useful for making plants with modulated water use efficiency
  misc_feature: Useful for making plants with modulated biomass
MATAAWRPRVTPVHTEIILRATPPPHVLLEKGPRIRELSAVV

SEQ ID NO: 23597 - DNA, 679 bp, Panicum virgatum
  misc_feature: Ceres CLONE 1828801
  misc_feature: Encodes the peptide sequence at SEQ ID NO. 23598
tgcattctcccttggatcactgggcttcatgacacctttcccgagcgagcaataccgtgattgcttagacaatgtgctgaacggaccatttagcatcacactgagaaaccgtctgcagtgccatgtaatccgtgatgcagcaaaggatgaactcgtgaccgaggagccaatcttagtgttaaatgaagtcacaatcgaccgaggaatatcatcttaccttacctacctggaatgctactgcgacagttcttttgttacttgtgtacaaggagatggactaatcatttcaactacatctggaagcacagcatattcactagcagctggagggtccatggtccatccgcaggtcccagggatccttttcaccccaatctgcccgcattccttgtcattcagacctttgatactgcctgaatacgtgactctgcgcgttcaagtgccttacaatagcagggggtctgcctgggcatctttcgatggcaaagatcgaaagcagctatcacctggcgacgctctgatctgcagcatatctccttggcctgtgcccacagcctgcctgatggactcaacgaccgatttcctccgcagcatccatgagggcctccactggaacttgaggaaatcccagtcatttgatggcccgcgcgattgatgcaacagtttttgcagttatatc

SEQ ID NO: 23598 - protein, 217 aa, Panicum virgatum
  misc_feature: Ceres CLONE 1828801
  misc_feature (1)..(187): Pfam Name: NAD_kinase Pfam Description: ATP-NAD kinase
  misc_feature: SWISSPROT Homolog: EC 2.7.1.23 NAD(+) kinase
AFSLGSLGFMTPFPSEQYRDCLDNVLNGPFSITLRNRLQCHVIRDAAKDELVTEEPILVLNEVTIDRGISSYLTYLECYCDSSFVTCVQGDGLIISTTSGSTAYSLAAGGSMVHPQVPGILFTPICPHSLSFRPLILPEYVTLRVQVPYNSRGSAWASFDGKDRKQLSPGDALICSISPWPVPTACLMDSTTDFLRSIHEGLHWNLRKSQSFDGPRD

SEQ ID NO: 23599 - DNA, 653 bp, Panicum virgatum
  misc_feature: Ceres CLONE 1828803
  misc_feature: Encodes the peptide sequence at SEQ ID NO. 23600
aactccactgctactactgctacaagtctactagaagtaggtagcttgttagagccagattggcaaagcttcggccgggcagcgacagcgagctgagaactcgcgcgccgcgtcggtcggcgtgatcggccgggcgcgttcggcctcgaggagatggagcgggagtgccagctcgtggtggcgccgccgcggccgcgccatggccagtacgaggagggcccgttcgcgcaccaggtgatggtggccggggacatcgaccccgccggcgcggggagaggcggcggcggcggggagaggaagcggcggttcacggaggagcaggtgcggtcgctggagacgacgttccacgcgcggcgcgccaagctggagccccgggagaaggcggagctggcgcgggagctgggcctgcagccgcgccaggtggccatctggttccagaacaagcgcgcgcggtggcgctccaagcagctcgagcacgactacgccgcgctccgcgcgcagtacgacgcgctccacgcccgcgtcgagtcactcaggcaggagaagctcgcgctcgccgcccaggtacggacggtgcccttccatccatccatcgatcgattcctcattccgagcaccattgctgatcatgttcgctcgatcggtggcgcgcg

SEQ ID NO: 23600 - protein, 166 aa, Panicum virgatum
  misc_feature: Ceres CLONE 1828803
  misc_feature (48)..(103): Pfam Name: Homeobox Pfam Description: Homeobox domain
  misc_feature (104)..(148): Pfam Name: HALZ Pfam Description: Homeobox associated leucine zipper
MERECQLVVAPPRPRHGQYEEGPFAHQVMVAGDIDPAGAGRGGGGGERKRRFTEEQVRSLETTFHARRAKLEPREKAELARELGLQPRQVAIWFQNKRARWRSKQLEHDYAALRAQYDALHARVESLRQEKLALAAQVRTVPFHPSIDRFLIPSTIADHVRSIGGA

SEQ ID NO: 23601 - DNA, 1631 bp, Panicum virgatum
  misc_feature: Ceres CLONE 1828810
  misc_feature: Encodes the peptide sequence at SEQ ID NO. 23602
ttttttccctttctgccgcattccctcttcctccggcagccgtcgccagctccccggccgtcccatggtccggaaggagacggccatgaggctgcccccgcagcaccgggggctggaggtcaagatccccagcttcttccgctgccccatctcgctcgacgtcatgcgctcgcccgtcagcctctgcaccggcgtcacctacgaccgcgcctccatccagcgctggctcgactccggcaacaccacctgccccgccaccatgctcccgctcccctccaccgacctcgtccccaacctcaccctccgcagcctcatcgcccactgggccgcctcggccgccacctgctgctcgcccaccgccgccggaggggcctccgcggcttcctcgctgcggactgcctcccccgccagcctcgtccgccaggtggcggcctccggcgccgacccctccccggccctccgcgagctggcagcgtacctctccgacgacgacgtcgacgacttcgagaagaacgcgcttgtgggcgccggccgcgccgccgagacggtcgcgtcggtgctccggaggaaaggcgaggaggaggccagcgtcgagggcgcggaggcagccacgagggtgctcgccgcgatcgtggcctcggacggcatcgacgacgcgaacaagaagcgggtggccgccggcctcgccgcggacgcgccggcggcggccgcgtcgctggcgcgcgtgatgcgcggcgggagcggcctggaggcgagggtcgccgcggtgaggctcgcggagttcctgctcgccaatgccgccgaggaggcgagggcggcggcggcggcggccgagtcgtcggacctggtggccgagctgatccggctcatcggccccgtcgacgagaagggcaccctggacgggaaggccgtggaggccggcctctcgtgcctggccgccatctgccggtcgcggcgcgcggcgcgcggcgagatggtgcggctgggcgcggtcccggcggcggtgcgcgcgctccgcgccacggcggaccccggcgcgtccgcgaaggcgctccgggtgctcgagtccgcggtgggctgcgccgagggccgcgccgcgctgtgcgagggcgcggaggaggccgtccaggcggtggtgggcaagatgatgaaggccgggcgcgacggcgcggaggccgcggtggccgtgctctgggcggtgtgccaccggtaccgggaccggcgggcggcggacgcggcggcggcggccgagggcggcctgacgaggctgctgctggtggtgcagagcgggtgctcgccggcggcgcggcagatggcgctggagctgctcaagatgtacagggtgaacgccaagagctgcctcgccgggtacgactccaagaccacccacatcatgccgttctgaggaagcgaagcggacgggaacggcggcaaggtggtcagccgatcaactgaatgtgttcttgttcctgtgatgatgttttttgctttttcccccttttcttttgatgtaagtcgatagatagagaaacgaagaagaattggttcatggaggggaggaggatgaataatctgtacatgggtagagagagttttgacatgatcagaaacaggcacaggggacaaatttt

SEQ ID NO: 23602 - protein, 446 aa, Panicum virgatum
  misc_feature: Ceres CLONE 1828810
  misc_feature (20)..(94): Pfam Name: U-box Pfam Description: U-box domain
MVRKETAMRLPPQHRGLEVKIPSFFRCPISLDVMRSPVSLCTGVTYDRASIQRWLDSGNTTCPATMLPLPSTDLVPNLTLRSLIAHWAASAATCCSPTAAGGASAASSLRTASPASLVRQVAASGADPSPALRELAAYLSDDDVDDFEKNALVGAGRAAETVASVLRRKGEEEASVEGAEAATRVLAAIVASDGIDDANKKRVAAGLAADAPAAAASLARVMRGGSGLEARVAAVRLAEFLLANAAEEARAAAAAAESSDLVAELIRLIGPVDEKGTLDGKAVEAGLSCLAAICRSRRAARGEMVRLGAVPAAVRALRATADPGASAKALRVLESAVGCAEGRAALCEGAEEAVQAVVGKMMKAGRDGAEAAVAVLWAVCHRYRDRRAADAAAAAEGGLTRLLLVVQSGCSPAARQMALELLKMYRVNAKSCLAGYDSKTTHIMPF

SEQ ID NO: 23603 - DNA, 1613 bp, Panicum virgatum
  misc_feature: Ceres CLONE 1828840
  misc_feature: Encodes the peptide sequence at SEQ ID NO. 23604
accccttgcgcaagaaagaaagcgaaagagaaaatcgtgtaaaaaggaaggggaaaaaagaggaagcgtcttccttccacgcttgtagggttcccggatcggaggagccagcctcgcccaggtcgccgcagccatggttcgcggatcgctcgggaagcttgcgtcccgcgccctctccgtcgccgggagatggcagcaccagcagctccgccgcctcaacatccacgagtaccagggcgcggagttgatggggaaatacgggatcaacgtgcccaggggggcggcggctggttccgtgcaggaggtcaaggacaccttgaagaacgtatttcccagcgagaaagagatagttgttaagagtcaaatccttgctggaggccgcgggctgggcactttcaaaagtgggctgaaaggtggtgttcatattgttaaggctgaggaagctgaaggaattgcaagtaaaatgctaggccagattctggtcacgaagcaatctggcccagagggaaagattgtgagcaaggtctatttgtgtgagaaattatcactgactaacgagatgtactttgccatcacccttgacaggaaaactgctggtccgctcattattgcttgcagcaagggaggaaccagtattgaagatctcgcagagaagtatcctgacatgattattaaggttcctattgatgtattcaaaggaatcacagatgaggatgcagctaaagttgttgatggcctagcgctgaaggcagcagacaggcagtcttctatagaacagattaagaagctctatgaacttttctgcaagtgtgattgcacactgctggagataaatcctcttgcggagacagctgacaacaagcttgttgctgctgatgcaaagttgaactttgatgataatgctgcatttagacagaaagaaatatttgcactgcgtgatacaacacaagaagaccccagggaggtcgctgctgccaaagcagatttgaactacattggtcttgatggagagattggttgcatggtgaatggagcaggattggccatggctaccatggacattatcaagttgcatggtggtacacctgccaatttccttgatgttggtggaagtgcatcagagggtcaggttgtggaagcatttaagatcctgacttcagatgatagagtgaaggcaattctagtgaacatttttgggggcatcatgaaatgtgatgtgatagcaagtggaattgtaaatgctgctaaacaggttgacctgaaggtgcctgttgttgttcgtctagaaggcaccaatgtggaccaaggaaagaggattcttaaggaaagtggaatgacactgataaccgcagaagatcttgatgatgcggcagagaaggctgtaaaagcatccgtcaaataactctagtgtatgagtctgaagtttcttttttacaagatgagcggtgctctttttacggatttcggatcagggcggaaggcgtgaactgcaacctttttgaagagggattattttggcttgattttccctgttaaacattgccaatgccgaaacggagtgaaacgttgttgatctcatgttaataaacatttatcggcgtgattaggcagct

SEQ ID NO: 23604 - protein, 422 aa, Panicum virgatum
  misc_feature: Ceres CLONE 1828840
  misc_feature (281)..(417): Pfam Name: Ligase_CoA Pfam Description: CoA-ligase
  misc_feature (29)..(238): Pfam Name: ATP-grasp_2 Pfam Description: ATP-grasp domain
  misc_feature: SWISSPROT Homolog: EC 6.2.1.4 Succinate--CoA ligase (GDP-forming)
  misc_feature: Useful for making plants with modulated biomass
MVRGSLGKLASRALSVAGRWQHQQLRRLNIHEYQGAELMGKYGINVPRGAAAGSVQEVKDTLKNVFPSEKEIVVKSQILAGGRGLGTFKSGLKGGVHIVKAEEAEGIASKMLGQILVTKQSGPEGKIVSKVYLCEKLSLTNEMYFAITLDRKTAGPLIIACSKGGTSIEDLAEKYPDMIIKVPIDVFKGITDEDAAKVVDGLALKAADRQSSIEQIKKLYELFCKCDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 23605 - DNA, 1885 bp, Panicum virgatum
  misc_feature: Ceres CLONE 1828856
  misc_feature: Encodes the peptide sequence at SEQ ID NO. 23606
aaaggctgtcacaatcgcatcaccaacatcctaagtcctaactcatccatccttgcttagccacagcaagagcactgcagctggaggtggaagaaggcgaggccagcaacaagacgaaggcggtgatgcagccaagattcgggcacctctctctcctcctctttctgctcctcgcagcctcgccctgttccccgcaggagcaagaacacaacgtcgccggcgccgccctccgcgagagcttcctccggtgcgtcgccggcgtctcgccggccaccgccgacccgtcccggatcgtccacgcgccgtcggatccctcctacccttccctcctgaacgccaccatccagaacctccgcttcgcctcgccgcggacgccgcgcccggcgctgctcctcacgccggcgaccgtcgccgaggcgcgggcctgcgtcgcctgctgccggcgccacgggctcacggtccgcgcccgcagcggcggccacgactacgagggcctctcctaccgatcggtcggcccccgcgccgccggggcccgccccttcgcggtcgtcgatgtcgccgcgctccgcgacgtgcgcgtggacgcggcgcggcgcgaggcgcgggtgggccccggcgccacgctcggcgagctctactacgccgtggcccgcgagagccggggggcgctcgggttccccgccgggatctgccccacggtctgcgtcgggggccacctcagcggcggcgggttcgggcccatgatgcggaagcacggcctcgccgccgacaacgtggtgggcgccgaggtggtggacgcggaggggaggctcctggaccgggacgccatgggcgagggcctcttctgggcgctccgcggcggcggcggcggcagcttcggcgtcgtggtctcgtggacggtgcggctggtgcccgtgccgcgcgtcgtgtccgccttcaccgcccgccgcgtcgtccggcgcggagaccagcggcggacccaatcaaccctccgcctcctgacgaaatggcagcgcgtggcgcacgcgctccccgacgacctgttcgtcaaggtggccatggaacccgagctcgacgccgccggcgagaggcacccgctggtggtcttcaagtcgctgttccttggcaactgcagcggcatggtcgccgagatgagcacccatctgccggagctcggcgtgaagcccggcgactgcagagacatgagctggatccaatccatgctctacttctacggctacaccaatggcggccagcccgccgaggtgctgctcgaccggagcctgcagcccaaggactactacaagatcaagctggactacctgacctccccaatcccggccgccggcctggccgggctcctcgacctggtcgtcgaggacaggggcgggtccatcgacatcgacccgcagggcggcgcgatgggcgcgacgccggagtccgccacgccgtacgcgcaccggcgagggtacctgtacaacgtgcagtacttcgtcaagtggggcggcgacgcgaacgtgtcgcgcgaggacgggcacctggggtgggtgcgaggcgtgcacgggttcatggcgccgtacgcgagctcgaggccccgggcggcgtacatcaacttcagggacctggacctggggcgcaacgtggagggggagacgacctacgaggcggccagggagtggggggagatgtacttcaggggcaacttcaggaggctggccatggtgaaggccgaggtggatcccgagcaggtgttctggagcgagcagagcatccctcccctgcttgtggaagatgttgcaggggacaggcagagacagagtgagtgagacagggttggttagatgtgtaaaattttggtgcaaaatgtcacatcatatatcccgat

SEQ ID NO: 23606 - protein, 566 aa, Panicum virgatum
  misc_feature: Ceres CLONE 1828856
  misc_feature (86)..(233): Pfam Name: FAD_binding_4 Pfam Description: FAD binding domain
  misc_feature (493)..(550): Pfam Name: BBE Pfam Description: Berberine and berberine like
  misc_feature: SWISSPROT Homolog: EC 1.21.3.3 Reticuline oxidase
MQPRFGHLSLLLFLLLAASPCSPQEQEHNVAGAALRESFLRCVAGVSPATADPSRIVHAPSDPSYPSLLNATIQNLRFASPRTPRPALLLTPATVAEARACVACCRRHGLTVRARSGGHDYEGLSYRSVGPRAAGARPFAVVDVAALRDVRVDAARREARVGPGATLGELYYAVARESRGALGFPAGICPTVCVGGHLSGGGFGPMMRKHGLAADNVVGAEVVDAEGRLLDRDAMGEGLFWALRGGGGGSFGVVVSWTVRLVPVPRVVSAFTARRVVRRGDQRRTQSTLRLLTKWQRVAHALPDDLFVKVAMEPELDAAGERHPLVVFKSLFLGNCSGMVAEMSTHLPELGVKPGDCRDMSWIQSMLYFYGYTNGGQPAEVLLDRSLQPKDYYKIKLDYLTSPIPAAGLAGLLDLVVEDRGGSIDIDPQGGAMGATPESATPYAHRRGYLYNVQYFVKWGGDANVSREDGHLGWVRGVHGFMAPYASSRPRAAYINFRDLDLGRNVEGETTYEAAREWGEMYFRGNFRRLAMVKAEVDPEQVFWSEQSIPPLLVEDVAGDRQRQSE

SEQ ID NO: 23607 - DNA, 638 bp, Panicum virgatum
  misc_feature: Ceres CLONE 1828874
  misc_feature: Encodes the peptide sequence at SEQ ID NO. 23608
aagctcctcccgcttttttcagacccctcccgctcactcagtccacagcgccggcgaggcacgcaagaagaagccgcgtttcttgcagctgcagctctgatctcgcactttctctgcctctccctcctcccgcaaacacagaaggatggggagagcgccgtgctgcgagaaggtggggttgaagaaggggaggtggacgaaggaggaggacgagatcctggcgaggtacatcaaggagcaaggcgaaggatcatggagatcgctgcccaagaatgctgggctgctgcggtgcgggaagagctgcaggctgcggtggatcaactacctgagggcggatctcaagagggggaacatctcggaggaggaggaggagatgatcatcaagctccacgccccccttggcaacaggtggtccctgatcgccggccacctgcccggccggacggacaacgagatcaagaactactggaactcgcacctcagaaggcgggcggccgacttctgcgacggcgtcgtcgtcaacgtcgacctcagcaagctccccggcggcggcaagcggcgcggcggccgggtcagccgcggcgtcatggccgccgccaaggccggcaaggagaagaaggtgaaggagaaagagaagg

SEQ ID NO: 23608 - protein, 164 aa, Panicum virgatum
  misc_feature: Ceres CLONE 1828874
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 569 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 726 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: Useful for making plants with modulated low light sensitivity
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 794 in the 11/435,388 US patent application
  misc_feature: The sequence is a functional homolog of SEQ ID NO 788 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 743 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 790 in the 11/435,388 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: Useful for making plants with altered lignin content
  misc_feature: Useful for making plants with altered terpenoid content
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1564 in the 10/374,780 US patent application
  misc_feature: The sequence is a functional homolog of SEQ ID NO 126 in the 10/412,699 US patent application
  misc_feature: Useful for making plants with modulated biomass
  misc_feature: Useful for making plants with modulated flowering time
  misc_feature: The sequence is a functional homolog of SEQ ID NO 1565 in the 10/374,780 US patent application
  misc_feature: Useful for making plants with modulated nitrogen use efficiency
  misc_feature: Useful for making plants with altered cell wall content and/or composition
MGRAPCCEKVGLKKGRWTKEEDEILARYIKEQGEGSWRSLPKNAGLLRCGKSCRLRWINYLRADLKRGNISEEEEEMIIKLHAPLGNRWSLIAGHLPGRTDNEIKNYWNSHLRRRAADFCDGVVVNVDLSKLPGGGKRRGGRVSRGVMAAAKAGKEKKVKEKEK

SEQ ID NO: 23609 - DNA, 401 bp, Panicum virgatum
  misc_feature: Ceres CLONE 1828877
  misc_feature: Encodes the peptide sequence at SEQ ID NO. 23610
atcaatggacgttgttgtgtccagcgtcagagcttacctgagtgccctgaacaagatgtgcagttttgctggcgctgtaaaagccagcagcgaggtatctgagagcacacgtgtgcaaagcaaagagtgagaccgtcgtcatccgattctcatatgggccgagcaatgtaagagctcttgagcaacttttcagagccacatttcatttcagtaataggctggttaatattggggtttccccttggtcagtgtgaagattgtgcgttctttctggaggatgtccgcttagaacaggcatagagtttttggcccgtccagtgtacaacttgtatgttatagaccatgctttcaataaggaaataatggtagggtctgtgaagccacccattgaatgatttcac

SEQ ID NO: 23610 - protein, 42 aa, Panicum virgatum
  misc_feature: Ceres CLONE 1828877
  misc_feature: SWISSPROT Homolog: EC 2.3.3.13 2-isopropylmalate synthase
SMDVVVSSVRAYLSALNKMCSFAGAVKASSEVSESTRVQSKE

SEQ ID NO: 23611 - DNA, 1295 bp, Panicum virgatum
  misc_feature: Ceres CLONE 1828934
  misc_feature: Encodes the peptide sequence at SEQ ID NO. 23612
atcgcaggacgcgcggcgtgggagatcgccggcgccgaggagccgagatccagaggatgggctgctccttctctgggctcaacaccatctacggcgccgcgacgggcggcggcgacgtctggatcaacgagcgctgcttccgcgtcatccgccagatcggcgacggcggcgtcgccgtcgtctacctcgtcaaggagcaacagcccgcctccgatgccgcgcccgccaagcgccacgacgcccatgtctcagaggatggaacgtatgccatgaagaaggtgctgatacagagcaaggagcagctggatctggtgaaggaggagatccgcgtgtcgtcattgttcaatcaccccaacctgttcccgcttcttgatcatgccataataaccgtcaagagtccacagggagatttgagccatgaagcctacctgctctttccagtccatttggatggtactttattggacaacgctaacatcatgctgtccagaaaggaattctattcaacatctgacgttctgcaaatattccgtcagttgtgtgaaggactgaagcacatgcacagctttgatcctccatatgcccataacgatgtgaagcctggtaatgttcttataacccatcgtaaaggacaagcacctgttgtaaatttaatggattttggaagtgcaaggcctgcaagaaaacaaatccgttcgcactcagaggcgttacagttgcaggaatgggctgctgagcattgctccgcaccttatcgtgcccctgaattatgggactgcccaagccatgctgatattgatgagaggacggacatctggtctctaggatgcaccctttatgcaatcatgtttaatgtttcaccatttgaggatgctcttggtgaatctgaagaaagtctgcaacttgccattgtcaatgggcagctgaagtggccagcaggacctaaccctccttatcctgatgaacttcgcaagtttgttatctggatgcttcagccacaacctgcaatgcgccctcacattggtgatgtagttcttcatgttgacaagctcatcgcaaaatacttgtcctaaaccagcttgtagtctccatttgtcttatttctttgttacacgaaatgaatatggtgtaaaatgggttcatgcttgacatcattcgattcttggatatgctcaatattgattccttgtagaactttcagattgttatcgacatcaatctaatgttttactcagttatcatgtaatgtcaagtgaacatcaaaagtgttcctatataatatatgtaatagcatc

SEQ ID NO: 23612 - protein, 338 aa, Panicum virgatum
  misc_feature: Ceres CLONE 1828934
  misc_feature (28)..(329): Pfam Name: Pkinase Pfam Description: Protein kinase domain
  misc_feature: SWISSPROT Homolog: EC 2.7.11.1 Non-specific serine/threonine protein kinase
MGCSFSGLNTIYGAATGGGDVWINERCFRVIRQIGDGGVAVVYLVKEQQPASDAAPAKRHDAHVSEDGTYAMKKVLIQSKEQLDLVKEEIRVSSLFNHPNLFPLLDHAIITVKSPQGDLSHEAYLLFPVHLDGTLLDNANIMLSRKEFYSTSDVLQIFRQLCEGLKHMHSFDPPYAHNDVKPGNVLITHRKGQAPVVNLMDFGSARPARKQIRSHSEALQLQEWAAEHCSAPYRAPELWDCPSHADIDERTDIWSLGCTLYAIMFNVSPFEDALGESEESLQLAIVNGQLKWPAGPNPPYPDELRKFVIWMLQPQPAMRPHIGDVVLHVDKLIAKYLS

SEQ ID NO: 23613 - DNA, 713 bp, Panicum virgatum
  misc_feature: Ceres CLONE 1828937
  misc_feature: Encodes the peptide sequence at SEQ ID NO. 23614
gtgttttaccaaagctttacacatgtccccgtcgcatcacaagcttttgatccctgccaattcaaggcttgttcccccgggtaatgggactgctctggtgctcttcctctccccacttccgacgttcatccacatctggaagaaggggtcggtgaagcactactcgccggtgccttacatgtcaactctcctcaactgcatgatgtgagtgctgtacagcctaccgcttgtccacccccacaccatgctcttcatcaccatcaaccgcaccggcatggccatccagctcacctacgtcacgctcttccttctctactccacgggaccctctcgcctcaagatcttcctcctcctcgccgccaaggtctccttcctctgctccatccccgttctactgctcaccctgccgcacactcactagcgcaggtccatgatcgtctgcatcctctgcctcctcttccgcaccggcatgtacgcgcccccgctctccgtcatgaaaaaggcgatccaaaccaatagcgtggactacatgcccctattcctgtccctagcttctctggtgaacggcatctgctggactgcctacaccctcatcaaattcgacctctacatcacaatccacaacgggctgggcgttctgttcgccgtggcgcaggtggtcctctacgacatctactacaagaccacctactacatcatcgaggcgcgcacgt

SEQ ID NO: 23614 - protein, 94 aa, Panicum virgatum
  misc_feature: Ceres CLONE 1828937
  misc_feature (1)..(87): Pfam Name: MtN3_slv Pfam Description: MtN3/saliva family
MIVCILCLLFRTGMYAPPLSVMKKAIQTNSVDYMPLFLSLASLVNGICWTAYTLIKFDLYITIHNGLGVLFAVAQVVLYDIYYKTTYYIIEART

SEQ ID NO: 23615 - DNA, 1201 bp, Panicum virgatum
  misc_feature: Ceres CLONE 1828946
  misc_feature: Encodes the peptide sequence at SEQ ID NO. 23616
atcgccactcgccagccaccgccacaccaccccaccccacccctgcactccaccaccaccgccgccgcccaaaccgccgccgccgcacccccgccgcgcgccatggcggtgagcaacaacatcacggcgtgcgtgacgctgctggcgctgatctgcgcggtgccggtgatcgcgtcgggggtctggttcgcctccgcgcagggggacgagtgcgcgcgccttgcgcgctggcccgtcgccatcctcggcgggctgctcctcctcgctgccctggcgggcttcgtcggcgcctactagaaccgccgcggcctcctcgccttctacctcttcgccatggccgcgctcatcgtgctcctcatcgtgctcctcgtcttcgccttcgccgtcacccggggctccggcgcctaccccgtcctcggccgcgcctacgacgactaccgcctcgacggattctccatgtggctccgcggatacgtctccgacgaccccgcccggtgggagaagatcaaggcctgcctcgccgtctccgacacctgcaagaagctccagcgccaggccgccttcgtcaacgccgagcagttctaccagtcacgcctctccccgctccagtcgggctgctgcaagccaccgtcggtgtgcgggtacacgtacgtgagcccgacggagtggacgagcccggcgcggccggcggcggacccggactgcgcgctgtggagcaaccaccccggcgagctctgctacgagtgcgagtcctgcaaggccggcctcctggaggcgctccgcgaccagtggcacaaggccaacatcgcgctcgtcgtcgccaccgtctgcctcgtcttcctctacctcatcgggtgcagcgcctacaagaacgcccaggccgccgccttcttccgtcactacaagtaataactgatcagtccgtgacgacgacgatgagctggcttgccggccgcagcggcgggatgccggtcgccggcgtggcgtcgccgtcaggttggttcagcaagctacgtgtgggctgtgttgtggacaagtagttgtgattgatgtgctttcttcagactcttcttgctttgtggtgtttggtagcagtagacgtgtaagatgtgtaacaatgtaaggtagtggagatgtaacattgatgagagtcgatgtgttttagtcttctgccatcgattatcagcaatggtgctagatc

SEQ ID NO: 23616 - protein, 191 aa, Panicum virgatum
  misc_feature: Ceres CLONE 1828946
  misc_feature (1)..(167): Pfam Name: Tetraspannin Pfam Description: Tetraspanin family
MAALIVLLIVLLVFAFAVTRGSGAYPVLGRAYDDYRLDGFSMWLRGYVSDDPARWEKIKACLAVSDTCKKLQRQAAFVNAEQFYQSRLSPLQSGCCKPPSVCGYTYVSPTEWTSPARPAADPDCALWSNHPGELCYECESCKAGLLEALRDQWHKANIALVVATVCLVFLYLIGCSAYKNAQAAAFFRHYK

SEQ ID NO: 23617 - DNA, 1539 bp, Panicum virgatum
  misc_feature: Ceres CLONE 1828959
  misc_feature: Encodes the peptide sequence at SEQ ID NO. 23618
ccccagatccaatcgcgacttccaccatggcagaagcggccggcggcggcccccagctccccgaggatctcgttgtctcggagatcctgacgcgtctgccggtgaagcccctcctccggtgccgcgccgtctgccgctcctggcgcctccggctcacatccgacgccaaattcctcctcgcccaccaccgtcgtcagccctcgctcccgctcctcaccaactgggacagggacacgcatgagagaaggatcgacgccctggaccaccgcaccggcgagcggcatcctgtcggccggatcgctgcctccgaggacgacgtccacgtactcgctgcctgcgacggcctcatcatcctccatgcctacggcggcctcgagatctgcaacccggcgacccgccagcgcgcgcctctcacgctgctccacggcgccgcctgcatctccgcgctttaccctcaccgcccgtccgggtcgcaccgggtgctgtgctgcttcgagagaaccgaggacggccacgccgtcgccgtgtaccacgtgcacaccgtcgggtccggcgagctcaggtgtgtcggagagcttcccgggccgtgggcgtccggggatctggcggtggcggcgtcgatgatggggttccttcacccgcccgtcctggcagacggcaggatctactggtctccgttgatgctgtccggcggcgacgccgacgacggcaaggggaaggtcaacaacatgctggtgttcgacaccatgtccgagtccttccagcatttgctgtcgcccgtcgatggcccctttgttgagctgtttgagatgaacagcggcgctcttggattgtaccaccgcggcagcagctcgattgatctttgggtgctaaaggatcaccagagctggtcatggtcgttgaacagccggatcaaattggacgtgcggtttttctctctgctgccggtactggacccaggaggagatgtgctcctcgtttctaccagaggggaatcaggcatcctctggtaatatctgcatcacatttctggtgccaatggcagtatgttggcacggtataaatggagcgcttatctgaggcttaccaaacataggttgaaagagccttgttcgccatgacttcttctcgatgcaaggtaatgctggtggtatggatgagaaaccattgttcgatggcttgtcaactgtggcggtggttcgtgatgataattctgagtcacattgagaaacaacggtgttagtctgtgctggcaagctatttcattttagcaggatggagtcactcctgatgattctgaactgtctagtaataagagtgctgcagattagtaataacctgaaaccaccggcggagctacatgtcggcaaacatgggctgtgccccccctgcccccaaatgaaatcacatagcatcatttcaagtttaattggttcagtgattttccttcttgtttagagtattcagagagcaaccaccgagtatattgtcttctttgcttcatttccagtaagaatataaagagaagaagcagttttg

SEQ ID NO: 23618 - protein, 328 aa, Panicum virgatum
  misc_feature: Ceres CLONE 1828959
  misc_feature (6)..(54): Pfam Name: F-box Pfam Description: F-box domain
MAEAAGGGPQLPEDLVVSEILTRLPVKPLLRCRAVCRSWRLRLTSDAKFLLAHHRRQPSLPLLTNWDRDTHERRIDALDHRTGERHPVGRIAASEDDVHVLAACDGLIILHAYGGLEICNPATRQRAPLTLLHGAACISALYPHRPSGSHRVLCCFERTEDGHAVAVYHVHTVGSGELRCVGELPGPWASGDLAVAASMMGFLHPPVLADGRIYWSPLMLSGGDADDGKGKVNNMLVFDTMSESFQHLLSPVDGPFVELFEMNSGALGLYHRGSSSIDLWVLKDHQSWSWSLNSRIKLDVRFFSLLPVLDPGGDVLLVSTRGESGILW

SEQ ID NO: 23619 - DNA, 422 bp, Panicum virgatum
  misc_feature: Ceres CLONE 1828963
  misc_feature: Encodes the peptide sequence at SEQ ID NO. 23620
agtacccacaggtaaagttcagcaccgcgtcggcgaccccggagaagtacaacacctttatcgcctctgtccgccccgcgctggagaacaaagctggggggaagagcaacgggatccccgtgctgctcgaccgggacgacccgctcgcgcttcaaacctacctgaacatcacactgacgaactcggcagggcattctatcagcctgaagatggatgtcaccggagcttacttcacctcctacatggcgtggaagtcctcgtgcctgctcaaacgatccgaccaggcattctcggcggcgatctgctattccgatgatccatggacgagctcagctgccaatgatgcggcgctgcagtactccgccggcgccggcgcccgcgacgtggtgaacgcgtgcccgccgcgcgtcccagcggcgcgc

SEQ ID NO: 23620 - protein, 139 aa, Panicum virgatum
  misc_feature: Ceres CLONE 1828963
  misc_feature: SWISSPROT Homolog: EC 3.2.2.22 rRNA N-glycosylase
YPQVKFSTASATPEKYNTFIASVRPALENKAGGKSNGIPVLLDRDDPLALQTYLNITLTNSAGHSISLKMDVTGAYFTSYMAWKSSCLLKRSDQAFSAAICYSDDPWTSSAANDAALQYSAGAGARDVVNACPPRVPAA

SEQ ID NO: 23621 - DNA, 695 bp, Panicum virgatum
  misc_feature: Ceres CLONE 1829008
  misc_feature: Encodes the peptide sequence at SEQ ID NO. 23622
ccggttaatcccgccctggccgttcacattatccgcgcgcgcgcgggcggccgtcgcgtgtgccgtcgccgtgcggcctctgttggtggcggcgcgcggcgcgtgagcgacgacgggggtgtgccgcccagcgggggaggagggcgtccgtccggcggcggcgatggtgggggtcagcggcgcggaggcggtgtctgtcgcggtcctcttctccttcgccttcatctgcgcccgcttcctgctggaccgcctcgtctacaagccattggcagtttacctattcagtaccaaagcttctaagttgatgaatgatgagaccaggcaagcaaagattgtcaagttctcagagtccatttggaaacttacatactatgcttctgttcaagcatgggtcctcatgataataaagcaggaaccatggtcattggatacaatgcaatacttcaatggctggccgaatcaacccattccgaagatattgatgtttttctacatgtgccagtgtggattttatgtctacagcattggtgctcttgttgcttgggaaacccgcagaaaagattttgctgtaatgatgtctcatcatgtaataacatctgctctaattggagtttcatatctgaccgggttttttccaattgggacaatcattctcgccctgcatgatacaagtgatgtgtttcttgagactgccc

SEQ ID NO: 23622 - protein, 177 aa, Panicum virgatum
  misc_feature: Ceres CLONE 1829008
  misc_feature (78)..(177): Pfam Name: LAG1 Pfam Description: Longevity-assurance protein (LAG1)
  misc_feature: SWISSPROT Homolog: EC 2.3.1.24 Sphingosine N-acyltransferase
MVGVSGAEAVSVAVLFSFAFICARFLLDRLVYKPLAVYLFSTKASKLMNDETRQAKIVKFSESIWKLTYYASVQAWVLMIIKQEPWSLDTMQYFNGWPNQPIPKILMFFYMCQCGFYVYSIGALVAWETRRKDFAVMMSHHVITSALIGVSYLTGFFPIGTIILALHDTSDVFLETA

SEQ ID NO: 23623 - DNA, 1986 bp, Panicum virgatum
  misc_feature: Ceres CLONE 1829012
  misc_feature: Encodes the peptide sequence at SEQ ID NO. 23624
gtctctctctctcctcgtcctcaagctctccctctcccctcccgcggcgtggccgaatgccgcgagctgggcggagctgaccccgcccgccggcgactccgctcggccgccgccgcagcagcagcgacgcggattcggctgccgagcgcggaatgcccgcggagggagggcactgaggcgcccagattcgggagcacgggagagcctcgcttggggcaccggggattcgcctcgccggggcggcggaggtggtttgggggcggaggctctccggattccagcgtgtgggacctcaacgcgatggccgccggcggcggcgcctccgccgaagccaagtacaactcgtacaaggcgccgggcctgcgcggggccttccttgaggcggcgcacgtctcgtgcctcgaggaccgctacgcgctcgggccgcagcttgggtggggccagttcggcgtcatccgctcctgctccgacctggtcaccggcgaggcgctcgcctgcaagtccatcgccaaggaccgcctcgtgtcccccgacgacgtgaggggcgtcaagctcgagatcgaggtcatggcgcgcctctcgggccaccccaacgtcgttgacctcaaggcggtgtacgaggacgaggactccgtgcacctcgtcatggagctctgcgccggcggggagctcttccaccgcctcgaggagcgcggctgcttctcggagcacgaggctgccgtgctcttccggtacctcatggaggtcgtcgcccattgccatagcaaggggatcgtgcaccgggacctcaagccggagaacatcctcctggtcagcaagtcgccgtcctcgccgatcaaactcgcggactttggcctcgccacctacatcctgcctggtcgaagcttgagtggcatggtaggaagcccgttttacattgcgccggaggtgctttccggtggatacaatgaagctgccgacgtgtggagcgccggggttatactctacatcctcctgagcggcatcccgccgttttgggggaaaaccaagtcgaagatcttcgagtgtataaggtcgacggagctgcggttcccttctgatccatgggatagggtttctgattcagccaaggagctggtcactgggatgctgcggcgcgatcctaggcaacgactaactgccaagcaggttctagagcattcgtggatgcaagagcacgctgaccaatcacaagattcctgcagccattgccacgggatcggcctccggagggaggacctcggctcgtgctccttctccacgccgctggcgacacggagcagggacgtgagcttcaacaccggcggccccatcacctgccagggcatgttggaggaggacgaggcgtggtcgccctccttcgcctgcaggtcgtccttctcggcatttgtcaccgacatggccccatcttgctcgatgtctggcttctcgttcggcgaggcaagcgagctcggtggcggcgtggcgttccccacgctgccagtggcttccatgccgagcttctcattcttctgcgggcaagagtgcggcgagcccgagccgtcggcatcacagggggtgtcggttgccactgctgctgctgctccttccacttcacggaggatgtcagaggtcatgggggcagcgaggcccgtgacgaaccagtcgcgggtcgctggcgtcaacagcaggcggaaccacacgatcggcgccggcgagcgggagcccctggacgtggcggtggcggagtccgtcatacggtgggcgtcgtgcacgaacctgtcgacgacgcactcgctccgggcgtcgctcgtgtgctagctagcatttcgttcgctcgatagtttgtcggccgcctttacctgtaacgctatgcaaagctgagtgttgagattaaagtgtcagtcgaaggtagagaatgtaacctggacccgatatatatgatgttgttattatagtaaagcagtagattaactagtgatgttcctc

SEQ ID NO: 23624 - protein, 505 aa, Panicum virgatum
  misc_feature: Ceres CLONE 1829012
  misc_feature (38)..(296): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MAAGGGASAEAKYNSYKAPGLRGAFLEAAHVSCLEDRYALGPQLGWGQFGVIRSCSDLVTGEALACKSIAKDRLVSPDDVRGVKLEIEVMARLSGHPNVVDLKAVYEDEDSVHLVMELCAGGELFHRLEERGCFSEHEAAVLFRYLMEVVAHCHSKGIVHRDLKPENILLVSKSPSSPIKLADFGLATYILPGRSLSGMVGSPFYIAPEVLSGGYNEAADVWSAGVILYILLSGIPPFWGKTKSKIFECIRSTELRFPSDPWDRVSDSAKELVTGMLRRDPRQRLTAKQVLEHSWMQEHADQSQDSCSHCHGIGLRREDLGSCSFSTPLATRSRDVSFNTGGPITCQGMLEEDEAWSPSFACRSSFSAFVTDMAPSCSMSGFSFGEASELGGGVAFPTLPVASMPSFSFFCGQECGEPEPSASQGVSVATAAAAPSTSRRMSEVMGAARPVTNQSRVAGVNSRRNHTIGAGEREPLDVAVAESVIRWASCTNLSTTHSLRASLVC

SEQ ID NO: 23625 - DNA, 671 bp, Panicum virgatum
  misc_feature: Ceres CLONE 1829036
  misc_feature: Encodes the peptide sequence at SEQ ID NO. 23626
agacccgctcccactcccccaagctcgctcgctcgcacgcacgccgcggcggaacaccgccgccgccatggcctccacgtgcaccttcctctcgctgcgcctccccaccccgtcccctgcccacgcggcttcgtctccttccctcccgctgcccctgctccggcaggcgcggggagggggggcgtcctcggctctggtggacacgcgcggcggcgccaggggcggctccgtcgccgctgttcaaccccaggggggaccctttcctgtccaccctcgcggccgcctcgccggaggaccttgcgtccgccgctggtggcgagcgccgcgacgaggaccacctgccgttcctcgagatcttccagaacaccaagctcatggccacgcccgcgcaggtggagcgttctagcagttcttacagtcaacacagacctagaaggcctccaccaaatttgccttcattgcttcttcatggtcgaattgtttatattggaatgccgttggtgccagcagagactgagcttgttgttgcccagttgatgtaccttgaatggatgaatagtaaagaacctgtttatatatacgtcaactcaacatgaacagctcgtgatgatggtgaaccggtcgggatggagagagaaggttttgcaatctacgatgcaatgatgcgtatg

SEQ ID NO: 23626 - protein, 197 aa, Panicum virgatum
  misc_feature: Ceres CLONE 1829036
  misc_feature: SWISSPROT Homolog: EC 3.4.21.92 Endopeptidase Clp
TRSHSPKLARSHARRGGTPPPPWPPRAPSSRCASPPRPLPTRLRLLPSRCPCSGRRGEGGRPRLWWTRAAAPGAAPSPLFNPRGDPFLSTLAAASPEDLASAAGGERRDEDHLPFLEIFQNTKLMATPAQVERSSSSYSQHRPRRPPPNLPSLLLHGRIVYIGMPLVPAETELVVAQLMYLEWMNSKEPVYIYVNST

SEQ ID NO: 23627 - DNA, 663 bp, Panicum virgatum
  misc_feature: Ceres CLONE 1829097
  misc_feature: Encodes the peptide sequence at SEQ ID NO. 23628
accaccatccccaccgggttccctcgagcaccgcctgctcgtctcgcctcgcctcgccgcgacccgacgcggccgccctcccccgcgccggaaccctagcgaccgccattgcccccgcgtgccgcgcccgatggacggcgggggctccggggcggcgccgtacgcggcgcgcaccgcggaggaggtcttccgcgactaccgcgcccgccgcgccggcatgatcaaggccctcaccaccgatgtggacaagttcttcaagctctgcgaccccgaaaaggagaacttgtgcctttatgggtatcccaatgagacgtgggaggttaccttgccagctgaggaagtgcccccagagatcccggagccagcattaggcatcaactttgctagggatggcatgaatgagaaggactggctggcgctagttgcagttcacagcgattcctggttactgtctgttgcattctactttggtgcccggtttgggtttgacaaagaagctaggaggcgactctttagcatgataaacaacatgcctacaatatttgaggtagtgacaggaacaggatcggccaagaagcagacaaaggagaagacgcctaacagtagcagcaagagcaacaggcctagttcaaaagtgcagtcaagagctgagtctcgttcaag

SEQ ID NO: 23628 - protein, 177 aa, Panicum virgatum
  misc_feature: Ceres CLONE 1829097
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: Useful for making plants with altered alkaloid content
  misc_feature: The sequence is a functional homolog of SEQ ID NO 1981 in the 11/479,226 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
MDGGGSGAAPYAARTAEEVFRDYRARRAGMIKALTTDVDKFFKLCDPEKENLCLYGYPNETWEVTLPAEEVPPEIPEPALGINFARDGMNEKDWLALVAVHSDSWLLSVAFYFGARFGFDKEARRRLFSMINNMPTIFEVVTGTGSAKKQTKEKTPNSSSKSNRPSSKVQSRAESRS

SEQ ID NO: 23629 - DNA, 671 bp, Panicum virgatum
  misc_feature: Ceres CLONE 1829155
  misc_feature: Encodes the peptide sequence at SEQ ID NO. 23630
acccgtatccgtccctcgtcctcctctgctcctcgcctcctcccctccctcgaaggccggccggcgcagggcgggagatcgatccgaacttggagttgagtcggctccttcttctgctgggtaccatgaggaggttggtgtcgaccgccctcgtcgcgagggggctcgtcaggtcgtgccgcgcgccgacgacagctgctttgtcacaaccagcttttcagcagtttatgaactactcgtcaggacatggtggtgatcctaatgcaaacggggattcgactgtaacacaaatagctactgaccgtgatacacatcaagatttcaaaccaatgagcaaaaatttggacacgcctttgcatgacattgttgctcaggatatcagagaaaacccagtcttgatctatatgaagggtttccctgagtctccaatgtgtggcttcagtgcactggcagtcaaagtcttccagcaatatgatgtccctatctgtggtagagatattctgggagatctcaggctcaaagaggctgttaaagcccacactaactggcctacgtttccacaaatatttatcaaaggagagtttgttgggggatctgacatcatactaagcatgcaccagaagggggaactaaaggatctgcttggagactcacacaaagagatggacaaa

SEQ ID NO: 23630 - protein, 181 aa, Panicum virgatum
  misc_feature: Ceres CLONE 1829155
  misc_feature (90)..(154): Pfam Name: Glutaredoxin Pfam Description: Glutaredoxin
MRRLVSTALVARGLVRSCRAPTTAALSQPAFQQFMNYSSGHGGDPNANGDSTVTQIATDRDTHQDFKPMSKNLDTPLHDIVAQDIRENPVLIYMKGFPESPMCGFSALAVKVFQQYDVPICGRDILGDLRLKEAVKAHTNWPTFPQIFIKGEFVGGSDIILSMHQKGELKDLLGDSHKEMD

SEQ ID NO: 23631 - DNA, 1368 bp, Panicum virgatum
  misc_feature: Ceres CLONE 1829162
  misc_feature: Encodes the peptide sequence at SEQ ID NO. 23632
acccggcggttagtttattgcacgcggtccatctgccagtcccgcactgctctccacctatcgttcttcttcttcggtctcctcccctctttgttcaccggcgacccgccgtataaatcctgcttctgcaactgatctgatccgaggcttccgtgctcgggctcatggagttcaagaggaaggatgtatggggcctgctgctcgtgctgctcctcggccagctcgtcgccttctccatggccgcctcaagcttcacctcctccctcatcgccaatcttggagttgatgcaccactcacacagtctttcttcggatacctgctgctgaccttagtttatgtaccaatcgtcctgcatcgacggcagaagctgcacattgcttggtactggtacctagcactggcgttcattgatgtacagggcaactatcttgttgtgaaggcataccaatactcctacatcaccagtgtaactttgttggattgttggactgttgtatgggtcatcatactcacctggtacgcactgggcacaaggtattctttcttgcagtttgtaggggcagggacatgtgtggcagggcttgcccttgtgctcctttcagatgcggaatcaacaggggagccagatccaagtaaaataccacttctggaggatgcccttgttattgccgggacagttttttttgcatttagtaatgttggggaggaatactgtgtcaagaagaaagatcgagttgaagttgttgcaatgcttggactctttgggttgcttatcagtatggttcagatacttgtatttgaaaggaagagcctagaagcagttgcatggtctccaacaatgataagtctctttgcaggatttgcagtggcaattttcatattctacacaattactcctttcgttcttaagatgagtggagcaacattgttcaacctttcactgttaacatctgacatgtgggcagttgccattcgagttctattctaccatcaacagataaactggttgtactatctagcattcacagttgtggccgttggattaatcgtctactcgttgaatgaaagttcttcagataatgaaacagctgcaagtgcagaagcagcagcccaatatcatcagctacaaagtgaggatgattcaacaggaagtggacaaaattcaggtatccaagaaaggacacataaggaagaacttcacatctgttagtaggtcaatgtataaagacacctccttgttaatagatagacctgtacccgattcgatatggctattagtgacaacagatatatgcagagtaaacggttgctcaattcatgtataggcaaatgcattattagctcaagtgaaaaaatcaggatgtggg

SEQ ID NO: 23632 - protein, 348 aa, Panicum virgatum
  misc_feature: Ceres CLONE 1829162
  misc_feature (19)..(305): Pfam Name: UAA Pfam Description: UAA transporter family
MEFKRKDVWGLLLVLLLGQLVAFSMAASSFTSSLIANLGVDAPLTQSFFGYLLLTLVYVPIVLHRRQKLHIAWYWYLALAFIDVQGNYLVVKAYQYSYITSVTLLDCWTVVWVIILTWYALGTRYSFLQFVGAGTCVAGLALVLLSDAESTGEPDPSKIPLLEDALVIAGTVFFAFSNVGEEYCVKKKDRVEVVAMLGLFGLLISMVQILVFERKSLEAVAWSPTMISLFAGFAVAIFIFYTITPFVLKMSGATLFNLSLLTSDMWAVAIRVLFYHQQINWLYYLAFTVVAVGLIVYSLNESSSDNETAASAEAAAQYHQLQSEDDSTGSGQNSGIQERTHKEELHIC

SEQ ID NO: 23633 - DNA, 680 bp, Panicum virgatum
  misc_feature: Ceres CLONE 1829174
  misc_feature: Encodes the peptide sequence at SEQ ID NO. 23634
aaatccaaatctatctgatcagatctctccgacccccatccccatggcgatcgtgtacgcgctggtggcgcgcggcaccgtcgtgctggccgagttcgccgccgtctcgggcaacgccggcgccgtcgcccgccgcatcctcgagaagctgccgcccgacgccgactcccgcctctgcttcgcgcaggaccgctacatcttccacgtcctccgcgccgacgccggcatcaccttcctctgcatggccaacgacaccttcggaaggaggatcccctttctctacctggaggatatccagatgaggttcatgaagaactacggcagagtcgcgcactccgcgctcgcctatgccatgaacgatgagttctccagggtcctccaccaccaaatggagttcttctccagcaaccccagcgccgacacgctcaaccgtctccgtggagaagtcagcgagatacacaccgttatggtcgacaacatagagaaaattctagacagaggtgaccgcatctcactccttgtcgacaagacatccaccatgcaagacagcgctttccacttccgcaagcaatccaagaggctccgcagagcgctttggatgaagaatgccaagcttctagctgtgttgacggttgccatagtagtgctactctacttgctcatttctgctttctgtggag

SEQ ID NO: 23634 - protein, 212 aa, Panicum virgatum
  misc_feature: Ceres CLONE 1829174
  misc_feature (124)..(212): Pfam Name: Synaptobrevin Pfam Description: Synaptobrevin
  misc_feature: Useful for making plants with modulated heat sensitivity
MAIVYALVARGTVVLAEFAAVSGNAGAVARRILEKLPPDADSRLCFAQDRYIFHVLRADAGITFLCMANDTFGRRIPFLYLEDIQMRFMKNYGRVAHSALAYAMNDEFSRVLHHQMEFFSSNPSADTLNRLRGEVSEIHTVMVDNIEKILDRGDRISLLVDKTSTMQDSAFHFRKQSKRLRRALWMKNAKLLAVLTVAIVVLLYLLISAFCG

SEQ ID NO: 23635 - DNA, 663 bp, Panicum virgatum
  misc_feature: Ceres CLONE 1829184
  misc_feature: Encodes the peptide sequence at SEQ ID NO. 23636
gaccgctacggcaagccggtgcgcgggcactgcatcttctgggccgtcgagaacaccgtccagcagtgggtgaagagcctcgacaaggaccagctcacggcggcggtgcagggccgcctccagagcctgctcacccgctacgccggccggttcccgcactacgacgtcaacaacgagatgctgcacggcagcttctaccgcgaccggctcggcgacgacatcgacgccttcatgttccgggaggcggcgcggctggacccgggcgccgcgctgttcgtcaacgactacaacgtggagggcggcaacgacccgaacgcgacgccggagaagtacatcgagcagatcgcggcgctgcagcagaagggcgcgcccgtgggcggcatcggcctgcaggggcacgtcaccaacccggtcggggaggtcatctgcgacgcgctcgacaagctctccgccgccaccgacctccccgtctggctcaccgagctggacgtgtgcgagtccgacgtggacctccgcgccgacgacctcgaggtggtgctccgggaggcgtacgcgcacccggccgtcgagggcgtcgtgttctgggggttcctgcaggggcacatgtggcgccaggacgcgtgcctcgtcaactccgacggcaccgtcaacgacgccggcgaa

SEQ ID NO: 23636 - protein, 220 aa, Panicum virgatum
  misc_feature: Ceres CLONE 1829184
  misc_feature (1)..(220): Pfam Name: Glyco_hydro_10 Pfam Description: Glycosyl hydrolase family 10
  misc_feature: SWISSPROT Homolog: EC 3.2.1.8 Endo-1,4-beta-xylanase
  misc_feature: Useful for making plants with altered carbohydrate content
DRYGKPVRGHCIFWAVENTVQQWVKSLDKDQLTAAVQGRLQSLLTRYAGRFPHYDVNNEMLHGSFYRDRLGDDIDAFMFREAARLDPGAALFVNDYNVEGGNDPNATPEKYIEQIAALQQKGAPVGGIGLQGHVTNPVGEVICDALDKLSAATDLPVWLTELDVCESDVDLRADDLEVVLREAYAHPAVEGVVFWGFLQGHMWRQDACLVNSDGTVNDAG

SEQ ID NO: 23637 - DNA, 675 bp, Panicum virgatum
  misc_feature: Ceres CLONE 1829227
  misc_feature: Encodes the peptide sequence at SEQ ID NO. 23638
gctgctcttcgctctagcttggttccgtgctgatctttactagtagtggttgcctggtgtcgagaggaagcccccggagcacgggaggccggggagcttctcgaggagcgaggggcgcggccatgaggatccagtgcgacgcttgcgagggcgcggcggccacagtggtgtgctgcgcggacgaggcggcgctgtgcgcgcgctgcgacgtcgagatccacgccgccaacaagctcgccggcaagcaccagcgcctcccgctcggcggcggcgccggcgccggcggggacgtcccgcgctgcgacgtctgccaggagaagccggccttcatcttctgcgtcgaggacagggcgctcttctgccgcgactgcgacgaacccatccacgtccccggcacgctctcggggaaccaccagcgctacctcgccaccggcatccgcgtcggcttcagctccgtctgcggcgccggcgccggcgccgacgtccttccgccgcctaagggcagctcaaagcccgcggctgccgccgggtccgctaaggcgccggccagtaagcccgcgcagccgcaggaggtgccgtcgtcgccgttcctgccgccgtccgggtgggccgtcgaggacctcctgcagctctccgaccacgaatccagcgacaaggcaagctagcaaaccatcc

SEQ ID NO: 23638 - protein, 180 aa, Panicum virgatum
  misc_feature: Ceres CLONE 1829227
  misc_feature (1)..(47): Pfam Name: zf-B_box Pfam Description: B-box zinc finger
  misc_feature (55)..(102): Pfam Name: zf-B_box Pfam Description: B-box zinc finger
  misc_feature: The sequence is a functional homolog of SEQ ID NO 465 in the 11/479,226 US patent application
  misc_feature: The sequence is a functional homolog of SEQ ID NO 1961 in the 11/479,226 US patent application
MRIQCDACEGAAATVVCCADEAALCARCDVEIHAANKLAGKHQRLPLGGGAGAGGDVPRCDVCQEKPAFIFCVEDRALFCRDCDEPIHVPGTLSGNHQRYLATGIRVGFSSVCGAGAGADVLPPPKGSSKPAAAAGSAKAPASKPAQPQEVPSSPFLPPSGWAVEDLLQLSDHESSDKAS

SEQ ID NO: 23639 - DNA, 1552 bp, Panicum virgatum
  misc_feature: Ceres CLONE 1829228
  misc_feature: Encodes the peptide sequence at SEQ ID NO. 23640
gcaaccgagctcaactactgctgctcacctcagctgctagctcctgacaacaacgcagggggccggggggcgccatggacctccccgtggcgctcgccatcctcttcttctgcgtcctcctcctctcctccgccgccatcgccgtcctcctcgtccgccgctgcctcgccgccctccggcgccccgacgccgaccccgaggcgcgagcggtcgtgccccagcggccgcagtacgagctggccttgtcagcggaggcgccagccgcagagcaagcgaccgaccgcaaggacgcgccgcggcggctcacgtggcgggaggtggagacgctgaccggcggcttcgacgaggcggccgtcgtgggcaggggcggctccagcaccgtctacctcgccaggctccgggacggcgcgcccgtcgccgtcaaggtgcaccgctggtgcggcggcgagcgccgcctgcgcgcgttccggcaggagctcgacctgctccgccgcatccgccacccgcgcatcgtcgcgctcatcgcctactccgacgaccacgaggaaggaggcgcgctggtcctggagtacgtcgccggcggcacgctcgccgaccgcctccacggcggcgccacggcccctctgtcgtggccccagcgcatgcgcatcgtcctcgacgtcgcctgcgccctggagcacctgcacgacgcctccacccccgtggtccacggcgacgtctcggcgtccaacgtgctcctcgacgcccgggggctcggcacgcggctctgcgacctgggctccgcctgcgagggcttctcggccgccgtggcgcccacgcgcgccgccgtgggctcgccgggctacgccgaccccttcttcctccgcaccggcatcgtgtccaagaagtccgacgtgtacagcttcggcgtgctgctgctcgaggccgtcacgggcatgccggccgccggcgcgcccgggtcggagaacctggcgccccggatactgccgcgcgtcagggcgcaaggggtggcggggctcgtcgacggcaggctaggggaggggtacaacgacgaggaggccggcgacgtggcgaggatcgccgtggagtgcttggcggcgcagccggggctccggccggcgatgggtcaggtgcgtgcggccatcgcggagaaggcggcgaggtccattgccaaggctgatctcggcgaccaccatattcagctgagcaagctgttggagctcacatgattcaggcaggaatctgcagggacgacaattgcttgctcacatgattttcctagcacattgtttgtttagagttaagacgtcttagcttcaccctgctgcctctttctattttctgtttttatagaagtaaaatccttcggttgttacgttctaggtacaaattaagatccacggcgaaaacttaggcttgtaagaaaaaatgattgtgcattagagaagactttagagtgaccagagtgaaatgtaaatatggatggaattatcttatctttttctttcgtaattaaaagaataaagttagtgtgggccagcgcaccaccagc

SEQ ID NO: 23640 - protein, 384 aa, Panicum virgatum
  misc_feature: Ceres CLONE 1829228
  misc_feature (89)..(357): Pfam Name: Pkinase Pfam Description: Protein kinase domain
  misc_feature: SWISSPROT Homolog: EC 2.7.11.1 Non-specific serine/threonine protein kinase
MDLPVALAILFFCVLLLSSAAIAVLLVRRCLAALRRPDADPEARAVVPQRPQYELALSAEAPAAEQATDRKDAPRRLTWREVETLTGGFDEAAVVGRGGSSTVYLARLRDGAPVAVKVHRWCGGERRLRAFRQELDLLRRIRHPRIVALIAYSDDHEEGGALVLEYVAGGTLADRLHGGATAPLSWPQRMRIVLDVACALEHLHDASTPVVHGDVSASNVLLDARGLGTRLCDLGSACEGFSAAVAPTRAAVGSPGYADPFFLRTGIVSKKSDVYSFGVLLLEAVTGMPAAGAPGSENLAPRILPRVRAQGVAGLVDGRLGEGYNDEEAGDVARIAVECLAAQPGLRPAMGQVRAAIAEKAARSIAKADLGDHHIQLSKLLELT

SEQ ID NO: 23641 - DNA, 555 bp, Panicum virgatum
  misc_feature: Ceres CLONE 1829261
  misc_feature: Encodes the peptide sequence at SEQ ID NO. 23642
agaacaacgtacagatgggcaccacgcagcggcagctgctcctgctcttcttcctatctgcggtcgccccgcaggtagttagagcactgaaaccaatcccaaattccaatcttggggtcgaggagggagacaattccatacgaatcatacagaaggacatcatagagacggtcaacaagcatcccgatgctgggtggacggctgcacacagtccttactttgccaactatactattgcacaattcaaacgtctccttggagcgaagcccacaccacagggtgcgctgaccgatgttcctgccaaaacttattcaagatcactgaaacttccaaaggagttcgacgccagatctaggtggtctcattgcagcacaattgggaacatacttgatcaaggtcattgtggctcctgtagggcattaggtgccgtggagtgcctccaggatcgtttttgcattcatatgaacatgaacatttcactatcagtcaatgacctagtggcatgctgcggttttatgtgcggtgatggttgtgatggaggctatcctatcatgg

SEQ ID NO: 23642 - protein, 180 aa, Panicum virgatum
  misc_feature: Ceres CLONE 1829261
  misc_feature (45)..(88): Pfam Name: Propeptide_C1 Pfam Description: Peptidase family C1 propeptide
  misc_feature: SWISSPROT Homolog: EC 3.4.22.1 Cathepsin B
MGTTQRQLLLLFFLSAVAPQVVRALKPIPNSNLGVEEGDNSIRIIQKDIIETVNKHPDAGWTAAHSPYFANYTIAQFKRLLGAKPTPQGALTDVPAKTYSRSLKLPKEFDARSRWSHCSTIGNILDQGHCGSCRALGAVECLQDRFCIHMNMNISLSVNDLVACCGFMCGDGCDGGYPIM

SEQ ID NO: 23643 - DNA, 689 bp, Panicum virgatum
  misc_feature: Ceres CLONE 1829275
  misc_feature: Encodes the peptide sequence at SEQ ID NO. 23644
acactcgagcgcgcagaatttagctacctacaagtgccacaatataatgccttcccacggggctgttgccaacgatgatggcatgtcgttcctcggcgacaagtccgcgaaggtcttcctcgccggccacaaaggcatgctgggctccgccgtgcaccgccgcctggccgcgctgggcttcaccaacgtcgtcggccgcacccgcgcggagctggacctcacctgcgaggccgcggtgcgcaagttcttcgacgcagagcggccccgctacgtgatcctcgccgcgggcaaggtgggcggcctgcacgccagctccgccgcgccggtcgacttcatgaccgagaacctccgcatcaccaccaacgtcctcgccgccgcccgccactgcggcaccgtgcgcaagctgctcttcctcgccacctccgccgtctaccccgcggacgccccgcagccgatcccggagtccgcgctcctcgccggcccgccggcgccggggaacgagtggtacgccatccccaagatcgtgggcatcaagatgtgccaggcctaccgcgccgagctcggcatggacgccatcgtggcggcgcccaacaacctgtacggcccgcgcgagccgttcccgtcggagagctcccacgtcatcccggcgctcatccgccgcttccaccgcgccaaggccgccggcgcgc

SEQ ID NO: 23644 - protein, 214 aa, Panicum virgatum
  misc_feature: Ceres CLONE 1829275
  misc_feature (23)..(214): Pfam Name: Epimerase Pfam Description: NAD dependent epimerase/dehydratase family
  misc_feature: SWISSPROT Homolog: EC 1.1.1.271 GDP-L-fucose synthase
  misc_feature: Useful for making plants with altered carbohydrate content
  misc_feature: Useful for making plants with altered cell wall content and/or composition
MPSHGAVANDDGMSFLGDKSAKVFLAGHKGMLGSAVHRRLAALGFTNVVGRTRAELDLTCEAAVRKFFDAERPRYVILAAGKVGGLHASSAAPVDFMTENLRITTNVLAAARHCGTVRKLLFLATSAVYPADAPQPIPESALLAGPPAPGNEWYAIPKIVGIKMCQAYRAELGMDAIVAAPNNLYGPREPFPSESSHVIPALIRRFHRAKAAGA

SEQ ID NO: 23645 - DNA, 653 bp, Panicum virgatum
  misc_feature: Ceres CLONE 1829280
  misc_feature: Encodes the peptide sequence at SEQ ID NO. 23646
agatcgcgcgagcgcgagaccgagaggagcatgggatcggaggggcggggctggaacggcgcggccgccggagccggcgccggcgacggcgccaggggcggggaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcgtcgctggacagctcgtgcttctccatcgagacggtgtctggcggcatcacgaatctattgctgaaggtatctataaaagaagatactggaaatgagttttctgtgactgttcgtttgtatggaccaaatacagacttggtgattgatcggaaaagggaattgcaggcgataccatatctctcagctgcagggttcggggctcgactacttggaatttttgagaatggagtagttcagtcattcatcaatgctcgaacactgtcacctgcagacatgagagaacctagaatagcagctgagattgccaaggagctccacagattccatcaagtagacattccagggtgtaaagaaccacaactgtggaatgatatattcaagtttttgaaaaaagcttcagc

SEQ ID NO: 23646 - protein, 207 aa, Panicum virgatum
  misc_feature: Ceres CLONE 1829280
  misc_feature (105)..(207): Pfam Name: Choline_kinase Pfam Description: Choline/ethanolamine kinase
  misc_feature: SWISSPROT Homolog: EC 2.7.1.82 Ethanolamine kinase
MGSEGRGWNGAAAGAGAGDGARGGEEKPTTTAAVAAGAPADVPTSAASVDISLPLPEMTPHIIGLCKGSVKGWSSLDSSCFSIETVSGGITNLLLKVSIKEDTGNEFSVTVRLYGPNTDLVIDRKRELQAIPYLSAAGFGARLLGIFENGVVQSFINARTLSPADMREPRIAAEIAKELHRFHQVDIPGCKEPQLWNDIFKFLKKAS

SEQ ID NO: 23647 - DNA, 1153 bp, Panicum virgatum
  misc_feature: Ceres CLONE 1829287
  misc_feature: Encodes the peptide sequence at SEQ ID NO. 23648
ctcgcttgcggtggcggcggccttcgggggaagaagaggataggaaaagggagatgaactgatgaaggcgtgcgcgaaggcggcgggggagaggctccccctggttcgtcctcccaccgggcgggcgctggctcggagctttgttaaggtaagcagattaccctctcaatggataaagtctcaagtatcttgctccattggggtgtcgggaaatgcagcgcatagaatagaggccacagcagaaaatattttcccagcaaccaaagatcatgtcacaaaagcaactgatgcaattaacagaggagaagtgattgcagtgcccactgatacaatatacgggtttgcttgcgatgcctgctctgcaggagcagttaatcgcatctatgagatcaaagggcgcatacaaacacgccctctggcaatctgtgttgctgatgtctcagacatatcacgatttgctttagtagatcacttgccgcatggattgcttcatagtctacttcctgggcctgtcactgttgttctaaaacgaggtgaagacagtatattagagagatcacttaatcctggcttggatagcattggagttcgtgtgccggatctggatttcatacgatccattgctcgtggtgctggaagtgcacttgcacttactagtgccaacttaagcggacgacctagtagtgtcagcatcagagatttcgaggatttatggccgcattgttcatatgtctttgatggtggaatacttccttctgggcgtgctggttcaacaattgttgacctaataacaccaggagtctacaagatattgagagatggaagttcaagggaggaaacaacacgggtgcttggcaagttcggcttcgttgaagcttcatgacaaccctagtgccttctacaaagctgaaagaatcagagagttctccttttttatccttcataactcctgtttgattagttgatgtatgtacatgtcgtcgtgtgtgatttttttacatcagctttttcctgtgatcgatgttgattagaatagcagagctaaaccttatttaaggagtgcagagtgtgatgtgtttttaattttgttggaagtggagcaactcatctgggaactctggatgtgctgtgcccacgacacaagtcgtgctag

SEQ ID NO: 23648 - protein, 273 aa, Panicum virgatum
  misc_feature: Ceres CLONE 1829287
  misc_feature (75)..(254): Pfam Name: Sua5_yciO_yrdC Pfam Description: yrdC domain
MKACAKAAGERLPLVRPPTGRALARSFVKVSRLPSQWIKSQVSCSIGVSGNAAHRIEATAENIFPATKDHVTKATDAINRGEVIAVPTDTIYGFACDACSAGAVNRIYEIKGRIQTRPLAICVADVSDISRFALVDHLPHGLLHSLLPGPVTVVLKRGEDSILERSLNPGLDSIGVRVPDLDFIRSIARGAGSALALTSANLSGRPSSVSIRDFEDLWPHCSYVFDGGILPSGRAGSTIVDLITPGVYKILRDGSSREETTRVLGKFGFVEAS

SEQ ID NO: 23649 - DNA, 620 bp, Panicum virgatum
  misc_feature: Ceres CLONE 1829295
  misc_feature: Encodes the peptide sequence at SEQ ID NO. 23650
cggaatctacaacgaccaccactaccacctgaggctacttcctctacgccatcgcggtgctggccaagatcgacccgtgctggggccgcaagcacatgccccaggcctacgccatggtggccgacttcatgaccctgtcgcggaaccgggccggcggcagcttcacccggctccggatgtacgacctgtggaagctgcactcgtgggcgggcgggctgacggagttcgcggacgggcgcaaccaggagagcaccagcgaggccgtgggcgcctactactcggcggcgctggtggggctcagctaccgggacgcgcacctggtgtcgctgggcacgacgctggcggcgctggaggcgctggcggcccagacgtggtggcacgtgcgcgccggcgagggcatctacgaggaggacttcacggcggcgaaccgcgtggtcggggtgctgtgggcgaacaagcgcgacagcgggctgtggttcgcgccgcccgagtggagggagtgccagctggggatccagctgctgccgctgctgcccgtgagcgaggcgctgttcccagacgccgcgttcgtccgggacctggtggcgtgtacggagccggcgctggcgcgggactgcatc

SEQ ID NO: 23650 - protein, 174 aa, Panicum virgatum
  misc_feature: Ceres CLONE 1829295
  misc_feature: SWISSPROT Homolog: EC 3.2.1.6 Endo-1,3(4)-beta-glucanase
MPQAYAMVADFMTLSRNRAGGSFTRLRMYDLWKLHSWAGGLTEFADGRNQESTSEAVGAYYSAALVGLSYRDAHLVSLGTTLAALEALAAQTWWHVRAGEGIYEEDFTAANRVVGVLWANKRDSGLWFAPPEWRECQLGIQLLPLLPVSEALFPDAAFVRDLVACTEPALARDC

SEQ ID NO: 23651 - DNA, 675 bp, Panicum virgatum
  misc_feature: Ceres CLONE 1829314
  misc_feature: Encodes the peptide sequence at SEQ ID NO. 23652
acgacacacacgcaccagaggcgaggtccgaggagagctcaggcgcagcgacggcaatggcagcgtcactccaagcagcggccaccctgatgcagccggccaagatcggcggccgcgcctccgcctcgctgctgtcccgccagccgtcccacgtcgccagggcgttcggcgtcgacaccggcgcggccaggatcacgtgctctctgcagtccgacatcagggaggtcgcgagcaagacgtacatggaggtgaaggggaccggcacggcgaaccagtgcccgaccatcgacggcggcgtcgagtccttcccgttcaagcccggcaagtaccagatgaagaagttctgcctggagccgacgtccttcaccgtcaaggccgagggcatcgccaagaacgcgccgcccgagttccagaagaccaagctcatgacccgcctcacctacaccctcgacgagatcgagggcccgctcgaggtcggctccgacggcaccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcctccttcctcgaccccaaggggc

SEQ ID NO: 23652 - protein, 206 aa, Panicum virgatum
  misc_feature: Ceres CLONE 1829314
  misc_feature (56)..(206): Pfam Name: MSP Pfam Description: Manganese-stabilising protein / photosystem II polypeptide
MAASLQAAATLMQPAKIGGRASASLLSRQPSHVARAFGVDTGAARITCSLQSDIREVASKTYMEVKGTGTANQCPTIDGGVESFPFKPGKYQMKKFCLEPTSFTVKAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKG

SEQ ID NO: 23653 - DNA, 692 bp, Panicum virgatum
  misc_feature: Ceres CLONE 1829328
  misc_feature: Encodes the peptide sequence at SEQ ID NO. 23654
gcttcccagaccagaccacaacacatccatggcgatctcccagatctcccgcgggcccctggccctcctcctcctcctcgccgccgccttcgccgccgccccagcagcgctcgccgacggcgacgacgtgttggccctcaccgagtccaccttcgagaaggaggtcgggcaggaccgcgccgccctcgtcgagttctacgccccctggtgtggtcactgcaagaagcttgctcctgagtatgaaaggcttggcgcaagttttaagaaagctaaatccgtcttgatcgcgaaggttgattgtgatgagcacaagagtgtgtgcagcaaatatggagtttctggatatccaacaattcagtggttcccaaaaggatccttggagcccaaaaagtatgaaggacaacgcactgcggaagcccttgctgaatttgttaatactgaaggaggcacaaatgtaaagctggcaaccattccttcaagtgttgtggtgctcaccccagagacttttgactcagttgtccttgatgaaacaaaagacgtccttgttgagttctatgccccatggtgtggtcactgcaagagtcttgctcctatttatgagaaggtggcttctgttttcaagttggatgagggggttgttattgcaaaccttgatgctgacaaacacagggatttggctgagaagtatggag

SEQ ID NO: 23654 - protein, 221 aa, Panicum virgatum
  misc_feature: Ceres CLONE 1829328
  misc_feature (33)..(138): Pfam Name: Thioredoxin Pfam Description: Thioredoxin
  misc_feature (151)..(221): Pfam Name: Thioredoxin Pfam Description: Thioredoxin
  misc_feature: SWISSPROT Homolog: EC 5.3.4.1 Protein disulfide-isomerase
MAISQISRGPLALLLLLAAAFAAAPAALADGDDVLALTESTFEKEVGQDRAALVEFYAPWCGHCKKLAPEYERLGASFKKAKSVLIAKVDCDEHKSVCSKYGVSGYPTIQWFPKGSLEPKKYEGQRTAEALAEFVNTEGGTNVKLATIPSSVVVLTPETFDSVVLDETKDVLVEFYAPWCGHCKSLAPIYEKVASVFKLDEGVVIANLDADKHRDLAEKYG

SEQ ID NO: 23655 - DNA, 663 bp, Panicum virgatum
  misc_feature: Ceres CLONE 1829329
  misc_feature: Encodes the peptide sequence at SEQ ID NO. 23656
aaatccgccgcatctcaaatcaggtgcgaatcgaatcgaccaagaacagcagcagcagcagcagcagcagcagcagcaggcatggggtccgccagccgcgccgtctcgtgcctctgctgcccctgcaggtgcctcgcctgcgggctcctgagctgcctctgcagcatcctcatctccctcctcgtcaccctcggcgtcctcgccctcgtcctctacctcatcttccgcccccacatgatcgccgccaccgtcgactccgcctccctcgccaccttcaccctctccccgacctcctcgctcgcctacaacctcaccgtcgccgtcaccgtgcgcaaccccaacaagcgcgtcggcctctactacgacaacgtcgaggccctcgccttctacaaggcccagcgcttcggctacgaccccatcgacgccttctaccagggcacccaggattccacccggctcaagcccgagttccacggccagcagctgctccagggggacgtcaccgccgcgcagttcaggcaggaccagaccgacggcaacttcgccatcaacgtcggcctcaacgccaagctcagggtcaaggtctgggccttcaaggtccgggggcccaaggccaggatcacctgcagcctcctcgtcccggcgccgggagccaccaacgga

SEQ ID NO: 23656 - protein, 193 aa, Panicum virgatum
  misc_feature: Ceres CLONE 1829329
  misc_feature (45)..(182): Pfam Name: Hin1 Pfam Description: Harpin-induced protein 1 (Hin1)
MGSASRAVSCLCCPCRCLACGLLSCLCSILISLLVTLGVLALVLYLIFRPHMIAATVDSASLATFTLSPTSSLAYNLTVAVTVRNPNKRVGLYYDNVEALAFYKAQRFGYDPIDAFYQGTQDSTRLKPEFHGQQLLQGDVTAAQFRQDQTDGNFAINVGLNAKLRVKVWAFKVRGPKARITCSLLVPAPGATN

SEQ ID NO: 23657 - DNA, 584 bp, Panicum virgatum
  misc_feature: Ceres CLONE 1829339
  misc_feature: Encodes the peptide sequence at SEQ ID NO. 23658
aaacccatttccttcctgcctccacgacccagcccaggcccggcggtgcctctccctctcgtctccggatcggcaagagcccagctgctgccggattcacacgacacctcgtcgtctctctctctctctctctctctctctctctctctcgccgccgccgccgccgccgcggcgaggcccgccaccagagggtggatgacgctactggcgggtgaccgcgactaccggacacggctgtggcgggactggcccagggcctgcgcaaggtcggcacgacgaacctgcggctgaactgccgtgctgcccgacgtggcggacgcccagcgccagatcctcgtctcgcagggctccctcctgcgcgagatggagcccgcgcccccgccggagaacccgactcacgccgagaggccctcgtaccccatcgactactccacgctccgcatctgggaggtcgtggagcactagcggatggcgcacatggacgcggacgtccagtggttcgataactcccagaagctgttcgagctcaagaagggccactgctacgccgtgatggactgctgctgcgagaagacgtgcagcca

SEQ ID NO: 23658 - protein, 38 aa, Panicum virgatum
  misc_feature: Ceres CLONE 1829339
  misc_feature: Useful for making plants with altered carbohydrate content
  misc_feature: Useful for making plants with altered cell wall content and/or composition
  misc_feature: Useful for making plants with modulated water use efficiency
MAHMDADVQWFDNSQKLFELKKGHCYAVMDCCCEKTCS

SEQ ID NO: 23659 - DNA, 1712 bp, Panicum virgatum
  misc_feature: Ceres CLONE 1829343
  misc_feature: Encodes the peptide sequence at SEQ ID NO. 23660
atccatccatccatccatcgtcgtcagcgagagcacgagaggatcagcggtgtggggcgcggcggcgcggcgaggaatcgtacatcaccgggggcgttgcagcctaggcggcgcgcaggagcggttaggcgcgggggcggcggctggttcgggacgctcggctgacgcggcaagggctcaccgaggcaggccatcaagcttctgctgtgcttctcgagggcgcgatctctcgtttggcgatgctgtaagcaggcggagaacaaaaaaattcattatgctttgccaaaggagttctacgctatggcaacccgtatcctgtcgcgtcaaaatctgacaaagttggcttccttcgcactccagaacatatcccagaggcaattaattttaccttgccctccactcctcagatctactgctgtttcccctagcaaatgtttcagccccctttacctgtttggaaattcgtggactgtcagatgggctacctatggatcagtgaatctagttttgtctgatgatggcaagcctaagtttcagattgaggaggtggaaccctccaaaaaaggaaggtatttgacaaagaagcgcttgaagcttcagagaaagcgggtaaagaaaaagaggaaagaggcaaataaaaatgatccacgacgcattaggcccaagggaaagaagataaaacaaaaattccccacagctgaagctaggctcaaatataagattgagaaggccaaattaaaggaagctatgttggttgaaaagctaaagaagtatgaggttgccaaagctcaaggccctatggctaaaccagatgatcttagcggtgaggaaaggttttacttgaagaaggtttcacagaaaaagtcaaattatgtccctgttggaaggcgaggagtttttggaggcgtaattctgaacatgcatttgcattggaagaaacatgaaactgtgaaggtcatatgtaagccatgcaaaccagggcaaatccaggaatatgcaaatgagatagctagattgagtggcggtatccctgttaacatcattggagatgacactatagtcttctaccgaggaaagaactatgttcagccagaagttatgtcacctgttgatacattgtcaaagaaaaaggcacttgaaaaatcaaaatacgaacagtcgctggagacagttcggcgtttcattgcagtatctgaaaaggagcttgaactttattatcggcatgttgcactttatggaattccacaatcccagaaggctgatcttgtttgtggtgatgatagagaagcttctttgcttaaaatgggaggattggatcaagggaaggaccaactgccccatgtgactactgatcatttttctgattttcacatcagtgatgtttctgaatcagatgaagaagatacttctggtagtgaatacgatgttaatgacaatgacactgagggtatgatcaacatttctgaagacgtgatttcagatcatggtgtgttagccaacagaaagtgaagtgtgattaccttttctgacacgattacattgttgtctataaatttgcctcggacttagccgcacattataccatggatgtttctcagcactcagattgaatgatgtcagtgttaggctttggtgtaccgaatcatcatcatattatgttgattattcattacagctagctggcccttctgttgtcagctaaggctggtttc

SEQ ID NO: 23660 - protein, 402 aa, Panicum virgatum
  misc_feature: Ceres CLONE 1829343
  misc_feature (173)..(257): Pfam Name: CRS1_YhbY Pfam Description: CRS1 / YhbY domain
MATRILSRQNLTKLASFALQNISQRQLILPCPPLLRSTAVSPSKCFSPLYLFGNSWTVRWATYGSVNLVLSDDGKPKFQIEEVEPSKKGRYLTKKRLKLQRKRVKKKRKEANKNDPRRIRPKGKKIKQKFPTAEARLKYKIEKAKLKEAMLVEKLKKYEVAKAQGPMAKPDDLSGEERFYLKKVSQKKSNYVPVGRRGVFGGVILNMHLHWKKHETVKVICKPCKPGQIQEYANEIARLSGGIPVNIIGDDTIVFYRGKNYVQPEVMSPVDTLSKKKALEKSKYEQSLETVRRFIAVSEKELELYYRHVALYGIPQSQKADLVCGDDREASLLKMGGLDQGKDQLPHVTTDHFSDFHISDVSESDEEDTSGSEYDVNDNDTEGMINISEDVISDHGVLANRK

SEQ ID NO: 23661 - DNA, 1598 bp, Panicum virgatum
  misc_feature: Ceres CLONE 1829344
  misc_feature: Encodes the peptide sequence at SEQ ID NO. 23662
accaagcagagaccaagccagtgggtgttccgagagcatagccagccaaccacaatggcgggaaacctgctatctaactatgtccaggtgttcaagctggtgcaggaggccgggctgaagctgcaggccatcatgtcgtgccaccagtgcggcggcaatgtcggcgacatcgtcaacatcccgatcccgcagtgggtgcgggacgttggtgaggccaaccccgacatcttctacaccaaccggaggaagatgaggaacatcaagtacctcacgattggagtggatgaccagcctctcttccaggggagaactgcaattcagctctatgctgattacatgaagagcttcagggagaacatggcagagttcttggacgctggtgtcatcgtggacattgaggtcggacttggccctgctggagagatgaggtacccctcctatccacagagccagggatgggtgtacccaggcgttggagagttcatatgctatgacaagtacctggaagcagacttcaaagctgcagcaacaaaagctgggcatcctgagtgggaattgcctgatgacgctggggagtacaatgacactcctgagaaaacccggttctttgcggacaacaacggaacataccagaccgagaaggggaagttcttcctcacatggtactccaacaaactgatcaagcacggcgataagatcttggacgaagcaaacaaggtcttcttgggatgcagagtgcagctggccatcaaaatctctggcattcactggtggtacagggttccaaaccatgcagctgagctcactgccgggtactacaacttagatgacagagacggttacagaaccatagcgcacatgctcacaaggcatcgtgctagcatgaacttcacttgtgctgagatgagggacaatgaacagagttcggaagcaaaaagtgcacctgaggaactggttcagcaggtgctgagtgccggatggagggagggcctaaacatagcatgtgaaaatgcactcagtcgctatgatgccacagcttacaacacaatcctcaggaatgcaagaccacaaggaatcaacaagaatggccctcctgaacacaagttgtatgggttcacctacctccgagtatcgaatgagctccttgaaggacagaactatgccactttcaaaacttttgtcaggagaatgcatgctaacctggattataacgcaaacatcgatccacttgcacctatggaaagatcaaagccagagataccaatcgaacaaatcctggaagtagcacagccaaagctggagccatttcctttcatcgagaacacagatctaccagtttaaacatcccaatggttcaatttcaatctacaagaaggggcacaaggaactttaagaatcaagacaaacacagtacgcctattgtcgaacaatatgctgaaactaaataaactgctatgttaagcagactacaatcatgttgcaccaataatcttgtgttgttcaacctgaggcttgatgcttgtctaatgagctgtaataccttggccttcacattgttgtatgtatttgagctaatgaataaaaaagttatgtggggt

SEQ ID NO: 23662 - protein, 428 aa, Panicum virgatum
  misc_feature: Ceres CLONE 1829344
  misc_feature (1)..(375): Pfam Name: Glyco_hydro_14 Pfam Description: Glycosyl hydrolase family 14
  misc_feature: SWISSPROT Homolog: EC 3.2.1.2 Beta-amylase
MAGNLLSNYVQVFKLVQEAGLKLQAIMSCHQCGGNVGDIVNIPIPQWVRDVGEANPDIFYTNRRKMRNIKYLTIGVDDQPLFQGRTAIQLYADYMKSFRENMAEFLDAGVIVDIEVGLGPAGEMRYPSYPQSQGWVYPGVGEFICYDKYLEADFKAAATKAGHPEWELPDDAGEYNDTPEKTRFFADNNGTYQTEKGKFFLTWYSNKLIKHGDKILDEANKVFLGCRVQLAIKISGIHWWYRVPNHAAELTAGYYNLDDRDGYRTIAHMLTRHRASMNFTCAEMRDNEQSSEAKSAPEELVQQVLSAGWREGLNIACENALSRYDATAYNTILRNARPQGINKNGPPEHKLYGFTYLRVSNELLEGQNYATFKTFVRRMHANLDYNANIDPLAPMERSKPEIPIEQILEVAQPKLEPFPFIENTDLPV

SEQ ID NO: 23663 - DNA, 673 bp, Panicum virgatum
  misc_feature: Ceres CLONE 1829413
  misc_feature: Encodes the peptide sequence at SEQ ID NO. 23664
cggaatagcaggcaagatgaacaggaagcctggagactgggactgcagggcttgccagcacctcaacttcagccggcgggacctatgccagcgctgtggtgagccacgtggagctgctgaccgtggcagcggtggtggaggtgactatgccaacttcggtggccgcggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggttctggtggctttgatggtgacatgtcacgctctcgctacggcttcggtggcggtgctgcccgcaccaaccgccctggttggaagtctggagactggatctgcaccaggtccggatgcaacgagcacaactttgccagcaggatggaatgtttcaggtgcaacgcaccacgggactccggtagcgctgccatgacctacgatacttataacttgcactgaggtgtaggatcggagctgatgcttcgaacggaccccgacgagcagaagcagcaagaagatgagtccctcaagctgataagaagagtagtagatttgcaaaaggcgtccccgatgctctattactagttttgttccacc

SEQ ID NO: 23664 - protein, 172 aa, Panicum virgatum
  misc_feature: Ceres CLONE 1829413
  misc_feature (128)..(159): Pfam Name: zf-RanBP Pfam Description: Zn-finger in Ran binding protein and others
  misc_feature (66)..(94): Pfam Name: zf-RanBP Pfam Description: Zn-finger in Ran binding protein and others
  misc_feature: Useful for biocontainment applications
  misc_feature: Useful for making plants with modulated biomass
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGSGGFDGDMSRSRYGFGGGAARTNRPGWKSGDWICTRSGCNEHNFASRMECFRCNAPRDSGSAAMTYDTYNLH

SEQ ID NO: 23665 - DNA, 654 bp, Panicum virgatum
  misc_feature: Ceres CLONE 1829422
  misc_feature: Encodes the peptide sequence at SEQ ID NO. 23666
gccagcggcagcggtagcagcgcccagcgcgcaccacagccagcggcgagcggcgagcggcgagcggcgagttctttaaggaagcggcaggccgcctttgcccggcttggcttggagtgggagtcgagtggcttgccttctcggagaagacaagcgagcattcttgtcttcctcgctctctcctgctttccttcctgtcctgtttctactttctactagtagtagcagcagccagcagccagcagccagccgccgcctctgcctgtgcgggaggaggaagagggaggaggaagcagggttgggagagggagggagagatgagcgtgaccaagttcatcaagtgcgtgacggtgggcgacggcgcggtgggcaagacctgcatgctcatctgctacaccagcaacaagttccccacggactacacccccacggtgttcgacaacttcagcgccaacgtctccgtggatggcaacatcgtcaacttggggctctgggacactgctgggcaagaggactacagcaggctgaggccactgagctacaggggggcagacgtgttcgtgctggccttctccctgatcagcagggcaagctatgagaatgttcttaagaagtgggtgccagagttgcgcagatttgcacccaatgttccag

SEQ ID NO: 23666 - protein, 112 aa, Panicum virgatum
  misc_feature: Ceres CLONE 1829422
  misc_feature (8)..(112): Pfam Name: Ras Pfam Description: Ras family
  misc_feature: Useful for making plants with modulated nitrogen use efficiency
MSVTKFIKCVTVGDGAVGKTCMLICYTSNKFPTDYTPTVFDNFSANVSVDGNIVNLGLWDTAGQEDYSRLRPLSYRGADVFVLAFSLISRASYENVLKKWVPELRRFAPNVP

SEQ ID NO: 23667 - DNA, 660 bp, Panicum virgatum
  misc_feature: Ceres CLONE 1829428
  misc_feature: Encodes the peptide sequence at SEQ ID NO. 23668
atcgagcaccctccaatcttcaaggcgtcgcagcaggcaaggcatcgatcgatcaatcaccagcagcgcgtgccgcgtagagagatcgagagagagagagagagagagagagagagagagagagagagagagagagagagagagagagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcggcgggcagcgcgccgtcgtcgccgtccccgaggaagtcgtcggcgtcggcgccggtggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcct

SEQ ID NO: 23668 - protein, 151 aa, Panicum virgatum
  misc_feature: Ceres CLONE 1829428
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPVAPAAETKDEMERVFRKFDANGDGRISRSELAALFEGVGHAATDDEVSRMMEEADADGDGAISLPEFAALVRSADADADAVEEDLRHAFMVFDADGNGLITPAELARV

SEQ ID NO: 23669 - DNA, 714 bp, Panicum virgatum
  misc_feature: Ceres CLONE 1829438
  misc_feature: Encodes the peptide sequence at SEQ ID NO. 23670
aaaccaaacacctccccctccctcccaggtctcatccaatccattacccattcgccggggcaaacaaatccggtgagctgcctgccagccgcgcgggagcctcggaagggcatagtattgtatactagcactatataaccagccgccgccgcggtcgtcggggtcgctcctacctcgctgcaccggccagtcctcctctccccccccccccccccttccgcctcgccgcgccgcgcctctgtcgccgggagtagggagggagaggcgccggcagatcgatcggggaggcgcgcgggggctcggcggccggttgctgctatggcggaggcggtgcgggggctgcgcgcaagcttcgcggcggggcggacgcggccggcggagtggcgggcggcgcagctccgggcgctggtgcggatgatcgacgagcgggaggccgacatcaccgccgcgctccacgacgacctcgccaagccgcacatggagtcgtacctccacgagatatcgctcgcgaagtcctcgtgcaagttcgcgctcaacgggctcaagaactggatgaagcccgagaaggtacctgcggccataactacgttcccgtcctctgcgcaaatcgtgcctgagcccctcggtgtggtgctcgtcatctccgcctggaactacccattcctgctctctattgatccggtaattggagcaatagctgctggaaatgctgtt

SEQ ID NO: 23670 - protein, 131 aa, Panicum virgatum
  misc_feature: Ceres CLONE 1829438
  misc_feature: SWISSPROT Homolog: EC 1.2.1.3 Aldehyde dehydrogenase (NAD(+))
MAEAVRGLRASFAAGRTRPAEWRAAQLRALVRMIDEREADITAALHDDLAKPHMESYLHEISLAKSSCKFALNGLKNWMKPEKVPAAITTFPSSAQIVPEPLGVVLVISAWNYPFLLSIDPVIGAIAAGNA

SEQ ID NO: 23671 - DNA, 1461 bp, Panicum virgatum
  misc_feature: Ceres CLONE 1829439
  misc_feature: Encodes the peptide sequence at SEQ ID NO. 23672
atcaagcagctcggagaaggccgacgcccgacgacggcgagccagaagaggccgccgatccgaccctgagagctcgcgcgcacagtacgcggccatggttgaggaagcggcggccgtgccccccgccgtggcggcatcggcggccgcgagcgccccgccgcacctgctgctgatctgcttcccggggcagggccacgtgaaccccatgctccgcctggcgaagcgcgtcgcggccaagggcctcctcgtgaccttctcctcgctggccagcgttggcccgaagctggcggccgccgcgggggtgtcggccggcggcgacggcgtgcccgtcggccggggccgcgtccggttcgagttcctggaggacggcgaccccgggcccgacctggacgacctcatgcggcacctcgagacggccgggcccccgccgttcgcggcgctgctgcggcgccaggcggaggagggccggcccgtggcgtgcgtggtggcgaataacccgttcatgccgtgggcgagcgacgtggccgccggcgaggggatcccgacggcggtgctgtgggtgcagtcgtgcgcggtgttctcgctctactaccaccaagtgcacggcctggtggagttcccgcacgaggacgacccgacggcgcggttcaagctcccgggcctgccggagatgtccgccgccgacgtgccgtcgttcctgctcccgtccaacccgttgaagctccacgccgacgcgatcatcaggcagttccgcaccatcgggcgcgcgtcgtgggtgctggtgaactcgttcgcggagctggaggcggacgtggtggccgcgctccccggcgtgacgccgcgcccgccggagctcatctccgtgggtccgctcgtcgagctgcagcagcaggaggggcaggaggaggacgatgcggtgcgcggggacctgatcaaggccgccgacgactgcgtggagtggctggacgcgcagccgccgcggtccgtggtgtacgcgtcgatgggcagcgtggtggtgctgacccccggcgaggtcgccgagatggcgcacgggctggcgtcgacggggcggccgttcctgtgggtggtgcggccggacacgcagccgcaccttcccgcggggttcgtggagtccgtgtccgggcgcggcgcggtggtggcgtggagcccgcaggagcgcgtgctggcgcacccgtcgacggcgtgcttcctgacgcactgcgggtggaactcgacgctggagacggtggcggcgggggtgcccgtggtggcgttcccgcagtggggggaccagtgcacggacgcgcgcttcctggtggaggagctcggcatgggcgtgcgcctgcggggcgcgcggcgggaggccgtgcgggaggccgtcaaggccgccgtcgcggggccccgcgcgggggagatgctcgcgagcgccaggcgcyggagcgccgccgccagggccgccgt

SEQ ID NO: 23672 - protein, 455 aa, Panicum virgatum
  misc_feature: Ceres CLONE 1829439
  misc_feature (31)..(455): Pfam Name: UDPGT Pfam Description: UDP-glucoronosyl and UDP-glucosyl transferase
  misc_feature: SWISSPROT Homolog: EC 2.4.1.210 Limonoid glucosyltransferase
  misc_feature (448)..(448): Xaa is any aa, unknown, or other
MVEEAAAVPPAVAASAAASAPPHLLLICFPGQGHVNPMLRLAKRVAAKGLLVTFSSLASVGPKLAAAAGVSAGGDGVPVGRGRVRFEFLEDGDPGPDLDDLMRHLETAGPPPFAALLRRQAEEGRPVACVVANNPFMPWASDVAAGEGIPTAVLWVQSCAVFSLYYHQVHGLVEFPHEDDPTARFKLPGLPEMSAADVPSFLLPSNPLKLHADAIIRQFRTIGRASWVLVNSFAELEADVVAALPGVTPRPPELISVGPLVELQQQEGQEEDDAVRGDLIKAADDCVEWLDAQPPRSVVYASMGSVVVLTPGEVAEMAHGLASTGRPFLWVVRPDTQPHLPAGFVESVSGRGAVVAWSPQERVLAHPSTACFLTHCGWNSTLETVAAGVPVVAFPQWGDQCTDARFLVEELGMGVRLRGARREAVREAVKAAVAGPRAGEMLASARRXSAAARAA

SEQ ID NO: 23673 - DNA, 1513 bp, Panicum virgatum
  misc_feature: Ceres CLONE 1829442
  misc_feature: Encodes the peptide sequence at SEQ ID NO. 23674
accgccgttcaaaattcgaatccagaattccccaagcttttcttaaatcgtccgttccccatcgacctccccctcgtgctcgcctcgcccgttgcgcgttcaaatttcgaatccctcctcctccggcgcccaagccctagctcgattcctcctcctcctcctcctcggccgcctgccatcatgagcgccgccgccgcgccagccgctatgggcagcggcaaggagctcgccaacccgccctccgacgggatctccaacctcctcttctccaaccacagcaacaacctcctcgtgtcctcgtgggacaagacggtgcggctgtatgacgctgacgccaacgtgctcaagggggagttcgtgcaccccgggcccgtcctcgactgctgcttccacgacgactcctcgggcttcagcgctggagccgaccacaccgtgaggaggctagtatttagttcatccaaagaagatgttctggggcgacacgatggtccagttcgttgtgtggaatactcttatgctgcaggacaagtcatcacaggcagctgggataaaactgttaaatgttgggatccaagaggagtgagtggaccagagcgtacacttgttgggacatatactcaaccagaacgtgtatattctctgtcattagtaggaaataggttggttgttgcaactgcagggaggcatgtcaatatttatgatttgcgcaatatgtctcaacctgagcaaaagagagactcgtctttgaaatatcaaacacgatgcgttcgatgtttcccaaacggaacaggatatgctctaagttctgtcgaagggcgagtttctatggaattctttgatctatctgagtccgcacagtctaaaaagtatgctttcaagtgtcatcggaaatctgaagctgggagggacagtgtttatcctgttaatgcaattgccttccatccaatatatggaacatttgccactggaggttgtgatggatttgtgaatgtgtgggatggcattaacaagaaaagactatatcagtactcaaagtacgcatcaagcattgctgctctttcattcagtaaggatggccatcttcttgctgtggcatccagctacacttacgaagagggggaaaaatcgcatgagcctgatgcaatattcatcaggacagtgaatgaagttgaggtaaaaccgaagcccaaggcattggccgctccccagtagtactgtaatcagttgttggacagtatcagtcagatggctagatgatccttacttctcttgatgtcaattatgttagttgacgcagagcttgattacgttgaggtgaaatgttagtaaatccatctatttctgaattgtgtccgtggaaacatttcatgttccagctgattgtataattcgatagagattatgttttagtttattttgattctatgttgagttagaacttatttgtttctccattttagtaagtttggaactctggaggtggaggaaaataaaatactggcatgtagcatct

SEQ ID NO: 23674 - protein, 343 aa, Panicum virgatum
  misc_feature: Ceres CLONE 1829442
  misc_feature (92)..(130): Pfam Name: WD40 Pfam Description: WD domain, G-beta repeat
  misc_feature (235)..(273): Pfam Name: WD40 Pfam Description: WD domain, G-beta repeat
  misc_feature: SWISSPROT Homolog: EC 2.3.1.48 Histone acetyltransferase
MSAAAAPAAMGSGKELANPPSDGISNLLFSNHSNNLLVSSWDKTVRLYDADANVLKGEFVHPGPVLDCCFHDDSSGFSAGADHTVRRLVFSSSKEDVLGRHDGPVRCVEYSYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDSVYPVNAIAFHPIYGTFATGGCDGFVNVWDGINKKRLYQYSKYASSIAALSFSKDGHLLAVASSYTYEEGEKSHEPDAIFIRTVNEVEVKPKPKALAAPQ

SEQ ID NO: 23675 - DNA, 1440 bp, Panicum virgatum
  misc_feature: Ceres CLONE 1829474
  misc_feature: Encodes the peptide sequence at SEQ ID NO. 23676
aaaaccaaagatccgcatcatccaatcccgcgcggacacccaattttccccttattttgctccttttctgcgcggtgctaggaatagtgcgccgcgctggtttaggttttgcgcggtggcagtgaggccttgaagctagggttaggatccccgggcggcggagggatggacaagaagaaggcggcggtgccgctggtgtgccacggccactcgcggccggtcgtggaccttttctacagccccgtcacgcccgacggctacttcctcatcagcgccagcaaggattcaaatccaatgcttcgcaatggtgagactggagattggattgggacatttcaaggccacaaaggtgctgtttggagcgcttgtcttgacaccaatgctctgcgtgctgcctctggttccgctgacttctcagcaaaaatatgggatgcgctgacaggcgatgtgctgcactccttcgaacgcaagcacattgtccgtgcatgtgctttttctgaggatacccacatgttgcttactggaggtttcgagaagattttgcggatatataatttgaaccgtccggatgcagctccaagagaaattgagaaatcacctggttctgtcagaactgtcacttggcttcatagtgaccaaactatactaagttcctgcacagatatgggtggtgtgagattatgggatgtaaggagtggaaaaattgtccaaacacttgaaaccaagtcacctgtgaccagtgcggaagtaagccaagatggtcggtttatcacaacaactgatggctcaagtgtgaagttttgggatgcaaatcactatggacttgttaagagctacaatatgccatgtgcagtggagtcagcttctcttgaaccaaagtatgggaacaaatttgtcactggtggagaagacatgtgggttcgtgtcttcgatttcttcactggagaagaattagcatgtaacaaggggcaccatggcccagtccactgcgtccgattctccccagttggcgaatcttatgcatcagggtcggaagatggcaccatccgaatctggcagctgggcccagctaccagcgaagagcaggaggctgcaaacgcaaacgggaagacgaaggttgaggtaaatgatgccgcgcgcaagattgagggcttccacattcccagggacaggcaggcagaggggtcgtgaatttgtgatgctgatgcaccacttcacgctgggagactgctgttgtcaaatgctctgcgggtggtctgttgtaatacgggggggtttcatgtagcaacactgggatgaaatggtgaaattttgtaggggggcggtatcctaactctcagtggcatcgagttcgaaaaaaaaaaatcccagttgcatgcagtacacagtcgggacagtttttctctcctctctcactgaaagagtagcaagttgaaatgc

SEQ ID NO: 23676 - protein, 341 aa, Panicum virgatum
  misc_feature: Ceres CLONE 1829474
  misc_feature (260)..(298): Pfam Name: WD40 Pfam Description: WD domain, G-beta repeat
  misc_feature (51)..(89): Pfam Name: WD40 Pfam Description: WD domain, G-beta repeat
  misc_feature: SWISSPROT Homolog: EC 2.7.11.7 [Myosin heavy-chain] kinase
MDKKKAAVPLVCHGHSRPVVDLFYSPVTPDGYFLISASKDSNPMLRNGETGDWIGTFQGHKGAVWSACLDTNALRAASGSADFSAKIWDALTGDVLHSFERKHIVRACAFSEDTHMLLTGGFEKILRIYNLNRPDAAPREIEKSPGSVRTVTWLHSDQTILSSCTDMGGVRLWDVRSGKIVQTLETKSPVTSAEVSQDGRFITTTDGSSVKFWDANHYGLVKSYNMPCAVESASLEPKYGNKFVTGGEDMWVRVFDFFTGEELACNKGHHGPVHCVRFSPVGESYASGSEDGTIRIWQLGPATSEEQEAANANGKTKVEVNDAARKIEGFHIPRDRQAEGS

SEQ ID NO: 23677 - DNA, 697 bp, Panicum virgatum
  misc_feature: Ceres CLONE 1829510
  misc_feature: Encodes the peptide sequence at SEQ ID NO. 23678
aagaaaagtagcagcagcaacccgcggcggcgacgagtaaccaaccgggccacgccattgccagtcgcccggccgcctacgagccctgcctcgcgcccttgcccggccaccgcgccttccttctccctcccgctgcgggttctctcgcgcagcccgaatccgcggggtggtttctgtttctttgaccgcttcttctgagttctttctcggcggcgcgccatggaggagacggggaagagggtggtgaggaccgtgcgggtgcggaacatatcagatctggcgacagagcgggaggtgcgcgagttcttctccttttccggtgaaatcgaacacgtcgacatcagattggacggtacgcggaggacggcctacgtgacattcaaagatcccaaagccctcgagattgcccttctcctatcgggagcaacaattgtggatcaagttgtgaacatagccccagctgaagattacatctacatcccagttactgaacagcaacttttggtcaatgaggtgacaagtacaagttcagctcctaatgcagaattggagtactcctctccagaggccaatgccagccccaatagccatatctatgtgagcaaggctcatgatgtcatgacaaatgtgattgcaaagggttcagcaatgagacaagatgctgtgaacaaggctaaagcatttgatgagaaacatc

SEQ ID NO: 23678 - protein, 159 aa, Panicum virgatum
  misc_feature: Ceres CLONE 1829510
  misc_feature (12)..(78): Pfam Name: RRM_1 Pfam Description: RNA recognition motif. (a.k.a. RRM, RBD, or RNP domain)
  misc_feature: Useful for making plants with modulated biomass
MEETGKRVVRTVRVRNISDLATEREVREFFSFSGEIEHVDIRLDGTRRTAYVTFKDPKALEIALLLSGATIVDQVVNIAPAEDYIYIPVTEQQLLVNEVTSTSSAPNAELEYSSPEANASPNSHIYVSKAHDVMTNVIAKGSAMRQDAVNKAKAFDEKH

SEQ ID NO: 23679 - DNA, 689 bp, Panicum virgatum
  misc_feature: Ceres CLONE 1829511
  misc_feature: Encodes the peptide sequence at SEQ ID NO. 23680
aatgcgaccgcatctcctccgacgtctcctcctcctcgccgccgccgcgctaccgtcgccggccgattgccgccagggcggccaccacgcggcccctccgccgccgaagcaccacgacaagagcggcgcgctcaccgtcgcgctcgccgtcgccgcatcgctccttgcgctggtcctgctctacctctgcgcggccatcgccgtccgccgcttccgctcccgcggcgcggtggggcgggagccggcctcctcctcctcctctgcggcgtcccgcgccgcggcgtttcttcgccggaacgggctccagcaccaccgcccggccttcacctacgagcagctccgcgccgccaccgcgggcttcgacgcgggccgcaagctcggcgacggcgggttcgggacggtgttcctcgcgcacctcccgcccgccggccgacccgccgccgtcaagcgcctccacgtcccgccgtccccgtcgccgtcgttcccttccgccgccgccaccatcaccaagtccttctgcaacgaggtgctcatcctctccgcgctccgccacccgcacctcgtccgcctccacggcttctgcgccgacccccgcgcgctcctcctcgtctacgacttcgtccccaacggcacactctcgcaccacctccaccgccgggtcggcggcggcggcggcgcccctccgcccc

SEQ ID NO: 23680 - protein, 229 aa, Panicum virgatum
  misc_feature: Ceres CLONE 1829511
  misc_feature: SWISSPROT Homolog: EC 2.7.11.1 Non-specific serine/threonine protein kinase
MRPHLLRRLLLLAAAALPSPADCRQGGHHAAPPPPKHHDKSGALTVALAVAASLLALVLLYLCAAIAVRRFRSRGAVGREPASSSSSAASRAAAFLRRNGLQHHRPAFTYEQLRAATAGFDAGRKLGDGGFGTVFLAHLPPAGRPAAVKRLHVPPSPSPSFPSAAATITKSFCNEVLILSALRHPHLVRLHGFCADPRALLLVYDFVPNGTLSHHLHRRVGGGGGAPPP

SEQ ID NO: 23681 - DNA, 685 bp, Panicum virgatum
  misc_feature: Ceres CLONE 1829522
  misc_feature: Encodes the peptide sequence at SEQ ID NO. 23682
acgctgcgagacagccgagcagagcacggagcgaagcgcggcgcggcgcggcgcagtgcagtgcagcgcgacccctcctcggaacagccgcgcgcgcgtgcgtgcttgcttgcccccaccccatccccctcgtctctccagccatggcggcccgccgcgggtgcctccccctggtggccgtgctgctcgcgctgctctgccgcgccgaggcggcggtgagggagctcaaggtcgggtactacgccgagacgtgcccggaggccgaggggatcgtccgggaggtcatggcgcgggcgcgcgcccgcgaggcccgcagcgtcgcctccgtcatgcgcctccagttccacgactgcttcgtcaacgggtgcgacgggtcggtgctgatggacgccacgcccacgatgctcggcgagaaggacgcgctgtccaacatcaactccctgcgctcgttcgaggtcgtcgacgagatcaaggaggcgctggaggagcgctgccctggcgtcgtctcctgcgccgacatcgtcgtcatggccgcccgcgacgccgtcgtcctgaccggtgggcccaattgggaggtgcggctcgggcgcgaggacagcctgacggcgagccaggaggactcggacagcatcatgccgagcccgcgcgccaacgccagcgcgctcatccgcctctttgccgggct

SEQ ID NO: 23682 - protein, 180 aa, Panicum virgatum
  misc_feature: Ceres CLONE 1829522
  misc_feature (44)..(180): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
MAARRGCLPLVAVLLALLCRAEAAVRELKVGYYAETCPEAEGIVREVMARARAREARSVASVMRLQFHDCFVNGCDGSVLMDATPTMLGEKDALSNINSLRSFEVVDEIKEALEERCPGVVSCADIVVMAARDAVVLTGGPNWEVRLGREDSLTASQEDSDSIMPSPRANASALIRLFAG

SEQ ID NO: 23683 - DNA, 710 bp, Panicum virgatum
  misc_feature: Ceres CLONE 1829538
  misc_feature: Encodes the peptide sequence at SEQ ID NO. 23684
atcactcgctcgcgccgccgccgccgcccccacctctaccctcgcagccccaacctcctcggcgaccatggccggcgcgcaggagtcgctctcccttgtgggcacgatgcgcggccacaacggggaggtgacggcgatcgcgaccccgatcgacaactcgccgttcatcgtctcgtcctcccgcgataagtccgtgctggtgtgggacctgaccaacccggtccactccaccccggattccggcgccgccgctgactacggcgtccccttccgccgcctcaccggccactcccacttcgtccaggacgtcgtcctcagctccgacggccagttcgcgctgtccggctcctgggacggcgagctccgcctctgggatctctccaccggtctcaccacccgccagatcgtctccgcttcccgcgacaagaccatcaagctctggaacaccctcggtgagtgcaagtacaccattggcggcgaccacggcggcggcgagggccacagcggttgggtctcctgcgtcaggttctcccccaacaccttccagcccactattgtctccggttcctgggaccgcactgtcaaggtctggaaccttaccaactgcaagctacgctgcacgctcgccggccacggcggctatgtcaacgccgtcgccgtgagccccgacggttcgctgtgcgcctccggcgggaaagacggctttactc

SEQ ID NO: 23684 - protein, 214 aa, Panicum virgatum
  misc_feature: Ceres CLONE 1829538
  misc_feature (136)..(176): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
MAGAQESLSLVGTMRGHNGEVTAIATPIDNSPFIVSSSRDKSVLVWDLTNPVHSTPDSGAAADYGVPFRRLTGHSHFVQDVVLSSDGQFALSGSWDGELRLWDLSTGLTTRQIVSASRDKTIKLWNTLGECKYTIGGDHGGGEGHSGWVSCVRFSPNTFQPTIVSGSWDRTVKVWNLTNCKLRCTLAGHGGYVNAVAVSPDGSLCASGGKDGFT

SEQ ID NO: 23685 - DNA, 1291 bp, Panicum virgatum
  misc_feature: Ceres CLONE 1829561
  misc_feature: Encodes the peptide sequence at SEQ ID NO. 23686
actctccgccctctcaattctcctcgtctgtcgtctcctctcccgcacacgatcagcagcaggagctggaacaaattcctcagctgtcttggcccgaacccagttcttcgcatccggtgcctttctccatcccgcaaggacctccaaaagccacagcctattaagctcgagcttgctagtgcggcgctgctattctcggtgcgccgtttggtgggaagtttatattcttggttggttgctcgaatcgggtgcgcacgaatcgctcgaattcgcgccttttgtggattgcttccgtgagagctcggcactgcgtcgagttcttggaagaggcttcggcttcggctccctgtggctgtgggctccgggcgcgcgccagtccaataaaggcgcgctcttttgctcggtagtcgcgactggaggcggcgacagcaagcatgggcgcgggcgcgtcggacctggcggggatggagcccggcggcaaggtcgcgcgcgccgggctgggcgacctgccggagctgtgcgccgcggaggtgctgctctacctcgacgcgccggacatatgccggctcgcgcggctgaaccgtgcgttccgcggcgcggcggcggcggacttcgtgtgggatgcaaagctgccggagaactacggccatctcctacgtttcgtcgatgaagcgaaggaggtggggagtagagggagtaggagcgagatggggaagaaggacatctttgcaaggctcgccaagcctgtgccgttcgacggtggcagaagggaattctggttggagaagagcaaaggtgggatctgcatggccttgtcgtcgaaagccttggtgataacaggaatcgatgacagaagatattgggttaacatgccaaccactgaatctaggttccagtcatttgcatatctccagcaaatctggtggtttgaggtagttggagaagtggatttcagcttcccagcatggacctacagcctgtacttcaggcttcatcttggcaagtcttcaacgcgttttggccgccgtgtttgctgctcagagcaaatccatggctgggacaagaagcctgtacggttccagctatctacatcagatggtcagcacgccgtgtcccagtgctacttagacgaggctggaagctggatcttgtaccacgttggtgacttcgttgcatcaagctctgaacaggcgacgaaactgaagttctcgctagcccaaatcgactgcactcatacaaaaggtggtctgtgcgtggattcagttgtaatatatccaaagggctttgagcc

SEQ ID NO: 23686 - protein, 285 aa, Panicum virgatum
  misc_feature: Ceres CLONE 1829561
  misc_feature (20)..(67): Pfam Name: F-box Pfam Description: F-box domain
MGAGASDLAGMEPGGKVARAGLGDLPELCAAEVLLYLDAPDICRLARLNRAFRGAAAADFVWDAKLPENYGHLLRFVDEAKEVGSRGSRSEMGKKDIFARLAKPVPFDGGRREFWLEKSKGGICMALSSKALVITGIDDRRYWVNMPTTESRFQSFAYLQQIWWFEVVGEVDFSFPAWTYSLYFRLHLGKSSTRFGRRVCCSEQIHGWDKKPVRFQLSTSDGQHAVSQCYLDEAGSWILYHVGDFVASSSEQATKLKFSLAQIDCTHTKGGLCVDSVVIYPKGFE

SEQ ID NO: 23687 - DNA, 619 bp, Panicum virgatum
  misc_feature: Ceres CLONE 1829572
  misc_feature: Encodes the peptide sequence at SEQ ID NO. 23688
atttttttcgtcgaaattggccgtgagatccgaccggttctggctcggatccggcgccctccgtcggggtaaggttccccctccctccgaccagatggcgtgggaagggagccaaggcctccgcggccacctcggcggacaaggacaaggggaagaaggccggcggctccgtctcacgctcctcccgtgccgcacctcctgacaaatctgctccgaagaaagatgtttatcccttgtttgctgagaaggctagggataaccaacagctggaatccagatgggcaatcatgcaagaaactcgagtggagtattttcgtgcaaaatatttcactaccttcataaaacataatccacaactcatacaatttttacggccggaacatgatttacaagtggaggacattgttaaccctttgctgacccagaaccttgttataagatgtgaccgagatatgaacactgtcaggcctggcaagaaaaaactatcatcctgccctgctcatttgtagatacataatgaacgagtgtttactgcaaatgatggtttctttgcttggatgtctctcaatgggcggacctagtggcagactattctctcatttgtttggcctcattttgc

SEQ ID NO: 23688 - protein, 73 aa, Panicum virgatum
  misc_feature: Ceres CLONE 1829572
  misc_feature: Useful for making plants with modulated drought sensitivity
  misc_feature: Useful for making plants with modulated water use efficiency
MQETRVEYFRAKYFTTFIKHNPQLIQFLRPEHDLQVEDIVNPLLTQNLVIRCDRDMNTVRPGKKKLSSCPAHL

SEQ ID NO: 23689 - DNA, 1784 bp, Panicum virgatum
  misc_feature: Ceres CLONE 1829969
  misc_feature: Encodes the peptide sequence at SEQ ID NO. 23690
aaaggagaagagtcttgcttctctcgccgcgtcgccaagcaagactgagcgagggaacccactcactcaacccaccagctcgcactcgctcgctcactagcgcccctttccccttccttccttccacactctagtgactcctctccagctccatccgcccgtgccgctccacggcgccgccccgccatggcggtgagcaacaacatcacggcgtgcgtcaccttcctggtcctgctctgcacggtccccatcgccgccacgggcgtctggctcgcctcccgccacggcggcgccgggtgcgcgcgcctcgcccgctggcccgtcgccggcctcggcgcgctcctcctcctcgtcgcgctcgcgggcttcctcggtgcctaccgcaaccgcaggggcctcctcgcctgctacctcttcgccatggccgcgctcatcacgctcctcctcgcgctcctcgtcgccgccttcgccgtcgcgcacggctccggggcgtacccggtgcccggccgcgcctacctggactaccgcctcgaggggtactccccgtggctgcggaggtacgtcgccggcaacccggaccggtgggaggggatccgggcgtgcgtcgccgggtcgggcacctgctcgaagctcgccatggacagatccttcatcgtgccggagcagttctacatgacgcacctctcgctcatcgaggtaactaagtaactagtaactgttgctcctactctataattttcttccaatagctagcgatttcatcatcagttaatctaatcacagtgcttgattaagtggtagaactctagtagtacactatacagtgcctggctaagtggtaacactctagtgcgtacaacttagcagagttttattagtaacttgtatgattacaatttaagatgaacaaaagttactggagtccagtgtaatgtggctggtacttttcatttctactttctacagtagttggtctgaagttgcactgccagctgatagtacactggcaatgggaatcaaggaacaatcttgtagggtctgaagaaagaaagcagtgttaaattattgcagagtgcagacactagttggggattcagatgattgcccccactcggcgagtgatctgtcgatgtgtttgttcatcatgcctaggtgtgtgtgagagagcagaggcatgtgccatgtgggccggcgcttggacccaagaaattgttggccatccactgattttcttctctgcagttctgtcccgtacacgaaacgaagcttctgaaatctcgttctgaataagacttgagtacctgactgacccgggcgctggcggtgcagtcctggtgctgcaagccgccgacggcgtgcgggttcgcgtacgtgtcgccgacggcgtggtcgggcccggcggcgggcgcggcggcggacgcggactgcgcggcgtggagcaacgacccggccgagctctgctacggctgcgcctcctgcaaggccggcgtgctgggggcgctccgggagcagtggcgccgggctagcgtggcgctgctcgccgccaccgtcgcgctgctcgccgccaccgtcgcgctcatcttcgtctacgtcgtcggctgctgcgccttccgcaacgcgcagacggaggacatgttccgccgctacaagtggggcaacaacaactactgacctccgcaatgcgctgcacgcttgtctctcgccggtgtaagcaagcagggaggtgagttctgtgtgtagtaatgtcttgagaagcttgtggttaagatgatggttttggtgcc

SEQ ID NO: 23690 - protein, 173 aa, Panicum virgatum
  misc_feature: Ceres CLONE 1829969
  misc_feature (3)..(170): Pfam Name: Tetraspannin Pfam Description: Tetraspanin family
MAVSNNITACVTFLVLLCTVPIAATGVWLASRHGGAGCARLARWPVAGLGALLLLVALAGFLGAYRNRRGLLACYLFAMAALITLLLALLVAAFAVAHGSGAYPVPGRAYLDYRLEGYSPWLRRYVAGNPDRWEGIRACVAGSGTCSKLAMDRSFIVPEQFYMTHLSLIEVTK

SEQ ID NO: 23691 - DNA, 635 bp, Panicum virgatum
  misc_feature: Ceres CLONE 1829970
  misc_feature: Encodes the peptide sequence at SEQ ID NO. 23692
accataccatatccatcttcaattctccatccatcaagtgaagttcagcgcaatccccccgatgccgagcatggcggcgccattgctctgcctggcgctgctcctggcgtccggcgccgccgccggcgcccaagctctcaaagactacccacaggtaaagttcagcaccgcgtcggcgacgccggagaagtacaacaccttcatcgccgctgtccgcgccgcgctggtgagcaaagctggggggaagagcaacaggatccccgtgctgctcgaccgggacgacccgctcgcgcttcaaacctacctgaacatcactctgacgaactcggcggggcattcgatcagcctgaagatggatgtcaccggagcttacttcaccgcctacgtggcggggaagtactcgtgcccgcgtcgtggtggacgcgtgcccgccgcgcgtccctgcggcgcgcgccgtctgggaggcgcgcgccgacggcacggtggcgctgcgggcgagcgggctggtcctgtcggtgacctcgtcgtcggcgttcgccggcgtcacggtgcggcgcgacgaccgcggcacgggccagtcgtggacgcccaccaacgagaccgcgtcgctgaccgcccccgtcgtcgggttcggc

SEQ ID NO: 23692 - protein, 92 aa, Panicum virgatum
  misc_feature: Ceres CLONE 1829970
  misc_feature: SWISSPROT Homolog: EC 3.2.2.22 rRNA N-glycosylase
MSPELTSPPTWRGSTRARVVVDACPPRVPAARAVWEARADGTVALRASGLVLSVTSSSAFAGVTVRRDDRGTGQSWTPTNETASLTAPVVGF

SEQ ID NO: 23693 - DNA, 700 bp, Panicum virgatum
  misc_feature: Ceres CLONE 1829974
  misc_feature: Encodes the peptide sequence at SEQ ID NO. 23694
gagtccagccactccctagtcagcaaccggcagccgcaaccatgggggcggaggaggcggagcagcccaacggcctcgtcgtggtgccggagccgcgcccgcgcaaggacctggcctcctgggcgctcgacctgctcgagtccgtcgccgtgcgactcggccacgacaaggccaagccgatccactggctatcaggcaactttggccccgtcgtcgacgagactccgccggcccctgacctccccgtccgcggacacctcccggagtgcttgaatggagagtttgtcagggtcgggcctaatcccaagtttgtcccagtcgcagggtatcactgaatgattcatgccatgcgtattaaggatggaaaagctacctatgtatcaagatatgtgaagacggctcgcctcaagcaggaagagtattttggcggagcgaagtttatgaagattggagatctaaagggattctttggattgttcatggttcaaatgcaacaacttcgtaaaaaattcaaagtcttggattttacctatggatttgggacagctaatactgcacttatatatcatcatggtaaactcatggccttgtcagaagcagataagccctatgtagttaaggtccttgaagatggagacttgcagactcttggtttgttggattatgacaaaaggctgaaacattctttcactgcccatcc

SEQ ID NO: 23694 - protein, 121 aa, Panicum virgatum
  misc_feature: Ceres CLONE 1829974
  misc_feature: SWISSPROT Homolog: EC 1.13.11.51 9-cis-epoxycarotenoid dioxygenase
MIHAMRIKDGKATYVSRYVKTARLKQEEYFGGAKFMKIGDLKGFFGLFMVQMQQLRKKFKVLDFTYGFGTANTALIYHHGKLMALSEADKPYVVKVLEDGDLQTLGLLDYDKRLKHSFTAH

SEQ ID NO: 23695 - DNA, 689 bp, Panicum virgatum
  misc_feature: Ceres CLONE 1829987
  misc_feature: Encodes the peptide sequence at SEQ ID NO. 23696
cctcgctttgcatcgcagctcgcaaactccatcatcgcaaggcaagcgaacccggaaccgtcgtcgagaagagagacaaggtggagtaggccatgtccaacgtgcccacctccctccgcgactcctccctcaccgtcttccgcctcgccatctccagctccgacccctggcccttctcttcctgcctctagccaccagccgcctccctctccctcctcctcctcctcctcctcctcttctagagcagcagccagcagccgggcggcggccgctcctccgttctcggggcggggctcgaccgatcgatctggcctgcctggcggccatcatcatgcacggcaagcaccaacaccagcagcagcagatggcgccggcggtggtggcgcccaaggggtgcgtgacggtgcgggtgggcgcggacggggaggagcagcgccgcttcgccgtcccgctgggccacctcaagcacccgctcttcggcgcgctgctcgaggaggccgagcgcgagtacggcttccgccaccagggcgccatctccatcccctgccgcgtcgaccgcttcgtccaggtcgagcacctcatcggccaggacctccacggcaccgccagcagctgcgcgcagcacctcgtcgacctcgacagcgccgccgccccgcaccaccaccaccagctgcacctgccgcgcttcg

SEQ ID NO: 23696 - protein, 119 aa, Panicum virgatum
  misc_feature: Ceres CLONE 1829987
  misc_feature (1)..(85): Pfam Name: Auxin_inducible Pfam Description: Auxin responsive protein
MHGKHQHQQQQMAPAVVAPKGCVTVRVGADGEEQRRFAVPLGHLKHPLFGALLEEAEREYGFRHQGAISIPCRVDRFVQVEHLIGQDLHGTASSCAQHLVDLDSAAAPHHHHQLHLPRF

SEQ ID NO: 23697 - DNA, 670 bp, Panicum virgatum
  misc_feature: Ceres CLONE 1829993
  misc_feature: Encodes the peptide sequence at SEQ ID NO. 23698
cgatcgctctccccacaccaccacctcctcctccacagcaggctagccaggctttttctggggtttgcgaggggggcgctccggtccggcgagaggggggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcaccgtcggcgccgacagcgacggccgcgccaaggccatcgacgtctccgcgcccggcggcggcacgctcgccggcggggaacgcccggacagcggctacggcgggcgcggcggcggcggctacggcgggggaggcgaccgcggctacggaggcggcggcggcgaccgcggttacggcggaggcggctacggcggaggcggctacggcggaggcggctacggcggaggcggcgaccgcggctacggcggaggcggcgaccgcgggtacgggggaggcggcgaccgcgggtacgggagaggcggcggctacggcggcgggggcgaccgtggctacggcggcagcgggggaggcggccgcggctgctacaagtgcggcgaggagggccacatcgcacgcgactgctccc

SEQ ID NO: 23698 - protein, 189 aa, Panicum virgatum
  misc_feature: Ceres CLONE 1829993
  misc_feature (5)..(72): Pfam Name: CSD Pfam Description: 'Cold-shock' DNA-binding domain
  misc_feature (173)..(189): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGSKGFGFISPDDGSQDLFVHHSSVKADGFPNLKDGEAVEFTVGADSDGRAKAIDVSAPGGGTLAGGERPDSGYGGRGGGGYGGGGDRGYGGGGGDRGYGGGGYGGGGYGGGGYGGGGDRGYGGGGDRGYGGGGDRGYGRGGGYGGGGDRGYGGSGGGGRGCYKCGEEGHIARDCS

SEQ ID NO: 23699 - DNA, 1849 bp, Panicum virgatum
  misc_feature: Ceres CLONE 1829998
  misc_feature: Encodes the peptide sequence at SEQ ID NO. 23700
aggtaacaggacacacacatcaaagctagctagctgcctctctgcggatcgagcagcaggagctcagtggtcagtggcgcagcaccgctcatcccaggccggccgagcacgcagtcacgcacacacggcgatggccggcggcgtcggcgtcggcggccgggagccccggcgccgccgcgcgctggtgttcccgctgccgttccagggccacatcgacccgatgatgcacctggccggcgcgctccacgcgcgggggctcgccgtcaccgtcctccacacgcgcttcaacgcgctgcgcccggggcgccacccggagttccgcttcgtcgaggtccccgacggcgtgcccgccaacgtcgccgccgcgggccggatcatcgacgtcatcctcgccatgaacgccgccatggaggcgtcgccggcgcccgtgctggccgccctggtgtccgcgatggaggcagaggaccaggaggcggcggagggggagggggagacccgcgccgccgcgtgcctcttcatcgacggcaacctcctcgccgtgcagcgggtcgccgccgcgctcgggctgcccacgctggtcctgcgcaccggcagcgccacgtgcttgcggtgcttcctcgcctaccccatgctccatgacaagggataccttcctccccaaggtccgtcagtccatcgcaccaagatttaattttgtaacacaatttgagtttcaaattcttctagagaattttaaaatttaaattctgaactgaactctgtgttccggcctgcacgtgctccagagtcgaacctggacacgccggtgccggagctgccgccgctgcgggtgagggacctctttttctcgccggtgagcagccacgacaaggtccgcgaggtcctcgcccggatcaccgagaccgtacgcaactcctcgggcgtcgtcatcaacacgtgcgaggctctggaggccgccgagatggagcggcttcgcggcgagctcgccggcctcccgttgctgctcgccgccgggcccctccacaagctctcctcccggagcgccgggggcagcctgctggacccggaccgcagctgcatcgcgtggctcgacgcccgcgcccccgggtcggtgctgtacgtgagcttcgggagcctggcggccatgggcgccggcgagttccaggaggtggcctggggcctggccggcagcggccacccattcctgtgggtcgtccgccccaagctcgtccggggctgcgacggcgtgcggctacccgacggattcgaggacgccgtcgagggcagaggcatggtgatccggtgggcgccgcagcaggaggtgctggcgcacccggcggtgggcgggttctggacccacgccgggtggaactcgacgctggagggctccggcgagggggtgccgatgatctgccggcccgacgccgtggaccagatgatgaacgcgcggtacgtgcaggaggtctggggcgtggggttcgagctggaaggcgagctggagagggggagggtcggggacgcggtcaggaggttgatggagggggccgagatgagggagagggccaagttgcttaggaggaaaatagcagactgctgcttggagagctctgggtcttctcagattgccatggacaagttggtcagctacatactgtctctgtgagatgaatgtgaaaccttctgctctgcatgcatggatgtgctgggttgaacgttcttggaggagattaatggctgatattctgaggcctgttgctgcatgcattcagtcgtcgatgaacgattcatgtgtaattctgatgctctctcttgatttctttggtgtagtagaagtttgtccccttgatat

SEQ ID NO: 23700 - protein, 233 aa, Panicum virgatum
  misc_feature: Ceres CLONE 1829998
  misc_feature: SWISSPROT Homolog: EC 2.4.1.115 Anthocyanidin 3-O-glucosyltransferase
MERLRGELAGLPLLLAAGPLHKLSSRSAGGSLLDPDRSCIAWLDARAPGSVLYVSFGSLAAMGAGEFQEVAWGLAGSGHPFLWVVRPKLVRGCDGVRLPDGFEDAVEGRGMVIRWAPQQEVLAHPAVGGFWTHAGWNSTLEGSGEGVPMICRPDAVDQMMNARYVQEVWGVGFELEGELERGRVGDAVRRLMEGAEMRERAKLLRRKIADCCLESSGSSQIAMDKLVSYILSL

SEQ ID NO: 23701 - DNA, 280 bp, Panicum virgatum
  misc_feature: Ceres CLONE 1830000
  misc_feature: Encodes the peptide sequence at SEQ ID NO. 23702
gagggcacccatagaacttgccactgcccgcccctccaccaccgaggcagagcgagagctatcggccatggcgagcgtgccggatgaggtccccctctgcttccccggtctggtgggggacctgagggaggtctacgacagccgcaggacccggggcctggagtggcgtccctcccacctccggggcctcgtccggctgcccccggacaaagaggagaacatcttcgacgccctccgcgaggacctcgcccagcaccgcgcccagtccttcccagaccac

SEQ ID NO: 23702 - protein, 70 aa, Panicum virgatum
  misc_feature: Ceres CLONE 1830000
  misc_feature: SWISSPROT Homolog: EC 1.2.1.3 Aldehyde dehydrogenase (NAD(+))
MASVPDEVPLCFPGLVGDLREVYDSRRTRGLEWRPSHLRGLVRLPPDKEENIFDALREDLAQHRAQSFPD

SEQ ID NO: 23703 - DNA, 643 bp, Panicum virgatum
  misc_feature: Ceres CLONE 1830003
  misc_feature: Encodes the peptide sequence at SEQ ID NO. 23704
accccgcctccaccgaccccgcctgctgcgctcccggctcaccgccccgcctcaccgacggagagagaagccgccgcgccgcccgtccgcccgtcgcagccgcgaccggagagccaatccgcgtaccacgccgaccgagcacccgccatgtcggaggagccggcgcggagctccatggagtcctcctccggggcgtcctcggggcccgacttcgtgctcaggctccggcccccgggctccgaccccgaccgcaagagcgccgcctccacctccgaccccgccgcccgcgaccgcagccgctccccgcgcggccccgacgccgccccgccgccgccctcccacttgccgcgggtggtggggtggcctccggttcggcgccggccgaacaaggtcaagttcgtcgaggtggccgtggccggcgcgccgtaccagcgcaaggtggacctcgaggcgtacgcgggctacgaccagctgctcgccgcgctccaggacaagttcaccgcccacttcaccgtccgccggggggcgaacgaggagatggagctcgtcgacgtcgtgagcggcgtcgagtacgtgccgacttacgaggacaaggacggcgactggatgctcgtcggagacgtcccctggagaatgtttgtgg

SEQ ID NO: 23704 - protein, 165 aa, Panicum virgatum
  misc_feature: Ceres CLONE 1830003
  misc_feature (24)..(165): Pfam Name: AUX_IAA Pfam Description: AUX/IAA family
  misc_feature: The sequence is a functional homolog of SEQ ID NO 738 in the 10/374,780 US patent application
  misc_feature: The sequence is a functional homolog of SEQ ID NO 736 in the 10/374,780 US patent application
MSEEPARSSMESSSGASSGPDFVLRLRPPGSDPDRKSAASTSDPAARDRSRSPRGPDAAPPPPSHLPRVVGWPPVRRRPNKVKFVEVAVAGAPYQRKVDLEAYAGYDQLLAALQDKFTAHFTVRRGANEEMELVDVVSGVEYVPTYEDKDGDWMLVGDVPWRMFV

SEQ ID NO: 23705 - DNA, 675 bp, Panicum virgatum
  misc_feature: Ceres CLONE 1830007
  misc_feature: Encodes the peptide sequence at SEQ ID NO. 23706
aggctaagtgtccatccacaacatacatcttgcaaacaacatactaacaatctcgtctctgtagcatttgaagaactccaacgaaaatgaactcggtggtgaagatcggcccctttggcagcacctccgaggctgagggcaatcgcgacatcaccgtagcgccgctgcgcctggagagcatcaccatccgccatgggaatgtgctcgacgccctctccttcacctacaaggactgccacgggctgcagcacaccacaggccaatggggcggcgacggcggcaactccaccacaattaccattggccctgacgagttcgtgacgggagttcacgggctctacggcttctacggttacgggagcgacggcgtcaccggcttcaccatcgtcaccaacctccggacctacgggccgttcggagtcagtgactccatcaaggaacccaagtccttcgacatccccgtcatgaacaacggcagcatcgtcggcttcttcgcccaccgcaacaaggcctacgtcacggccatcggtgtctacgtcaagcccttctgatgattgtcatcgggtttcttggtttgggccacaaaaccaaggtggcggatggcggttgaagtcgccaagtcgtggaggcacgagtatcggtctcgggactggcggaggaacgggcatcgacggc

SEQ ID NO: 23706 - protein, 154 aa, Panicum virgatum
  misc_feature: Ceres CLONE 1830007
  misc_feature (18)..(153): Pfam Name: Jacalin Pfam Description: Jacalin-like lectin domain
MNSVVKIGPFGSTSEAEGNRDITVAPLRLESITIRHGNVLDALSFTYKDCHGLQHTTGQWGGDGGNSTTITIGPDEFVTGVHGLYGFYGYGSDGVTGFTIVTNLRTYGPFGVSDSIKEPKSFDIPVMNNGSIVGFFAHRNKAYVTAIGVYVKPF

SEQ ID NO: 23707 - DNA, 685 bp, Panicum virgatum
  misc_feature: Ceres CLONE 1830026
  misc_feature: Encodes the peptide sequence at SEQ ID NO. 23708
gtcccgctcaccagccaccaccaccagaagaggggggaggcgcctgctactccgcggcgagcggcggcggccggagaggtgggggagagatgtcggggtggctgaaggtgctggcgtacggagcggggggcgtggcggtggtcggcctggcggcgctggtggcgctgcaggagcgcctcgtctacgtgcccgtgctcccgggcctggcgcgcgcgtaccccatcacgcccgcgcgcctccgcctctcctacgaggacgtctggctccgcgccgccgacggcgtgcggctccactcctggttcatccgccactcccctacctgccgaggtccaaccatcctgttcttccaagaaaatgctggcaacattgctcatcgtttggaatttgttcgactcatgatgcagaggctacagtgcaatgtctttatgctttcttatagagggtatggtgagagtgatggctatccttctcagaaagggatcacatatgatgcacaggctgcacttgatcatctagctcagagaaaggacattgatacatccaggatagttatctttggaagatctttaggaggcgctgtgggtgcagttcttgcgaaaaacaatcctgaaaaggtggctgctctaatactagaaaacacatttacatctatactggatatggctggcatcatgcttcccttctt

SEQ ID NO: 23708 - protein, 198 aa, Panicum virgatum
  misc_feature: Ceres CLONE 1830026
  misc_feature: SWISSPROT Homolog: EC 3.1.1.23 Acylglycerol lipase
MSGWLKVLAYGAGGVAVVGLAALVALQERLVYVPVLPGLARAYPITPARLRLSYEDVWLRAADGVRLHSWFIRHSPTCRGPTILFFQENAGNIAHRLEFVRLMMQRLQCNVFMLSYRGYGESDGYPSQKGITYDAQAALDHLAQRKDIDTSRIVIFGRSLGGAVGAVLAKNNPEKVAALILENTFTSILDMAGIMLPF

SEQ ID NO: 23709 - DNA, 683 bp, Panicum virgatum
  misc_feature: Ceres CLONE 1830034
  misc_feature: Encodes the peptide sequence at SEQ ID NO. 23710
acgcggccggcgagctggacgagcaagggcgcgagttcaagggcatcatcaacgacgggatcaagatcggcgggtccctctccatcgccaagtacatcccgtggctgagttggctggccccggccgacgaccaggtcttcaaagcccacggcgaccggcgcgaccgcctcaccgtgaggatcatggacgagcaggccagggccctcaagcagcgcggcggcgcccagcagcacttcatcgacgcgctcttcaccctcagggagcagtacgacctcagcgacgacaccgtcatcggcctcctttgggacatgatcgccgccggcacggacacgacggtgatctcggtggagtgggcgatggcggagctggtgcggaacccccgggtgcaggagaaggtgcaggaggagctggaccgcgtcgtcggccgcgaccgggtcctgctggagacggacttccccaacctgccctacctgcaggcgctcgtcaaggagtcgctccggctgcacccgccgacgccgctcatgctcccgcacaaggccagcgccggcgtcaagatcgccggctacgatgtgcccaagggcgccaacatcatcgtcaacgtgtgggcgctggcgcgcgaccccgaggtctgggaggacccgctcgcgttccggccggagcgcttcctccgggagaacatcgac

SEQ ID NO: 23710 - protein, 226 aa, Panicum virgatum
  misc_feature: Ceres CLONE 1830034
  misc_feature (2)..(226): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered carbohydrate content
  misc_feature: Useful for making plants with altered lignin content
  misc_feature: The sequence is a functional homolog of SEQ ID NO 6 in US patent 7071376
  misc_feature: The sequence is a functional homolog of SEQ ID NO 4 in US patent 7071376
  misc_feature: Useful for making plants with altered cell wall content and/or composition
AAGELDEQGREFKGIINDGIKIGGSLSIAKYIPWLSWLAPADDQVFKAHGDRRDRLTVRIMDEQARALKQRGGAQQHFIDALFTLREQYDLSDDTVIGLLWDMIAAGTDTTVISVEWAMAELVRNPRVQEKVQEELDRVVGRDRVLLETDFPNLPYLQALVKESLRLHPPTPLMLPHKASAGVKIAGYDVPKGANIIVNVWALARDPEVWEDPLAFRPERFLRENI

SEQ ID NO: 23711 - DNA, 683 bp, Panicum virgatum
  misc_feature: Ceres CLONE 1830050
  misc_feature: Encodes the peptide sequence at SEQ ID NO. 23712
attcagaggcacaacgcacacaagcaaggcggctagctacagacgcggctagtggcgcgagtacacacagccacgcccagtgcgaagcttgctggtgcatgcggcaatggcggcttcgcttgggctaaaccctgaagctctcttcagctcccactcgtcgtcatactcctcgcccttcatgtccggctacgcgccgcagagattcccggcggccgataacaccgtcgtcgacgatcgcgacgagaagtcgatgtggtgtggggggcgagatgagaagagacccaggagcagtggaaggattgggttcagaacgagatcggaggtggagatcttggacgacggattcaaatggaggaagtacgggaagaaagctgtcaagaacagccctaatccaaggaactactaccggtgctcgtcggagggctgcggcgtgaagaagcgcgtggagagggaccgcgacgacccccgctacgtcatcaccacctacgacggcgtccacaaccacgccagccccggcgccgccgccatcatccagtacggcggaggcggcttctacagcccgcagcacagcggctcgccgtcggccgcctcctactcgggctcctacctcttctgatgagacttccgagccattcttcccagaacgtgcctcagcagtgagcacgtgttgttacattacaacg

SEQ ID NO: 23712 - protein, 169 aa, Panicum virgatum
  misc_feature: Ceres CLONE 1830050
  misc_feature (76)..(135): Pfam Name: WRKY Pfam Description: WRKY DNA -binding domain
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 148 in the 10/714,887 US patent application
  misc_feature: The sequence is a functional homolog of SEQ ID NO 148 in the 11/435,388 US patent application
  misc_feature: The sequence is a functional homolog of SEQ ID NO 210 in the 10/714,887 US patent application
  misc_feature: The sequence is a functional homolog of SEQ ID NO 210 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 194 in the 10/666,642 US patent application
  misc_feature: The sequence is a functional homolog of SEQ ID NO 6 in the 10/714,887 US patent application
  misc_feature: The sequence is a functional homolog of SEQ ID NO 6 in the 11/435,388 US patent application
  misc_feature: The sequence is a functional homolog of SEQ ID NO 806 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAASLGLNPEALFSSHSSSYSSPFMSGYAPQRFPAADNTVVDDRDEKSMWCGGRDEKRPRSSGRIGFRTRSEVEILDDGFKWRKYGKKAVKNSPNPRNYYRCSSEGCGVKKRVERDRDDPRYVITTYDGVHNHASPGAAAIIQYGGGGFYSPQHSGSPSAASYSGSYLF

SEQ ID NO: 23713 - DNA, 639 bp, Panicum virgatum
  misc_feature: Ceres CLONE 1830054
  misc_feature: Encodes the peptide sequence at SEQ ID NO. 23714
aactcggcggcggcctctcctctcttcctcgtccttccaccgcacgcaggccatcgagatgtcgtcggcggaggcgaaggcggcggtggtgccggagtcggtgctgcggaagagcaagcgcgaggagcagtgggcggcggaaaagaaggagaaggcgctcgcggacaggaagaaggcgctggagagccgcaagatcatcttcgcgcgcgccaagcagtacgcgcaggagtacgacgcgcaggagaaggaccttgtgcagctcaagcgtgaggcccggctgaagggtgggttctatgtgagccctgaggcaaagcttctgtttgtgatccgcatccgtggtatcaatgccatgcaccccaagacccgcaagatcttgcagctcctgcgtttgaggcagatctttaatggcgttttcctcaaggttaacaaggccaccattaacatgctgcgcagagtggagccatatgttgcatatgggtatccgaacctgaagagtgtaagggaattgatttacaagaggggttatggaaagctgaacaagcagaggattcctctgagcaacaacaatgtcattgaggcgggcctcgggagtcacaacatcatatgcatcgaggatcttgtccatgagatcatgaccgt

SEQ ID NO: 23714 - protein, 193 aa, Panicum virgatum
  misc_feature: Ceres CLONE 1830054
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSSAEAKAAVVPESVLRKSKREEQWAAEKKEKALADRKKALESRKIIFARAKQYAQEYDAQEKDLVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNNVIEAGLGSHNIICIEDLVHEIMT

SEQ ID NO: 23715 - DNA, 1244 bp, Panicum virgatum
  misc_feature: Ceres CLONE 1830061
  misc_feature: Encodes the peptide sequence at SEQ ID NO. 23716
gagtccactgccgtgtgtcactcctaccgccggctgctcttccctcggctctgcaggtgcaggctggccgccgtgcgtccgcccgccgagtccgaagccgatggaagccgccgccgccgtggcgcgccgcgccggtctgctcgcgcgggcacggccgggcagcaggccgcgcgcgcgggcgtgggaacgcgtcgtcgtcggtgtcggctcggcgccgtccgccgcccgaagaaggccgctcgtcgcgtccctcggggtcgggttgccactcccggcacaatcatcccggggtgagcacgccgtggcgctggaggtgcgtgaggatgaggatgaggcgaactccattgttcctgccggaaacctgcctcaccccggcactgacgagatcgcgccagttcccggggccaagacggtgcgcgtcaagttcgtgctgaagaagcggtgcgcgttcgggcagcagttcctcgtcgtcggcgacgacccggcgctgggcctgtgggatccgagcaaggcgaccgctttggattggtcggaagaccacgtctggacggcgaagacggatttgccggcaaacgagttgatcgagttcaagttcttgctgcgagatgcctcggggcatgtttgctggcagcacggcgctaacagaaccctggagacgactgaaactacaaatatcttggtcgtctacgaagactgtgatcacgccatgaaacaggaagtatcggaggaagaagagctctcgaccgggctggaagatgtgatgtttcaagacgaccttgcaggaagcaatggtgcaaccctggcacataacaacgtcacaacggatgagaacctgaagaataaggtggcagcagtcgtagcagatgctcctctgcaggtggtagcaaatgaaacgaaccaaccacagctgatattggacaaagaccagacggttctagaagagctccgtggagaagcaaaaacagtagcacaaaagggcagcaacggcgatggcactagcttgtgtcaggaaggcgcccagctggcaaataggccgccaagtatattagagaacgacttggcctgggccggaaaagccatgcatcaggtgctccggatcctcggtttccagatcggcacaacaaaaacatgaaattagaatcaggaatctatgtgtatgttgcaaacctgctgttttggaagatcagctgtgcctcgcgtattcagttctacatgctgcaaagaacgacagcactgaggattgc

SEQ ID NO: 23716 - protein, 343 aa, Panicum virgatum
  misc_feature: Ceres CLONE 1830061
  misc_feature (104)..(192): Pfam Name: CBM_20 Pfam Description: Starch binding domain
  misc_feature: SWISSPROT Homolog: EC 3.2.1.1 Alpha-amylase
MEAAAAVARRAGLLARARPGSRPRARAWERVVVGVGSAPSAARRRPLVASLGVGLPLPAQSSRGEHAVALEVREDEDEANSIVPAGNLPHPGTDEIAPVPGAKTVRVKFVLKKRCAFGQQFLVVGDDPALGLWDPSKATALDWSEDHVWTAKTDLPANELIEFKFLLRDASGHVCWQHGANRTLETTETTNILVVYEDCDHAMKQEVSEEEELSTGLEDVMFQDDLAGSNGATLAHNNVTTDENLKNKVAAVVADAPLQVVANETNQPQLILDKDQTVLEELRGEAKTVAQKGSNGDGTSLCQEGAQLANRPPSILENDLAWAGKAMHQVLRILGFQIGTTKT

SEQ ID NO: 23717 - DNA, 1816 bp, Panicum virgatum
  misc_feature: Ceres CLONE 1830067
  misc_feature: Encodes the peptide sequence at SEQ ID NO. 23718
acttctcagtccgcaaagtctcaaacccagacggggacgagacgtaccgagggccatctcaacgtgtacgcgacgcgaccaagctcagctgctgctccaatggcctcccaccctcctcccgagccttcttccaactcgaacaaggggtggggcgagcacgatgagatccacgtctcctccggcggcgtccaggcgcacacggacgacgacgccgactgcgagagcaggcgccccttgctgctcgggactccagcccccgccgagtgctactccgtctccgccgccgccctcccgttcttctttccagccttgggaggccttctctatggctatgacattggggcaacatccggcgcgaccatatcgctcaagtcttcaacattcagtggtacaacctggtacaatttatcatctgtgcaaactggccttgtggtcagtgggtcattgtatggtgctttgatcggctccgtcttggcatatactattgcagactttttagggcgacgcaaagagcttatccttgcttcaatctcatatttgattggagcccttttgacagctgtagcacccaacttcgctatcatggtggttggccgcttgttatacggaataggaattggattggctatgcatgctgctccaatgtatattgcagagactgcaccaagtcagataagaggcatgctcatttctctgaaggagttctttattgttcttgggatgcttcttggttatatagcaggcaatctctatgtggaagtggtttccggttggcgttatatgtatgcgaccagtacaccattatgcctcataatgggagtcggaatgtgctggttaccctcgtcacctaggtggctcctgttatgtgccatacaagggaagggaaacctgccagagacaaaagaaattgcaacccggtgcttatgtcgattgaggggtcaagcttcacctgatttggtctcagatcaggttaacttgattctggaggaactgtcgtatattgatccagagaagcaagttggcttcagggagatctttcaaggaaaatgtcttaaagcaatgataattggatgtggtttggtgttctttcagcaggtcactggtcaacctagcgtgctatattatgctgctacaatctttcagagtgctgggttctctggggcatctgatgccactcgtgtttcaattcttctaggtttactgaagttgatcatgactggagtagcagtccttgtggttgacaggcttggccgaagaccgttactcattggaggtgtcagtggaattactgtttccttatttttgctgtcctcctactacaccttacttaaagatgcttcctatgtggctgtaatagcacttctattgtatgttggctgttaccagctatcatttggtcctattggctggcttatgatctcggaagttttcccattgaggctgcgaggccgtggactgagtgttgctgttcttatcaatttcgcgtccaatgcgctagtcacctttgctttctctccactggaggatttgattggaacggggttgctcttctgtggattcggggtgatcgcagtggcatctctcatcttcatattctggatcgtcccggagacgaagggactcaccctggaggagattgaagcgagtctgtagtagattaatccaaaagaatgctcattcgtccaagtttcagttaactgaaggaactgctggtatcattttgcagtcagccttctgctgtagctagtttattcatattttctacaagttgttgtagtaatacttattactgtttcctggtaaagattaattcatg

SEQ ID NO: 23718 - protein, 517 aa, Panicum virgatum
  misc_feature: Ceres CLONE 1830067
  misc_feature (65)..(517): Pfam Name: Sugar_tr Pfam Description: Sugar (and other) transporter
MASHPPPEPSSNSNKGWGEHDEIHVSSGGVQAHTDDDADCESRRPLLLGTPAPAECYSVSAAALPFFFPALGGLLYGYDIGATSGATISLKSSTFSGTTWYNLSSVQTGLVVSGSLYGALIGSVLAYTIADFLGRRKELILASISYLIGALLTAVAPNFAIMVVGRLLYGIGIGLAMHAAPMYIAETAPSQIRGMLISLKEFFIVLGMLLGYIAGNLYVEVVSGWRYMYATSTPLCLIMGVGMCWLPSSPRWLLLCAIQGKGNLPETKEIATRCLCRLRGQASPDLVSDQVNLILEELSYIDPEKQVGFREIFQGKCLKAMIIGCGLVFFQQVTGQPSVLYYAATIFQSAGFSGASDATRVSILLGLLKLIMTGVAVLVVDRLGRRPLLIGGVSGITVSLFLLSSYYTLLKDASYVAVIALLLYVGCYQLSFGPIGWLMISEVFPLRLRGRGLSVAVLINFASNALVTFAFSPLEDLIGTGLLFCGFGVIAVASLIFIFWIVPETKGLTLEEIEASL

SEQ ID NO: 23719 - DNA, 1413 bp, Panicum virgatum
  misc_feature: Ceres CLONE 1830069
  misc_feature: Encodes the peptide sequence at SEQ ID NO. 23720
tcccccgtccccgtgtccctcgcccccgctccctccctgctcccccaaatccatcgccgcggtggcccgcctcctcctccccctccccttcgccgccgcggcggccgcgtccgcctcctcctcgctccacctcgcggcctcgcgcctccgcctccccgcggtctccgtggcgcggcgcgagggcctgttcgggggaagggcggtgggagcaggagcggtgagggcgcccgcgaggctggcgaggcgcgggctgtgcgccggcgcggagcccggcggctcggccggcacggcggtcagccaggaggaggctttggagtgggccaagaaggaccggaggcgcctgctccacgtcgtctaccgcgtcggcgacctcgacaagacgatcaagttctacacggagtgcctgggcatgaagctgctgcgaaagagggacatcccggaggagaggtacaccaatgcctttctgggctatggacctgaggattcacattttgttgtggagctcacttacaattatggtgtggagagctatgatatcgggactggtttcggccatttcgggattgctgttgatgatgttgcaaaaactgtggaccttattaaagcaaaaggaggaacagtaacaagggagccaggccctgtcaaaggtgggaaatcagtaattgcctttattgaggatcctgatggttacaaatttgagcttatagaaagaggtcctactcctgagcctttgtgccaggtaatgcttcgagtgggagaccttgatcgtgctatcagtttctatgagaaggcatttggcatggaacttcttcgcaagcgagacaatcctgagtacaagtatacaattgcaatgctggggtatggtcccgaagataaaaatgctgtattggagctgacctacaactatggtgtcaaggaatatgataagggaaatgcttatgcacagattgctattagtactgatgatgtctacaagactgcagaagtaattcgactaaatggtggacaaattactcgtgaacctgggccattacctggcattaacaccaagataactgcatgcacagatccagatggatggaagacggtgtttgttgataacatagattttctcaaggagttggaagaatgagctttgccgaaggtctcaactcacaacctggtacaacagaggggtttttcctgtgagttccgagcatgaccgcaaaatctttgtaaaagccaccacctcgaactgaggtttgtagataggtcgtccaatctacggcgtcacaattgatagttgatagattcaccgtcgggagcgatgtaggtttacaacccgtttttgtcagtaaaatcatgtgtacaatttttccacagaagaatattgtcattaactgttcattctcaaggacgtgcatcttttctctc

SEQ ID NO: 23720 - protein, 376 aa, Panicum virgatum
  misc_feature: Ceres CLONE 1830069
  misc_feature (113)..(234): Pfam Name: Glyoxalase Pfam Description: Glyoxalase/Bleomycin resistance protein/Dioxygenase superfamily
  misc_feature (243)..(364): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
  misc_feature: Useful for making plants with modulated nitrogen use efficiency
PPSPCPSPPLPPCSPKSIAAVARLLLPLPFAAAAAASASSSLHLAASRLRLPAVSVARREGLFGGRAVGAGAVRAPARLARRGLCAGAEPGGSAGTAVSQEEALEWAKKDRRRLLHVVYRVGDLDKTIKFYTECLGMKLLRKRDIPEERYTNAFLGYGPEDSHFVVELTYNYGVESYDIGTGFGHFGIAVDDVAKTVDLIKAKGGTVTREPGPVKGGKSVIAFIEDPDGYKFELIERGPTPEPLCQVMLRVGDLDRAISFYEKAFGMELLRKRDNPEYKYTIAMLGYGPEDKNAVLELTYNYGVKEYDKGNAYAQIAISTDDVYKTAEVIRLNGGQITREPGPLPGINTKITACTDPDGWKTVFVDNIDFLKELEE

SEQ ID NO: 23721 - DNA, 1693 bp, Panicum virgatum
  misc_feature: Ceres CLONE 1830082
  misc_feature: Encodes the peptide sequence at SEQ ID NO. 23722
aggaaaaactgcaattttaatccagggactaaatgtcagcatctacctaagttactttgcagttgaaacagtaacttgataggatttttcccgccacaatcgcaatgcagattccaagaagtcgtccccctcaacgccggcaacgtcctggtgatcgaggacaacgagccggcgtcgagatggcttgccctcatcaaccaggcgctgaaccggccttcaccaccatctgacgcgcacgccatttctgaagctgcagcgagcttctcgttctgccgatccgtagacacgacggcctctgcatccccgtcctccgctctccaaacgcccagctccagcccgctcgatccgtcgcggttccacaaatcctccaacagagagatccgccgcgccgccatcacccgcggccgccggctgaagacctgcacctgcccgtcggagcggcctcctcgccgtcggaggtcctccagggcgccgtgcctgatgggttgcggcaagaactacgccgacgccgtggagagcgacacgacgacgtcagacgaggaggacgacgaggtccgaaccagcagcttcgcggtgtccgacgtgaagagccccgcggcggtggcgagccggcgcgagaggtactgcctggttgcctgcaagcagatggtggggctgttcgcgacggtgtgggtgaggcgagggctggtgccgcacgtcggccatgtccgcttctcctgcgtcggccgtggcatcatgggctacctcggcaacaagggatgcatctctgtgagcatgtcgctccaccagacgagcctgtgcttcgtgtgcagccacctggcgtccggggagaaggaaggcgacgagctcaggaggaactccgacgtcgtcgagatcctcaagaacacgcagttccgacgcctctgcaagagatccggccgcaggattcccgagagaatcctcgatcacgaccgtgtgatctggctcggtgatctgaattaccggattgctctgagctactcggaggccaagaagctcgtcgaggccaacgactggggtactctcttcgagaaggatcagctcaagactgaaagagagagtggagttttcagagggtggaatgagggcaagatcttatttgctcccacgtacaagtactcttggaattccgacaattatgccggtgaagatgtgacgtcaaagaagaagcgaagaacaccagcatggtgtgaccggattctctggtatggtgaagggatagtgcagctatcctacatccgcggggagtcaaaattttcagaccatcgtcctgtctgtagtgcgttcattgtcgaggttgcagttcctgacaacaaactcatcaagtttgcatcaggtcccaacatgaaagttggtgtggaagaactcctatttgcccccatgtagcagatagcagtacatggaatgcagcatttgctcaagaatcaagatcacatacgggacacagcaaatacctggactcctagagcactaacttgaaacattgtgtacactactaatattaggagatattcatgagaggcaattgctgaccatagtgctgacgaagtcatgagtataataattcatagtgttcagtgttccaatttctgctactgtaatgcctaaacactacatgccttgtgatttattatttttcatgttaaaaatttggtgttggctaaaggaacacatc

SEQ ID NO: 23722 - protein, 307 aa, Panicum virgatum
  misc_feature: Ceres CLONE 1830082
  misc_feature (25)..(275): Pfam Name: Exo_endo_phos Pfam Description: Endonuclease/Exonuclease/phosphatase family
  misc_feature: SWISSPROT Homolog: EC 3.1.3.56 Inositol-polyphosphate 5-phosphatase
MGCGKNYADAVESDTTTSDEEDDEVRTSSFAVSDVKSPAAVASRRERYCLVACKQMVGLFATVWVRRGLVPHVGHVRFSCVGRGIMGYLGNKGCISVSMSLHQTSLCFVCSHLASGEKEGDELRRNSDVVEILKNTQFRRLCKRSGRRIPERILDHDRVIWLGDLNYRIALSYSEAKKLVEANDWGTLFEKDQLKTERESGVFRGWNEGKILFAPTYKYSWNSDNYAGEDVTSKKKRRTPAWCDRILWYGEGIVQLSYIRGESKFSDHRPVCSAFIVEVAVPDNKLIKFASGPNMKVGVEELLFAPM

SEQ ID NO: 23723 - DNA, 1009 bp, Panicum virgatum
  misc_feature: Ceres CLONE 1830084
  misc_feature: Encodes the peptide sequence at SEQ ID NO. 23724
accccgcattgaactcgcccccggttcgttccggcgcttgcccatcggactcaccgccgagacagagccccaagccatccccagacccccagcttctctctcagcgccctccgcttgtcgcgttgcggactcggcacacgccggcccgcccaggcccggatatagagcgaacagagcctctgagacaaccggccagatcgacatccaagcggttgcttggttcggcaagggagaaggatcagtccccagttggttttgtagccggccatggctgccaagaaggtggtgctgaagctggacctgcacgacaacaaggataagcagaaagtgctcaaagcggtctccactctccacggtattgactcgatctccgtggacatgaaggactctaagctgacggtgatcgggctcgtcgaccccgtcgacgtcgtggccaagctgcgcaaggtcggggccgcccacatcctctccgtcggcccggccaaggaggagaagaaggacgacaagaaggacggcgacaagaaggacggcgataagaaggccgtggtgtacccgccgccgtggtacgccgcgcagtacccccactacgtcgtccgcagcgccgaggaggaccccaactcctgcgtcatctgctgatggcgacgccgacgccgatccccggcccggccggtttttgtaaattcctagttggcctgcctgcctacctcgagctccagcgtcagtgatcgccggccgggaccggggtgcggtggttggccgctgtgctctgctctatccctgggttggttggcccgtccgcaggtcgttatattatgatgatgacgatggccggagcaattacgcaggcgatccaggagtagttggtgtgatttcaggctgcagcgccattgccgatgatcagcgagttgtgtagtgttcatatcattaatcatagcatattgtatctgggttttgtccttgctatttgggtttgaggcatgaaactataaacatatacaaaggttaaccg

SEQ ID NO: 23724 - protein, 122 aa, Panicum virgatum
  misc_feature: Ceres CLONE 1830084
  misc_feature (6)..(73): Pfam Name: HMA Pfam Description: Heavy-metal-associated domain
MAAKKVVLKLDLHDNKDKQKVLKAVSTLHGIDSISVDMKDSKLTVIGLVDPVDVVAKLRKVGAAHILSVGPAKEEKKDDKKDGDKKDGDKKAVVYPPPWYAAQYPHYVVRSAEEDPNSCVIC

SEQ ID NO: 23725 - DNA, 704 bp, Panicum virgatum
  misc_feature: Ceres CLONE 1830094
  misc_feature: Encodes the peptide sequence at SEQ ID NO. 23726
actactcgtgttcccccaaggccaaacccacccgcgctccaacccgtcctcttctcctcctccatctccatcgctgccgtccccgatcgatctcctccggcctctcgagaatatgggcagcctggcgtcggagaggacggtggtggggtgggccgcccgggacgccgccggccacctctccccctacacctacaccgtcaggaacacaggccctgaagatgtggtggtgaaggtgctgtactgtgggatctgccatactgacatccaccaggccaagaaccacctcggcgcttccaagtaccccatggtccctgggcatgaggtggtcggcgaggtggtggaggtcgggccggaggtgagcaagcaccgcgtcggcgacgtcgtcggcgtcggggtgatcgtcgggtgctgccgggagtgccgcccctgcaaggccaacgttgagcagtactgcaacaagaggatctggtcctacaacgacgtctacactgacggccggcccacgcagggcgggttcgcctccaccatggttgtcgaccagaagttcgtggtgccgatccctgctggtctggcgccggagcaggcggcgccgctgctgtgcgcgggcgtgacggtgtacagcccgctgaagcacttcgggctgacggccccgggcctccgcggcggcatcctgggcctgggcggcgtgggccacatggggcgtg

SEQ ID NO: 23726 - protein, 197 aa, Panicum virgatum
  misc_feature: Ceres CLONE 1830094
  misc_feature (34)..(149): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature: Useful for making plants with altered carbohydrate content
  misc_feature: Useful for making plants with altered lignin content
  misc_feature: Useful for making plants with altered cell wall content and/or composition
  misc_feature: The sequence is a functional homolog of SEQ ID NO 2 in US patent 7288696
MGSLASERTVVGWAARDAAGHLSPYTYTVRNTGPEDVVVKVLYCGICHTDIHQAKNHLGASKYPMVPGHEVVGEVVEVGPEVSKHRVGDVVGVGVIVGCCRECRPCKANVEQYCNKRIWSYNDVYTDGRPTQGGFASTMVVDQKFVVPIPAGLAPEQAAPLLCAGVTVYSPLKHFGLTAPGLRGGILGLGGVGHMGR

SEQ ID NO: 23727 - DNA, 720 bp, Panicum virgatum
  misc_feature: Ceres CLONE 1830110
  misc_feature: Encodes the peptide sequence at SEQ ID NO. 23728
atcagctctttctcacctcgcttccaagcgacaccaaaagcggcagcgagcggcaagaaccaccaccaccaccacttgagcctccccttggcttccactccaccgaaccagaccggaaaggcggaggcggggcaggccagaggccatggcgagcaacggcgacgggaagggccgcgtggcggcggcggccgggggagggtacgggtacggcgggtacgaggggcccgaggagcgcaagtggtggccgtggctcgtgcccaccgtcatcgtcgcctgcatcgcggtcttcgtcgtcgagatgtacgagaacaactgccccaagcacgggagccagctcggggactgcgtcgccggctttctgcgccgcttctccttccagccgttccgggagaacccgctcctcgggccctcgtcctccactttggagaaaatgggagcccttgactggaacaaaattgttcatcagcaccaaggctggcgccttattagctgcatctggctccatgctggcctaatccatttggttgtgaacctgctgagtttgctgtttattggaatccgccttgaacagcaatttggatttgttcgcattggtgccatatacctactatccggttttggtggcagcgtgttgtctgcactcttcctacggaacaactacatctctgttggtgcatctggagctttatttggcctgcttggatccatgctctcagagct

SEQ ID NO: 23728 - protein, 191 aa, Panicum virgatum
  misc_feature: Ceres CLONE 1830110
  misc_feature (104)..(191): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
MASNGDGKGRVAAAAGGGYGYGGYEGPEERKWWPWLVPTVIVACIAVFVVEMYENNCPKHGSQLGDCVAGFLRRFSFQPFRENPLLGPSSSTLEKMGALDWNKIVHQHQGWRLISCIWLHAGLIHLVVNLLSLLFIGIRLEQQFGFVRIGAIYLLSGFGGSVLSALFLRNNYISVGASGALFGLLGSMLSE

SEQ ID NO: 23729 - DNA, 685 bp, Panicum virgatum
  misc_feature: Ceres CLONE 1830115
  misc_feature: Encodes the peptide sequence at SEQ ID NO. 23730
acttgcaaccagtaaccatatacatacacactatacgtctctcagcacacagctagcattagcaatagcaacgcagcagtctaggagactagaggcggctctctagctctagctaaccagggggtgccagtgccaggaagaagagctcgggggaaaatggcgcagctgccaccgagggcgccgagcgccgcggcgcaggacccctggtcggcggcgggcgatttcctcgggttcgccgcggccaggcgcggcgcgcaccgccgctcggccagcgactcggccgcgttcctcgaggccgtgcccatggacgacgtcatcggcggcggcggcggcggcgacgacttcgaccgcctcgacgacgagcagttcatgtccatgttctccgacgtcgacgcgccggccgtctccgacggcgccggcggcgcaggcggggagagggccggggacgcgcatctgatggacatgggggacgcggaggacggaatggcggcctcgtcgccggccggcgcgcgcgcggccgcggacggcgtcgctgaccccaagcgggtcaagaggatattggcaaacaggcagtcagctcagaggtcacgagttaggaagctgcagtacatctccgagcttgaacgcagtgtaaccagtctccagatggaggtgtcagcactgtccccacgcgtggccttcctcg

SEQ ID NO: 23730 - protein, 176 aa, Panicum virgatum
  misc_feature: Ceres CLONE 1830115
  misc_feature: The sequence is a functional homolog of SEQ ID NO 1362 in the 10/374,780 US patent application
  misc_feature: The sequence is a functional homolog of SEQ ID NO 1482 in the 10/412,699 US patent application
  misc_feature: The sequence is a functional homolog of SEQ ID NO 1363 in the 10/374,780 US patent application
  misc_feature: The sequence is a functional homolog of SEQ ID NO 1364 in the 10/374,780 US patent application
  misc_feature: The sequence is a functional homolog of SEQ ID NO 1483 in the 10/412,699 US patent application
MAQLPPRAPSAAAQDPWSAAGDFLGFAAARRGAHRRSASDSAAFLEAVPMDDVIGGGGGGDDFDRLDDEQFMSMFSDVDAPAVSDGAGGAGGERAGDAHLMDMGDAEDGMAASSPAGARAAADGVADPKRVKRILANRQSAQRSRVRKLQYISELERSVTSLQMEVSALSPRVAFL

SEQ ID NO: 23731 - DNA, 634 bp, Panicum virgatum
  misc_feature: Ceres CLONE 1830115-R
accaggccgccgaccccgcgccgcccgtcaccaactggaagatctccagccccggcgacagccccgacgaggtgaaggcgcggctcaagtactgggcgcaggcggtggcgtgcaccgtccgcctctgcagctgaacgcccggcgaccgccacgccgccgggagaagcgatcgccgacaaccgaatggccggccggccgaccgatcgatcaaccgagaggctagcatcccgctggacgatgaccggatcagatcgatcgccgctcctgctgtaaagcgacgacgatggaggcgcggcgccccttctgctgctgctgcgacggcgggcgttggcggctgccatgattgcagccggggagtttggtgggggcatcgttcgtagcggacgtcgtgggaggctggttgacgacttgctgtgctctctgatccagctgagcgacctgctgtccagtgccaaccccgcgcccagcctatctccaggaaataaacaatagcgatccaaataatcatgttcagaataacagttgattaatctagtgagtgcacattgggtagaggatcacagtgaataaataaataactgatggatcccaatcttgttgctgctgttcttaatcattggttgtttgcttaatc

SEQ ID NO: 23732 - DNA, 1007 bp, Panicum virgatum
  misc_feature: Ceres CLONE 1830118
  misc_feature: Encodes the peptide sequence at SEQ ID NO. 23733
tctctctctctctctctctctctctctctctctctctcctagcttgtaggtagctagtacggccacaagtcacaaagttgtatatagccttctcgtcctctccattctctggcttgaaacctccaatccatccatggacttggtgccaaagcaagagcagcacaaagaggaggaggagaaagaggaagaggagggcatgatcttggcggagcatggcagccgggccaactttggccgcgatggccaagaccacctcggccgcggccgccatgctcctctcgggcccggccgccgccggccgcgacgccggcgcgctcttcgcgggccaccacgtcgcggcgccgctcttccagtcgtacccctacgcgtccgccgccatgggcgccacgctctccgcctccgcgccgttcccgaccatcaccctcgacctcacccacccgccgccggcgtcggccgcgggcctgctcccgcaccgcccgccggcgctccccgcgatgccgttcccgatgtacggcggcttccctgccgcgcacaggcccgcggtgccgccacagccgacgacggtgtcgttggggatgatggacggcaggaaccggtcggcgctggagaccatgaccgccgcgatcaccagagaccccaacttcaccacggcgctggcggccgccatctcgacgatcattgggggaggcgctgaagcagctccccggagtggcgccggcgccaacggagatggtaatagcgatagcggcggcactgagtcgaccaccacggcggcggcggccggagcacgggagacggcattgcatgcgcttttacaaagactgcatgacagccggcaataataacattttgaaatcaaagcttatggacgaccatctgtacatacatccatgtgtaccgcgtacgcataaatctgtacacatcgcttttgtacgttatacgtatagtcctatgtgctagtgttgtaaatggattatacaattgagatttttatagaggcgatacgt

SEQ ID NO: 23733 - protein, 209 aa, Panicum virgatum
  misc_feature: Ceres CLONE 1830118
  misc_feature: The sequence is a functional homolog of SEQ ID NO 885 in the 10/666,642 US patent application
MAAGPTLAAMAKTTSAAAAMLLSGPAAAGRDAGALFAGHHVAAPLFQSYPYASAAMGATLSASAPFPTITLDLTHPPPASAAGLLPHRPPALPAMPFPMYGGFPAAHRPAVPPQPTTVSLGMMDGRNRSALETMTAAITRDPNFTTALAAAISTIIGGGAEAAPRSGAGANGDGNSDSGGTESTTTAAAAGARETALHALLQRLHDSRQ

SEQ ID NO: 23734 - DNA, 690 bp, Panicum virgatum
  misc_feature: Ceres CLONE 1830121
  misc_feature: Encodes the peptide sequence at SEQ ID NO. 23735
agaacgggagcggcgaggtcgagctcctgctgcggctgcgcgaggccgagagccggcggcccgagatcgatttcggcaataattgcagctcgagcaggcaaatcatagcttgggagagaggttgatttggaaggtgagaagagagaagcgagggtgagatcgaccggccgatcgggagggcaggccatggggcgcgggaaggtggtgctgcagcggatcgagaacaagatcagccgccaggtgacgttcgccaagcgccggaacggcctgctcaagaaggcctacgagctctccatcctctgcgacgccgaggtcgcgctcgtcctcttctcccacgccggccgcctctaccagttctcatcctcctccaatctgcttaaaactttggagaggtaccagaggtacatctatgcttcagctgatgctgcagtgccgtctagtgatgagatgcagaatcactatcaagaatatgtgaagttgaagacaagagttgaggttttacaacactcacaaaggaatcttctgggtgaagatctggctccacttaccaccagtgaacttgaacagcttgagagtcaagtagacaagaccttgaagcaaatcagatcaagaaagactcaagtgctacttgatgaactctgcgacttgaagagaaaggaacatatgctgcaagatgccaacatagtcctg

SEQ ID NO: 23735 - protein, 167 aa, Panicum virgatum
  misc_feature: Ceres CLONE 1830121
  misc_feature (75)..(166): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: Useful for making plants with modulated biomass
  misc_feature: Useful for making plants with modulated flowering time
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 28 in the 10/666,642 US patent application
  misc_feature: Useful for making plants with altered alkaloid content
  misc_feature: The sequence is a functional homolog of SEQ ID NO 707 in the 10/666,642 US patent application
  misc_feature: Useful for making plants with modulated phosphate use efficiency
  misc_feature: The sequence is a functional homolog of SEQ ID NO 2 in US patent 7273968
  misc_feature: Useful for making plants with altered terpenoid content
  misc_feature: The sequence is a functional homolog of SEQ ID NO 6 in US patent 7279615
  misc_feature: The sequence is a functional homolog of SEQ ID NO 730 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 46 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MGRGKVVLQRIENKISRQVTFAKRRNGLLKKAYELSILCDAEVALVLFSHAGRLYQFSSSSNLLKTLERYQRYIYASADAAVPSSDEMQNHYQEYVKLKTRVEVLQHSQRNLLGEDLAPLTTSELEQLESQVDKTLKQIRSRKTQVLLDELCDLKRKEHMLQDANIV

SEQ ID NO: 23736 - DNA, 1047 bp, Panicum virgatum
  misc_feature: Ceres CLONE 1830138
  misc_feature: Encodes the peptide sequence at SEQ ID NO. 23737
gctcacgcggcctcaccccactcgtcgtcttcccctgttccccctccttcccgccgtcgtggagaggaggcccccgcggctggcgcccgccgcttcccgacagttcggccctccagcttccccggttcggaggtagcagggccggctgccgcgatgttctccaggatctcccggctaggggtgcggctcctgcgcgagggtagggccgagacgagagctggaaacttgctcagcagtcgaggcagtttgtatcaagatcatgtcaaccagcattcgactccagttgtaacacctactttacaatcgttgaggaacgtcctcttttcaactgcaacaagtggtgatcaggatggaagcggtcaggagaaggagaaaatctctgtaacatttgtcaacaaggatggctcagaaaagacgatcagtgtgcccattggaatgtccatgttagaagctgcacatgaaaatgacatagaacttgaaggggcatgtgaaggctcacttgcttgttctacttgccatgtaatagttatggatgtgaatgattataacaagttagaagaaccaacagatgaagaaaatgatatgcttgaccttgcatttgggctcacagaaacgtcacggcttggctgccaagtgattgcgaagcctgagcttgatggcatgcggctggcattacctgcagcgacaaggaactttgcggtagacggctatgtaccgaaaccacactgaagagactgtcatctacggggacacggattcttacagcagagtcagttttgtcttggagctgcaatctggtgcgttagatggagcaccgggtggagtcatcttcaaagaagcaagacatcttctgagtttgcactttgttttgtttggtgttgcttacacacctcgttctcacacaaactagctcgttcaggcttatacagggacccagatcgaccaagcatctggtctgatcccctcccagattttgtaacatgtcttgtgggtcgcgactttgctgtcccggcgggtgaataaagcatgagccaagcatgatttttt

SEQ ID NO: 23737 - protein, 191 aa, Panicum virgatum
  misc_feature: Ceres CLONE 1830138
  misc_feature (80)..(165): Pfam Name: Fer2 Pfam Description: 2Fe-2S iron-sulfur cluster binding domain
MFSRISRLGVRLLREGRAETRAGNLLSSRGSLYQDHVNQHSTPVVTPTLQSLRNVLFSTATSGDQDGSGQEKEKISVTFVNKDGSEKTISVPIGMSMLEAAHENDIELEGACEGSLACSTCHVIVMDVNDYNKLEEPTDEENDMLDLAFGLTETSRLGCQVIAKPELDGMRLALPAATRNFAVDGYVPKPH

SEQ ID NO: 23738 - DNA, 1484 bp, Panicum virgatum
  misc_feature: Ceres CLONE 1830140
  misc_feature: Encodes the peptide sequence at SEQ ID NO. 23739
ggaaaaggagaaagagaaagggaacagaagaacgccggagcgggagcctgacgccacctcctccgtactccctccctccctcctccccgattcagatctctcctcggctcgcctccgtccccctctcgatcggccgcggcgccggagagggcggcgcccaatggaagccatccggaagcaggcctccaagctccgggagcaggtcgcccggcagcagcaggcggtgatgaagcagttcggcggcgggtacggcgcggacggcgccttcgcggacgaggccgaggcgcagcagcactccaagctcgagaagctctacatctccacgcgcgccgccaagcacttccaaagggatatagtccgcggcgtcgagggctacatagtcacggggtcgaaacaagtcgaaatcgggaacaagttgtgtgaggacggtaagaagtatggcactgagaacacgtgtaccagtggaagcacgctgtcgaaggcggcattgagtttcgctaaggcacggtccttgatggaaaaggaaagagttaacctgctgaaagccctgggcacgcaggttgcagaaccactgagggctatggttatgggagctcctttggaggatgctcgccaccttgcccaaagatacgacagaatgcgtcaagaagctgaagcgcaggctattgaagtttcgaagcgccaaatgaaattaagagaggcatctggaaatggtgatatgatttcaaggctagaggcagctgagacaaagctgcaggagttgaaatcaaatatgggggttttgggcaaagaagctgttgcagcaatgactgctgttgaagctcaacagcaaaggctgacattgcagcgacttattgcattggttgagtctgaaagaaattaccaccaaagggtcctacaaaatcttgatcagcttgaaagagagatggtatccgagcgccaaagaattgaaggagcacctcctccggttgttgaaagttccatgccacctccacctgcatatgaagaagtcaacggtatattcatgaggaacactgttgcagaattggtcgagaccgtggagtacttcttggctgaggccatccagtcatatcgagctgagagcgataccgagctcaaccttgcagctggtgactacatagtggtccgaaaggtgtcgaacaatggatgggctgaaggtgaatgcaggggtaaagctggctggttcccttacgactacatcgagaaacgggaacgtgtgcttgcaagtaaagttggccaagttttctgagacgctcaccgagccatacatacccccgtgtttgtacactgtattatgtccgttatcgtcagagaagatctgtaattttgctgaaaactccctgttggatggcttcctgcctggccgtcagcattgtttaaatccgtacggcaggaaccgaacactaatgcttatcttcattcttcaactatcccgtcaatatataaccataccttttttgttt

SEQ ID NO: 23739 - protein, 369 aa, Panicum virgatum
  misc_feature: Ceres CLONE 1830140
  misc_feature (304)..(357): Pfam Name: SH3_2 Pfam Description: Variant SH3 domain
MEAIRKQASKLREQVARQQQAVMKQFGGGYGADGAFADEAEAQQHSKLEKLYISTRAAKHFQRDIVRGVEGYIVTGSKQVEIGNKLCEDGKKYGTENTCTSGSTLSKAALSFAKARSLMEKERVNLLKALGTQVAEPLRAMVMGAPLEDARHLAQRYDRMRQEAEAQAIEVSKRQMKLREASGNGDMISRLEAAETKLQELKSNMGVLGKEAVAAMTAVEAQQQRLTLQRLIALVESERNYHQRVLQNLDQLEREMVSERQRIEGAPPPVVESSMPPPPAYEEVNGIFMRNTVAELVETVEYFLAEAIQSYRAESDTELNLAAGDYIVVRKVSNNGWAEGECRGKAGWFPYDYIEKRERVLASKVGQVF

SEQ ID NO: 23740 - DNA, 690 bp, Panicum virgatum
  misc_feature: Ceres CLONE 1830144
  misc_feature: Encodes the peptide sequence at SEQ ID NO. 23741
gagcctgcactctgctgattaggcagtcctcttgtcgatccatcctgcaagagtgctatattggggatggcgctgatcacgaatgtctctgactatgaggagctcgcaaagcagaagctgtcaaagatggtttatgacttctatgcgttaggtgcagaagaccagcggacactcaaggagaatagggaggcattctccagaattttgtttctaccaagggtactgattgatgtgtcccatatcaacatgttcgcgaacgttttaggctacaacatttccatgcctattatggtggctcccactgctttgcacaaactggcccatccagaaggagaggttgcttctgcccgagctgcagctgctgcaggaaccatcatgactttgtcttcatggtcatcttgtagtattgaagaagttagctcgagcggaccaggactccgtttctttcaactttcagtattcaaggacaggaactttgtgcaacagcttgtcagaagggctgaaaacgctggctataaggcaattgctgtcactgttgatgccccacggctaggtcacagggaagctgatgtcaggaacagattctccttgcctgaaaatgtgggattgaagtgctttgaaggactggatctcagcaacatggacaagaatgtttctggccttgctgcatatgttgctagccagattgac

SEQ ID NO: 23741 - protein, 207 aa, Panicum virgatum
  misc_feature: Ceres CLONE 1830144
  misc_feature (14)..(206): Pfam Name: FMN_dh Pfam Description: FMN-dependent dehydrogenase
  misc_feature: SWISSPROT Homolog: EC 1.1.3.15 (S)-2-hydroxy-acid oxidase
MALITNVSDYEELAKQKLSKMVYDFYALGAEDQRTLKENREAFSRILFLPRVLIDVSHINMFANVLGYNISMPIMVAPTALHKLAHPEGEVASARAAAAAGTIMTLSSWSSCSIEEVSSSGPGLRFFQLSVFKDRNFVQQLVRRAENAGYKAIAVTVDAPRLGHREADVRNRFSLPENVGLKCFEGLDLSNMDKNVSGLAAYVASQI

SEQ ID NO: 23742 - DNA, 1489 bp, Panicum virgatum
  misc_feature: Ceres CLONE 1830149
  misc_feature: Encodes the peptide sequence at SEQ ID NO. 23743
cccgatgccgcaccaccgtaaccgcccagctcggatccttaccgtcgccgctccttcttcccgagactcgcccccaatcccggcgcccagctcggattcgcgcccccaatcccggcgcccagctccctcatccagagagaccccaatcccggcgcccagctcggatcctgacggcgccgcagcaacctgccatcgccgctccttcatcccccagacgcgtccccaaccccggcgccgcaccacccccatcccggcgcgtctcggcctcccgtcggcgaccctcgcgccgtcccggcgaagtgctgaacggccggttgccgtcagcccccctcccccgacgagctgcagcatccgtccagcgcaattgatctaagggcgagatacttatagttcattctttctattactggattcattctgtctattacgcatcgtaggttcccgccggcgaggaggacctgccggcgcatgtgccagtgagatggagcagccggcacagatccttcagataacccaatgcaaagcactattcatagcaaaccattgtaagtctgcgccgctgtccggccttcctcagtgccaagcagctcgcttattatctgtactacccatggttttctacacattcgtcctcaccgatggagtctcctgaatcgctgcccttacatactgaactcttcagtgagttccatcacgggactgctcaactagaagcacggcagatctggtttttgatggatacaagaagtagcacggggagaggtagctggatctggttttctctggccgctagaagccagacctgaatcatgtcgtcatcctctccctccaaaatgcctagccatccctcttcagtctacatcgctatcgctcgcatccatccttctgcctgtcatgttgaaagatactaacaatacaaattcacccacagcactgaagaatcagggcacaagggaatacgagccatagggtcaaggatctacagaatacagggtcctctttatcaggcagatatgaatgggtgcaatctgtatgatagagcactctaaggaacttcagaatcttgttaatgacgctattgacaaaggtggcgaaattgctgtcagagggagttttggcaatcttggtgaagatgcagttgatcaatttttccctccaactatcccggtgaatgttaatcacacaatgaaaattatgcaagaagaggcatttggatcaattctaccaatcataaaattcagttctgacgaagaggctattaaagtggcaaaggattcaaaatttggtttgagaaccatttctggtttacacctgttgcctgggcattgaaatgaaattgaaattctactaactatggttgtgccaggatgtgtcatgtgctgctcttggacaccatcggtgttgagtgtctgtgtgcggttgataaatctcagcagcttcatcggcatgtacaaagtgtggggaagaaaagaccttgtacttttgctcc

SEQ ID NO: 23743 - protein, 103 aa, Panicum virgatum
  misc_feature: Ceres CLONE 1830149
  misc_feature: SWISSPROT Homolog: EC 1.2.1.3 Aldehyde dehydrogenase (NAD(+))
MGAICMIEHSKELQNLVNDAIDKGGEIAVRGSFGNLGEDAVDQFFPPTIPVNVNHTMKIMQEEAFGSILPIIKFSSDEEAIKVAKDSKFGLRTISGLHLLPGH

SEQ ID NO: 23744 - DNA, 689 bp, Panicum virgatum
  misc_feature: Ceres CLONE 1830167
  misc_feature: Encodes the peptide sequence at SEQ ID NO. 23745
gttttgattcgcttgcgagttgcgaggacggggccggcggcgtgcatggcgacggcggcggccgccggcacggtggtgctggtggacgcggcgctggccccgtacgagcaccctgacctccggtggctcgtccggaagcacgtcctcgccgtcctccaggagttccccaccctctcgccttccgtcgacacctacaccagcgacgacggcgcctccaccgtgctgctcaacgcgcggggcctcctcgccgtctccctcgccctgccgccggtcctcctcaccctgtggctccccagggagtacccctaccgcccgccgctcgtctacgcattccccgccgcgccgtcggcgtcgctcgtccccgaccaccccttcgtcgaccaccgcaccggccgcgtccaccgcacgctgccgtacctcgaggaatggagcgtgccaacctccagcctcgccggcctcgtgctgagcctcgtcgcggccttgaggatgtgccacccgctgaagtccaccatcggcttcgccgacgcgacgaacgccagagcgacgccggtggaggaggagcggcggcgcatgcacgcggtgctggccaacgagctcgcctcgaggctgggcagggacgcggcggccttccgcggcggcgtcgaccgggacatccatgccctgtcctcgctgcaagccggcctccgggc

SEQ ID NO: 23745 - protein, 214 aa, Panicum virgatum
  misc_feature: Ceres CLONE 1830167
  misc_feature (29)..(152): Pfam Name: UEV Pfam Description: UEV domain
MATAAAAGTVVLVDAALAPYEHPDLRWLVRKHVLAVLQEFPTLSPSVDTYTSDDGASTVLLNARGLLAVSLALPPVLLTLWLPREYPYRPPLVYAFPAAPSASLVPDHPFVDHRTGRVHRTLPYLEEWSVPTSSLAGLVLSLVAALRMCHPLKSTIGFADATNARATPVEEERRRMHAVLANELASRLGRDAAAFRGGVDRDIHALSSLQAGLR

SEQ ID NO: 23746 - DNA, 707 bp, Panicum virgatum
  misc_feature: Ceres CLONE 1830186
  misc_feature: Encodes the peptide sequence at SEQ ID NO. 23747
gagaaaatcagatgacgatgatggccgccgccgccgccgccgccgccgccaaatctccccccttcactctcgcctcttcccgcccgcaacctcgcgccgccttcctctcccccagccttgtcctcagaccccgccgcgcctcgctgctcgccacgcccgcgcccgcgccctcgccctcgccggacgccacgcccgccccggacgccgccaccaaccccttggccgctctcctccaggtgccccgcacgctctggcgccgcaccctccaccccctcggggactacggcttcggcacccgcagcgtctgggagggcggcgtcggcctcttcatggtctccggggccgcgctcctcgccctcgccctcgcctggctcaggggcttccagctccgctccagattccgcaagtacaacaccgtctttgagttcacgcaagcatgcgggatctgcgtcggcacgcccgtccggatacgaggggtcaccgtcggatccgtcgtccgcgtcgactcatccctcaggagcatcgatgcgctcgtcgaggttgaagatgataaaatcatcataccacggaattcagtggttgaggtgaaccagtctggtcttctaatggagacactcattgatatcacaccaaaagatccactccctgcaccttcactaggaccactacacccctgatgcaccaaacaaggtttgattctctgtgac

SEQ ID NO: 23747 - protein, 218 aa, Panicum virgatum
  misc_feature: Ceres CLONE 1830186
  misc_feature (128)..(205): Pfam Name: MCE Pfam Description: mce related protein
MAAAAAAAAAKSPPFTLASSRPQPRAAFLSPSLVLRPRRASLLATPAPAPSPSPDATPAPDAATNPLAALLQVPRTLWRRTLHPLGDYGFGTRSVWEGGVGLFMVSGAALLALALAWLRGFQLRSRFRKYNTVFEFTQACGICVGTPVRIRGVTVGSVVRVDSSLRSIDALVEVEDDKIIIPRNSVVEVNQSGLLMETLIDITPKDPLPAPSLGPLHP

SEQ ID NO: 23748 - DNA, 713 bp, Panicum virgatum
  misc_feature: Ceres CLONE 1830207
  misc_feature: Encodes the peptide sequence at SEQ ID NO. 23749
aaaaccactccgctcaagcagtcaagctcaacgcggggcaagcaagcagaagcagtcactccactctccacaaaccaagctcaagcatccacctgaagaaaacaacagcagcagcaaggagccgccatggacatgggccgcctcgagcactcgacctcctcctcgtcctccaccacctcggcgtcctcgtcctcgtcgggccagaacaaggcgtcgccgccgtcctcgccctccccgccggcgcccaagaagcgccccgcggggcgcaccaagttccgcgagacgcgccacccggtgttccgcggcgtgcgccgccggggcgctgcgggccgctgggtgtgcgaggtgcgcgtcccggggaaccgcggcgtgcgcctgtggcttggcacctacgccgccgccgacgccgcggcgcgcgcgcacgacgccgcgatgctcgccctgggacgcggcggggccggcctcaacttcccggactccgcgtggcggctcgccgtgccgccgccgtccgcgctcccgagcctggacgacgcccgccgcgccgccctcgaggccgtcgcggacttccagcgccgttccggtgccaatgacagtgccgccgcggtcgacgaggcgacctcgggcatgtcggctccgccgccggtgccggacattcccgggtcgctggctacgtcgcttgagcacgtgcccgcgaagactgatgagacggcggc

SEQ ID NO: 23749 - protein, 195 aa, Panicum virgatum
  misc_feature: Ceres CLONE 1830207
  misc_feature (56)..(109): Pfam Name: AP2 Pfam Description: AP2 domain
  misc_feature: The sequence is a functional homolog of SEQ ID NO 752 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1248 in the 10/374,780 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 2 in US patent 7253000
  misc_feature: The sequence is a functional homolog of SEQ ID NO 2 in US patent 7138277
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1236 in the 10/374,780 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
MDMGRLEHSTSSSSSTTSASSSSSGQNKASPPSSPSPPAPKKRPAGRTKFRETRHPVFRGVRRRGAAGRWVCEVRVPGNRGVRLWLGTYAAADAAARAHDAAMLALGRGGAGLNFPDSAWRLAVPPPSALPSLDDARRAALEAVADFQRRSGANDSAAAVDEATSGMSAPPPVPDIPGSLATSLEHVPAKTDETA

SEQ ID NO: 23750 - DNA, 1511 bp, Panicum virgatum
  misc_feature: Ceres CLONE 1830213
  misc_feature: Encodes the peptide sequence at SEQ ID NO. 23751
atccgagtgagaaaagaaggcccactctgcccagtgcccacaccaactcaccggtgagcagcgccgccgcgctcgtggcgatcccggtagtctccggcggcagattcgcagttcagcggcatggacacggaggacggtctcgacgccgagcagggtgccgcggcaacgacggcggggggcctccccgacgacgccgtcgtggagatcctctcccgcgtccccgcgaggtccatccaccgattcaagtgcgtctcgaagccctggcgcgacctcatcgccgaccccctccaccggaagcggctcccccagaccctcgaaggcttcgtctgctgcgccgtcgccggcgccagtttccacgggcgcttcatcagcctgccggggagatccgcgcctcccgttgacccttccttctccttcctctcgaagctgccctggatcgaaaacatcaagctcttgggttcctgcaatgggctcctcctctttgagcacggccggaatccggccacggcaccagcctacgccgtttgcaaccccgccactgaggaatgcgtggccgtgcccagcgctggctgtccctctcctggtcctgtattacaagagcgcacctatttgattttcgatccagccgtatcgccacacttccacttggtctatgtctggcaggaagatttcctgggtgagattgaggtgcgtgcctactcgtctgagaccagggtgtggagtgattgggcaagccaacagaggcgactgcaagatgaaggtggatggaaacattgggttaatggtggagccgtacttacatcaattggtgcctgtgttaacggcatggtgcatttaatcatcttcaacatgcaggaagagtatttgataactacgctggatagagaagggaagacgtgtaggatcattcgctggccagacaattgtggttttcctctttctgtcggtcaatcccaaggtcacctgcattgtgtgggtttacttgtggaacgggaagaaagttgtttaatatgggctggactgtccatttgggttcttaaggactatgatacagaagaatgggtcctcaagcatagggtgagcttcttggagttgtttggacaaatgaattgcctggatggttataatagcaatgtgcttgccattcatccggatcgcaatttgattttcattcttcagggcagcaaccagaagctgatatcatatgacatggacagtaaggaatcgcacgctttccacactcttggacacaactatgggtttcctactccatatgttcccagtttcatgaagttggtgcttgcaaatgagcattgaaatgttgcttttgaggtactcatggggacattcttcagtaaattgatccccatgtatggagaacttagcaacctgggtgaatgaaatctgtgagaactaagctaatacattgctggtgatttggacatattcgctctcagttgagagacatctctgtaaggcagttttacatgtgctagttaccttattaaacg

SEQ ID NO: 23751 - protein, 398 aa, Panicum virgatum
  misc_feature: Ceres CLONE 1830213
  misc_feature (16)..(63): Pfam Name: F-box Pfam Description: F-box domain
MDTEDGLDAEQGAAATTAGGLPDDAVVEILSRVPARSIHRFKCVSKPWRDLIADPLHRKRLPQTLEGFVCCAVAGASFHGRFISLPGRSAPPVDPSFSFLSKLPWIENIKLLGSCNGLLLFEHGRNPATAPAYAVCNPATEECVAVPSAGCPSPGPVLQERTYLIFDPAVSPHFHLVYVWQEDFLGEIEVRAYSSETRVWSDWASQQRRLQDEGGWKHWVNGGAVLTSIGACVNGMVHLIIFNMQEEYLITTLDREGKTCRIIRWPDNCGFPLSVGQSQGHLHCVGLLVEREESCLIWAGLSIWVLKDYDTEEWVLKHRVSFLELFGQMNCLDGYNSNVLAIHPDRNLIFILQGSNQKLISYDMDSKESHAFHTLGHNYGFPTPYVPSFMKLVLANEH

SEQ ID NO: 23752 - DNA, 1332 bp, Panicum virgatum
  misc_feature: Ceres CLONE 1830219
  misc_feature: Encodes the peptide sequence at SEQ ID NO. 23753
ggaggggcgtcgtcttcgtcgccgatccgctcgtctccgccgtggagatcccccaaaatcgcgggcagcctcttccggatttgcacggagttcgcgacgatttcgatgagatagaagcctacgccagccaaggccttgcgatgctgcggaaggtggctgtcgccctcatcgcctgcgccgcactctatttctccttcttcgcctactaccgtcgccagggcattgcagaggttcagttaccagctgttactcacagggtctacctagatgtggaaattgacggacaacacataggcagaattggtattggtctttatggggaggttgttcctaaaacagttgaaaactttagggcactttgcacaggtgaaaaaggtgtagggtccaatggcaaacctcttcattataaaggaactccattccatcgtatcatccctggtttcatgattcaaggtggtgacataattagaggtgatgggaaaggaagtgagtctatatatggaggcatcttcccagatgagaacttcaccgtaaaacatactcatccaggtgttgttgctatggcgaattctggacttgactccaatgggtcccagttttacataactacaatcaagacaagctggttggatggggagcatgttgtctttggcagggtgatccaaggaatggatacggtgtacgccattgaagggggtgctggcacttacaatggcaagccgaggaagaaggctgtgatcactgactcgggtgagatacccaaggagaaatggggtgatcaggagacgtagacactctctgcttgctctgttccatgtactgaaccatgacaagctgccttttgagttttgatttgtcgtcttgtgccacagtccagtcgtggcgtcgagatggtgtatattttagccagtttgtagccactcccattaacgctgattatatttgtatggcttagtttgtgatgttgcaacgtgaacacgcacaagtctttcaaaaaattgttttagccagctgttattgtttactgttaccttgatgggctgttctgctgttacagaggacttttgacatgagtttttacccggcgtttgtatgtatggacatcaacaatgcaaatcttagctcagcgctgtacacgtcggccggcaggccgctccggcgcttctccaccctcatcagtcagcacgcatcagtttactgtcttgaggaaatgttttgctttctggttatggaggtccaagttgtattgcatttcttatggtactgctgtattgacgttaatagccgtgcagaacaaccagtgatagtgtgcacaatttttcttcactatgc

SEQ ID NO: 23753 - protein, 216 aa, Panicum virgatum
  misc_feature: Ceres CLONE 1830219
  misc_feature (39)..(206): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MLRKVAVALIACAALYFSFFAYYRRQGIAEVQLPAVTHRVYLDVEIDGQHIGRIGIGLYGEVVPKTVENFRALCTGEKGVGSNGKPLHYKGTPFHRIIPGFMIQGGDIIRGDGKGSESIYGGIFPDENFTVKHTHPGVVAMANSGLDSNGSQFYITTIKTSWLDGEHVVFGRVIQGMDTVYAIEGGAGTYNGKPRKKAVITDSGEIPKEKWGDQET

SEQ ID NO: 23754 - DNA, 692 bp, Panicum virgatum
  misc_feature: Ceres CLONE 1830228
  misc_feature: Encodes the peptide sequence at SEQ ID NO. 23755
acacacgagagaggagggggattcatcagccattcatgctcatggagttgctctgctgagctcgttgtttccttctgcctgggcgtttcttctccctctggttcctcggccggagcctgaagcggtgagcgaagatgaactacctcaggagccggagcctgaagcggctcctgtccctcggccgccggagcaacgcggacgagtccgccgaggagtgcgtcgacgctgaaccgccgccgccgccgtacaagcccacgtggaggtgcttctcctacgacgagctccaccaggccaccgatggcttccaccaagacaacatggtggggaaaggcgggtacggcgaggtgtaccgcggcgtcctggacgacgggagcgccgttgccgtgaagcgcctggcgccgacggccgcggcggacgagaagaaggagaaggacttcctcacggagctgggcacggtgggccacgtccgccaccccaacgtgtgcgcgctcctcggctgctgcgtcgaccgcggcctctacctcgtcttcgagttctccacccgcggctccgtctccgccaacctccacgacttgaagctgccggtgatgtcgtggaagcagcggcacgggatcgcggtcggcacggcgcgcggcctgcgctacctccacaagggctgcgcgcggcggatcatccaccgcgacatcaaggcg

SEQ ID NO: 23755 - protein, 185 aa, Panicum virgatum
  misc_feature: Ceres CLONE 1830228
  misc_feature (57)..(184): Pfam Name: Pkinase_Tyr Pfam Description: Protein tyrosine kinase
  misc_feature: SWISSPROT Homolog: EC 2.7.11.1 Non-specific serine/threonine protein kinase
MNYLRSRSLKRLLSLGRRSNADESAEECVDAEPPPPPYKPTWRCFSYDELHQATDGFHQDNMVGKGGYGEVYRGVLDDGSAVAVKRLAPTAAADEKKEKDFLTELGTVGHVRHPNVCALLGCCVDRGLYLVFEFSTRGSVSANLHDLKLPVMSWKQRHGIAVGTARGLRYLHKGCARRIIHRDIK

SEQ ID NO: 23756 - DNA, 1738 bp, Panicum virgatum
  misc_feature: Ceres CLONE 1830252
  misc_feature: Encodes the peptide sequence at SEQ ID NO. 23757
gtctagcttcttcagagctactgtaattgcctccgtttcggcgccgcacccagaccgccccggcgcccacgccaagccaagcgcacatcgccccccgtttaaacctctgctccgtcactccggcggcgcctggtcggctcgccgcgggccggccaacctgcgctgggcatcggccgccgggcggcgcgcggccgcctccgtgctcgcttcggcgcggcgcttgtgcaggctataaataaggacggcgtgcggcgttcatcaagcagagcactaagagaaaaaaaataataaaagaagaagatcgagggggaggagcgtgatggcgtcagagatgagcaagaacgtcaaggtccttgacgagcaggaggtcacctcgcaccagcgcggcgaccagggcgtccgcgcccggcccggcggcgcggcggcggagggccaggaggatcagctggcgcggcagccgtcgatcatgtcgctgacgctggaggagctccagagctcgctctgcgagccgggacgcaacttcgggtccatgaacatggacgagttcgtggccaacatatggaacgccgaggagttccaggccgccaccggcgggtacaaggacgacgcgccggagcaggagcaggaggcgacggcggcagcggcgacaggggtaggtggtgggaacggggggagcgggttggttcggcaggggtcgttcgctctgccgccgccactgtcgcggaagacggtggaggaggtctgggcggagatcaaccagggggccccggcggacgcgggggcccacccggcgccgcaggccatcgtgcagccgcaggtggggagcggcggcgtcgcggccagcgggcggcaggtgacgctgggcgagatgacgctggaggacttcctggtcagggccggcgtcgtccggggcgccttcgccgccgggcacggccagggccaggcggtcggcatggtcccggccgcgccgatggtccacatgcagcaggggcagctcgcggctcccatgatgtaccaggtggcgccggggaacgccgtgttcccggtgatgggagacggcatggggtaccacaacgggtaccccggggcggccatggcggtggtgccgcctccgccgccgtcccagtgcgtggcgcccgccgtgagcccggggtcgtcggacgggatgagcgccatgacgcaggcggagatgatgagctgcattggcaacggagggatggtccggaacggcggcggcgcgaggaagcgcgactcccccgaggacgggtgcaccgagaagacggtggagcgccggcagcggcgcatgatcaagaaccgcgagtcggcggcccggtcacgagccaggaagcaggcgtataccgtggagctcgaggccgaattgaaccatctcaaggaggagaatgcgcgcctcaaagccgaggagaatacaattctgctgtcgaagaaaaagatgctggtggagaagatgatggagcaggcgagggagaacgtcagcgccaagaagagcggtcgcgggctgcgccgctgcggcagcgccatgtggtgagctgtgactagcgcggctcgcattgtgcgaagtccaatccacttgcttccgtccgaagcgctgctgtagctgcaacggtgttcggtagcaacgtcgttagtaacagcacgcgatgtgatcgctgtaaaatgttcatgagcacgagctgcgtgttggcctgctgctgtttataaaccgtgcgtgtcctagtac

SEQ ID NO: 23757 - protein, 408 aa, Panicum virgatum
  misc_feature: Ceres CLONE 1830252
  misc_feature (319)..(383): Pfam Name: bZIP_1 Pfam Description: bZIP transcription factor
  misc_feature: The sequence is a functional homolog of SEQ ID NO 1761 in the 10/374,780 US patent application
MASEMSKNVKVLDEQEVTSHQRGDQGVRARPGGAAAEGQEDQLARQPSIMSLTLEELQSSLCEPGRNFGSMNMDEFVANIWNAEEFQAATGGYKDDAPEQEQEATAAAATGVGGGNGGSGLVRQGSFALPPPLSRKTVEEVWAEINQGAPADAGAHPAPQAIVQPQVGSGGVAASGRQVTLGEMTLEDFLVRAGVVRGAFAAGHGQGQAVGMVPAAPMVHMQQGQLAAPMMYQVAPGNAVFPVMGDGMGYHNGYPGAAMAVVPPPPPSQCVAPAVSPGSSDGMSAMTQAEMMSCIGNGGMVRNGGGARKRDSPEDGCTEKTVERRQRRMIKNRESAARSRARKQAYTVELEAELNHLKEENARLKAEENTILLSKKKMLVEKMMEQARENVSAKKSGRGLRRCGSAMW

SEQ ID NO: 23758 - DNA, 665 bp, Panicum virgatum
  misc_feature: Ceres CLONE 1830274
  misc_feature: Encodes the peptide sequence at SEQ ID NO. 23759
accagctcgcactcgctcgctcactagcgcccctttccccttccttccttccacactctagtgactcctctccagctccatccgcccgtgccgctccacggcaccgccccgccatggcggtgagcaacaacatcacggcgtgcgtcaccttcctggtcctgctctgcacggtccccatcgccgccacgggcgtctggctcgcctcccgccacggcggcgccgggtgcgcgcgcctcgcccgctggcccgtcgccggcctcggcgcgctcctcctcctcgtcgcgctcgcgggcttcctcggtgcctaccgcaaccgcaggggcctcctcgcctgctacctcttcgccatggccgcgctcatcacgctcctcctcgcgctcctcgtcgccgccttcgccgtcgcgcacggatccgggacgtacccggtgcccgaccgcgcctacctggactaccgcctcgaggggtactccccgtggctgcggaggtacgtcgccggcgactcggaccggtgggaggggatccgggcgtgcgtcgccgggtcgggcacctgcacgaagctcgccatggacagatccttcatcgtgccggagcagttctacatgacgcacctctcgcccatcgagtccgggtgctgcaagccgccgacggcgtgcgggttcgcgtac

SEQ ID NO: 23759 - protein, 183 aa, Panicum virgatum
  misc_feature: Ceres CLONE 1830274
  misc_feature (3)..(183): Pfam Name: Tetraspannin Pfam Description: Tetraspanin family
MAVSNNITACVTFLVLLCTVPIAATGVWLASRHGGAGCARLARWPVAGLGALLLLVALAGFLGAYRNRRGLLACYLFAMAALITLLLALLVAAFAVAHGSGTYPVPDRAYLDYRLEGYSPWLRRYVAGDSDRWEGIRACVAGSGTCTKLAMDRSFIVPEQFYMTHLSPIESGCCKPPTACGFA

SEQ ID NO: 23760 - DNA, 1656 bp, Panicum virgatum
  misc_feature: Ceres CLONE 1830287
  misc_feature: Encodes the peptide sequence at SEQ ID NO. 23761
gcagcagcctcgcgcagtccgcccgcccggccgcggacgcaatgccgctggcgctcgcgctcgcgcagctgcaggacctgcgggagcgcatctccgaccgcctccgcccgtggagccgctccgcgcagttctgggtccgcgccgcggacatctacaccagctacaaggtgtgtcagctgcgggcggggttcgtcaaggatgaggaggagcgggaggccatgtgggagcagcagcacgagctcggcgcccagaagatgtactccctctgctacgagctcagaggactcttcctcaaggctgctcaaattctgggaaaacctgatttggccccaatggcttgggtgaagagactcgtcacgctctgtgatagggccccagccacaccatatgatgtggttagagatgttgttgagaaacagtttggaaagaacttcgatgacatatttgaattctttgatgtcgagcctgttgggtctgcttctattgcacaggtgcatcgggcaaggcttaaattatcaaagacagatgtcgctgtcaaggttcaacatccaggagctgaacatctgatgatggttgatatccggaacatgcaagcaatggccttgtttttgcagaagtatgacatcaactttgatctattctctgccaccaaagagatggaaaagcagatatgctatgagtttgactttgtgcgcgaagcaagggcaatggaaaggatacgagaattcctacgtgtcaccagtaagaaacctccggttatggtgcctcgtgtgattcctggaatggttagcagggaggttctggtaatggaattcgtcaaagggaccccaataatgaatcttggcaatgaaatggctaaaaggggcatagatcctggtggtaagattgcagcaatggcaaagcagaaaattttgtcagatctaactcttgcatatggtcaaatgatcttgaaggatggctttttccatgctgatccacatccaggaaatatccttatctgtaaggacacagaggtggctttacttgattatggacaagtgaaagaaatgccagaggatttacgacttgcttatgcaaatcttgtagttgcaatggctgatgatgatcttttgagagccgaagaaggtttcagggagctcggtatcaaaacaaggaccatagctgataacaagctagaagaattgtttcaattatcactgcgaatgtttgatacaagaatgccacctggtgtaactgttatgtcaccttttgccgatgattcttcacttactaaaattggagtggagagcttcccggaagagctattttcagtacttcgaacaatacagcttttgcgagggctgactgtagggatggggcttactttctcgtgcgctcagcaatggcgaccaattgctgaggaagcattgttaaaatctcggaggataagagcttcacaaccaaagcaaaagagaagttttctcaggcgactattttggtgaagtagagatagcgaccatcaaagaacatattatatgaacattctgtaatgaactggcagtatccagaagctcaagccttcgatttcacttcacagtacatttgtacacattcatttactttgggtgcgtgttatttgactcaatgatgttgatcatcaaaatgtttatttttggt

SEQ ID NO: 23761 - protein, 479 aa, Panicum virgatum
  misc_feature: Ceres CLONE 1830287
  misc_feature (125)..(245): Pfam Name: ABC1 Pfam Description: ABC1 family
MPLALALAQLQDLRERISDRLRPWSRSAQFWVRAADIYTSYKVCQLRAGFVKDEEEREAMWEQQHELGAQKMYSLCYELRGLFLKAAQILGKPDLAPMAWVKRLVTLCDRAPATPYDVVRDVVEKQFGKNFDDIFEFFDVEPVGSASIAQVHRARLKLSKTDVAVKVQHPGAEHLMMVDIRNMQAMALFLQKYDINFDLFSATKEMEKQICYEFDFVREARAMERIREFLRVTSKKPPVMVPRVIPGMVSREVLVMEFVKGTPIMNLGNEMAKRGIDPGGKIAAMAKQKILSDLTLAYGQMILKDGFFHADPHPGNILICKDTEVALLDYGQVKEMPEDLRLAYANLVVAMADDDLLRAEEGFRELGIKTRTIADNKLEELFQLSLRMFDTRMPPGVTVMSPFADDSSLTKIGVESFPEELFSVLRTIQLLRGLTVGMGLTFSCAQQWRPIAEEALLKSRRIRASQPKQKRSFLRRLFW

SEQ ID NO: 23762 - DNA, 644 bp, Panicum virgatum
  misc_feature: Ceres CLONE 1830294
  misc_feature: Encodes the peptide sequence at SEQ ID NO. 23763
aaactctcctcaacgttgcggtgttcttccgggaagctctgctgcaggtggggggtagccgtggaagctctgaggtggggggtggtggtgctggttgatgtcgatggcgcaggtgtactgtgactcggcggcagccgcggcggcggcggtggttgggccggaggccgaggcgagggcgagggcgcgcgccgagaggcggcgcccggcgggggaggccgggaggtggaagcacgcgccggcgccggcggcggccgggacggccgaggctgccacgaggaagcgacgcgtggaggccggggagctgctcgtggcgcggaagcacggggcggcctcggtggccggccgcacgaaggagatggaggacgccgtgtccgtgcgcgaggccttcgccgccggtggcgccgggaggtgcgacttctacggggtgttcgacggccacggctgctcgcacgtcgccgaggcctgccgggaccggatgcacgagctgctcgccgaggagctggccggcgagggcggccccgcgcagctggagcccgcggcctggaccgccgcgatggagcggtgcttcgcgcggatggacgccgacgtcgcctccgccggcgggcgcgccaccgccagctgccggtgcgacgcacacaagtgcg

SEQ ID NO: 23763 - protein, 180 aa, Panicum virgatum
  misc_feature: Ceres CLONE 1830294
  misc_feature: SWISSPROT Homolog: EC 3.1.3.16 Phosphoprotein phosphatase
MAQVYCDSAAAAAAAVVGPEAEARARARAERRRPAGEAGRWKHAPAPAAAGTAEAATRKRRVEAGELLVARKHGAASVAGRTKEMEDAVSVREAFAAGGAGRCDFYGVFDGHGCSHVAEACRDRMHELLAEELAGEGGPAQLEPAAWTAAMERCFARMDADVASAGGRATASCRCDAHKC

SEQ ID NO: 23764 - DNA, 662 bp, Panicum virgatum
  misc_feature: Ceres CLONE 1830340
  misc_feature: Encodes the peptide sequence at SEQ ID NO. 23765
atcgcttcactcccgcagcgaccaagaacccattcgaaaaacagagcagtagcagagcggagcagaggaggaagaggggcagccaagccatggagatgggagacagcttcgagtactactgggagatgcagcgcttgttagaatccgacgagctcaggtacgccctcgccgccgggcgcgacgccgccattgcttgcttcggggctcgacggagatgcgcggattgctgatttgcacgccgcaattgcagcgtctacctgaatggcgcgcaggaagacgcgctgtcctgctacgactccagctcgccggacgggtccttgtccaactcgtcctgggcgctggcgccggcggcgaccgcggcggacgacgccagggggcccggcgcggccgcggccgagggcggcgcggcggagggggcggccaagaacatcatcatggagcgcgaccgccggcgcaagatgaacgagaagctctacgcgctgcgcagcgtcgtgcccaacatcacaaagatggacaaggcgtcgatcatcaaggacgcgatcgagtacatccagcagctgcagacggaggagcggcgggtgctgcaggagctcgaggccggcggcggcgcgcggcgaatggacgagtacgggtacgacgagggcgcgctcctgcgggccgag

SEQ ID NO: 23765 - protein, 75 aa, Panicum virgatum
  misc_feature: Ceres CLONE 1830340
  misc_feature (1)..(43): Pfam Name: HLH Pfam Description: Helix-loop-helix DNA-binding domain
  misc_feature: The sequence is a functional homolog of SEQ ID NO 1195 in the 11/479,226 US patent application
  misc_feature: The sequence is a functional homolog of SEQ ID NO 538 in the 10/412,699 US patent application
  misc_feature: The sequence is a functional homolog of SEQ ID NO 108 in the 11/375,241 US patent application
  misc_feature: The sequence is a functional homolog of SEQ ID NO 2888 in the 10/374,780 US patent application
  misc_feature: Useful for making plants with modulated biomass
  misc_feature: Useful for making plants with modulated flowering time
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: Useful for making plants with altered lignin content
  misc_feature: The sequence is a functional homolog of SEQ ID NO 1177 in the 11/479,226 US patent application
  misc_feature: The sequence is a functional homolog of SEQ ID NO 528 in the 10/412,699 US patent application
  misc_feature: The sequence is a functional homolog of SEQ ID NO 148 in the 10/225,068 US patent application
  misc_feature: The sequence is a functional homolog of SEQ ID NO 216 in the 10/374,780 US patent application
  misc_feature: The sequence is a functional homolog of SEQ ID NO 228 in the 10/225,066 US patent application
  misc_feature: The sequence is a functional homolog of SEQ ID NO 56 in the 10/286,264 US patent application
  misc_feature: The sequence is a functional homolog of SEQ ID NO 714 in the 10/412,699 US patent application
  misc_feature: The sequence is a functional homolog of SEQ ID NO 862 in the 11/435,388 US patent application
  misc_feature: Useful for making plants with modulated cold sensitivity
  misc_feature: The sequence is a functional homolog of SEQ ID NO 118 in the 10/374,780 US patent application
  misc_feature: The sequence is a functional homolog of SEQ ID NO 752 in the 10/225,066 US patent application
  misc_feature: The sequence is a functional homolog of SEQ ID NO 2036 in the 10/374,780 US patent application
  misc_feature: The sequence is a functional homolog of SEQ ID NO 898 in the 11/479,226 US patent application
  misc_feature: The sequence is a functional homolog of SEQ ID NO 954 in the 10/374,780 US patent application
  misc_feature: The sequence is a functional homolog of SEQ ID NO 958 in the 10/374,780 US patent application
  misc_feature: The sequence is a functional homolog of SEQ ID NO 953 in the 10/374,780 US patent application
  misc_feature: The sequence is a functional homolog of SEQ ID NO 957 in the 10/374,780 US patent application
  misc_feature: The sequence is a functional homolog of SEQ ID NO 955 in the 10/374,780 US patent application
  misc_feature: The sequence is a functional homolog of SEQ ID NO 959 in the 10/374,780 US patent application
MERDRRRKMNEKLYALRSVVPNITKMDKASIIKDAIEYIQQLQTEERRVLQELEAGGGARRMDEYGYDEGALLRA

SEQ ID NO: 23766 - DNA, 611 bp, Panicum virgatum
  misc_feature: Ceres CLONE 1830351
  misc_feature: Encodes the peptide sequence at SEQ ID NO. 23767
gtcactcgccacaaccgaactctccaaccaattcgcacgccacgccacggagagctgagctgagctgcgcatggcgaggtccatggagagcggcgacggcggcggcaatgggggcggcggcgggctggtggtgacggagctgagccacatcaaggagctggtgcggcagctggaggcgcacctcggcggctccgacgagctctgcaggcacctcgccacggagatcttctccctcaccgagcgctccatcggcatcatcaccgccgcctcctcctcctccggcctcgacgcccggaagcgggagtacgccgggctcgcctcgcccctcccggccacgcccaccagcgacgtcgccgacgggcctttcaggagcaccaagaagaggaaggtgatggagaagaggaagcagcaggtgcgcgtgagctcgccccgcggcggcgccggcgagaacccggtggacgacggccacagctggcggaagtacggccagaaggagattcttggagccaagcacccaaggggctactaccgctgcacgcaccgccactcccagggatgcttggcgacgaagcaggtgcagcgcaccgacgaggacccggcgctcttcgacg

SEQ ID NO: 23767 - protein, 180 aa, Panicum virgatum
  misc_feature: Ceres CLONE 1830351
  misc_feature (129)..(180): Pfam Name: WRKY Pfam Description: WRKY DNA -binding domain
MARSMESGDGGGNGGGGGLVVTELSHIKELVRQLEAHLGGSDELCRHLATEIFSLTERSIGIITAASSSSGLDARKREYAGLASPLPATPTSDVADGPFRSTKKRKVMEKRKQQVRVSSPRGGAGENPVDDGHSWRKYGQKEILGAKHPRGYYRCTHRHSQGCLATKQVQRTDEDPALFD

SEQ ID NO: 23768 - DNA, 691 bp, Panicum virgatum
  misc_feature: Ceres CLONE 1830358
  misc_feature: Encodes the peptide sequence at SEQ ID NO. 23769
tgggtatttataatgtagcatagtacagttcattacggctatttcttatgactaatcttttgttaatactaccaggttactgtattccagcagcctcattatctgcagaactttgtccaatcaacattcaatgcccttcctgctgatcaagtaaaaggtgcgaccattgttgtctctggtgatggccgctatttctcgaaagatgctgttcagatcataacaaaaatggctgctgccaacggagtaagacgtgtttgggttggactaaacagtctcatgtcaacccctgctgtatctgctgttatccgtgaaagaaccggtgcagatggatcaaaggctaccggtgccttcatcctgacagcaagccataacccaggtggtccgactgaggattttgggatcaaatacaatatgggaaatggtgggcctgcacctgaatccgttactgatagtattttctctaatacaaagacaatctctgaatacctcatcactgaagaccttccagatgttgatatttctgttgctggtgtcactagcttcagtgggcctgaaggcccctttgatgtggatgtctttgactccagtgtagattacataaagttgatgaagtcaatctttgactttgaagcaataaaaaagctgctgacctctccaaagtttacgttctgctatgatgccctccatggtg

SEQ ID NO: 23769 - protein, 155 aa, Panicum virgatum
  misc_feature: Ceres CLONE 1830358
  misc_feature (1)..(88): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MAAANGVRRVWVGLNSLMSTPAVSAVIRERTGADGSKATGAFILTASHNPGGPTEDFGIKYNMGNGGPAPESVTDSIFSNTKTISEYLITEDLPDVDISVAGVTSFSGPEGPFDVDVFDSSVDYIKLMKSIFDFEAIKKLLTSPKFTFCYDALHG

SEQ ID NO: 23770 - DNA, 676 bp, Panicum virgatum
  misc_feature: Ceres CLONE 1830377
  misc_feature: Encodes the peptide sequence at SEQ ID NO. 23771
attcccctttcgccaaatccacgcgaccgcgcgagcgcagggagcaccgccaccgccgaggggattggcccagccgagcgaaccctccgagtctcggcggcaatggcgctctccgacctctcccgcgagtcgctcctcccgagcttcctctacgcccctgcggcggcgaggtccttcgccggcgcctcccgcctccccgcctcgcccgccgcggcgccggggggcgcgggcgcgccgtcgttcccgatccaggcgcccaaggagaagatcgagatgtactcgccggcgttctacgccgcctgcacggccggaggcatcgccagctgcgggctcacccacatggccgtcacgccgctcgacctcgtcaagtgcaacatgcagatcgatccagcaaaatacaagagcatcacatctgggtttggaattctggccaaggagcaaggagtgaggggtttcttcaggggatgggtgcccaccctgcttggttacagtgctcaaggagcctgcaagtttggattctatgagttcttcaagaaatactactcagatattgcagggcctgagtatgctcagaagtacaagaccttgatataccttgctgggtcggcttctgctgaggtgattgctgatgtggctctctgcccctttgaagctgtgaaggtccgtgtgcagacgc

SEQ ID NO: 23771 - protein, 191 aa, Panicum virgatum
  misc_feature: Ceres CLONE 1830377
  misc_feature (63)..(151): Pfam Name: Mito_carr Pfam Description: Mitochondrial carrier protein
MALSDLSRESLLPSFLYAPAAARSFAGASRLPASPAAAPGGAGAPSFPIQAPKEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQT

SEQ ID NO: 23772 - DNA, 1115 bp, Panicum virgatum
  misc_feature: Ceres CLONE 1830393
  misc_feature: Encodes the peptide sequence at SEQ ID NO. 23773
gttcggcttcggtcctaccgccgccgcgtcgtgcgaggagaagaatcgaaccgcttcccttccccaccccttgacggcctctccggagtattccctccactgcaccggtctcgcgtcgtctcccctctctctctccgtctccgactccgccagcgagtcctggattcccgcatggacgccggcggaggtgcggaggccgccgccaacggcgggatcgagggctccgccgacccctgcagctcaggcaccgccggtgggcacaggttctcggtccaccagatcgccggcggcgggaaagctgctgatatcatcttatggaggcgagggcgtgttacatttggtgttatatttggtgctactttggcatggttgttgtttgagaagtccagactgtcattcttgactatctgctgtgatatatttctcatcttaataattgtgcagttcctaagggttaaaatagctggattgctaaataggcagcctaggtcactacctgagttagttttatcagaggagatggttagcaacgctgcatcttcattccgcgtcaaagtcaacaacatgctaatgatagcgcatgacattactctcggcaaagacttccggctctttttccaggttgtgcttgtactttggctattatctgtactaggcaatttcttctcttctatcactcttgcttatgtaggaaccattgctttggtcacaatacctgcattgtacaacaaataccaggggcacgttgataggtatgcgggaatggtccaccggaacatatcaaggcagtacaagatagttgacgaaaatgtgatcagtagactaccgagaagctttatcagagataaagaagactgatacttgaatgaagctagtcaagtaattttgttaccataagcagggagaaactaaagatttaggaaaataggaaaagaaagcctgctgtagataccgttgcaatgtactcttgagcaataaggtttgtgacgaaaagcatgcagaaatttgtaactagttgtacagctttcggtcagcttttttgcaacaaactgggcaaaaggtcgttgtgtaacccaagcagttaccattggaatgtgaaatgaagtggtttgcat

SEQ ID NO: 23773 - protein, 228 aa, Panicum virgatum
  misc_feature: Ceres CLONE 1830393
  misc_feature (43)..(226): Pfam Name: Reticulon Pfam Description: Reticulon
MDAGGGAEAAANGGIEGSADPCSSGTAGGHRFSVHQIAGGGKAADIILWRRGRVTFGVIFGATLAWLLFEKSRLSFLTICCDIFLILIIVQFLRVKIAGLLNRQPRSLPELVLSEEMVSNAASSFRVKVNNMLMIAHDITLGKDFRLFFQVVLVLWLLSVLGNFFSSITLAYVGTIALVTIPALYNKYQGHVDRYAGMVHRNISRQYKIVDENVISRLPRSFIRDKED

SEQ ID NO: 23774 - DNA, 1064 bp, Panicum virgatum
  misc_feature: Ceres CLONE 1830395
  misc_feature: Encodes the peptide sequence at SEQ ID NO. 23775
gcgtataaaatcaccttgcagcaggagcaagctaggcaaatggagatgcaactctccctggcctcatggcctctcctcctcgtcctgctcctacccctcgtctgcttgctatacctgcgccagggtcacaagaggaagcagcagcagcctcgccctcacgcatcagacgatgacctcaaggcctacccgatcctcggcaggtttcctcacctggccaggaacggccaccgccttgtcgagtggtccgtcgaggttgcgaagcagagcccgacgacgcggaccatggccttcaaagccccgggccttcccggcgtcgtcatcaccgccaacccggacaacgttgagcacatagccaaggcgaacttcgccaactaccccaagggcgaattccaggcgtcggcgctcgaggacttcctcggccacggcatcttcaactccgacggcgagcagkggctgtggcagcgcaaggcggccagcttcgagttcagccagcgctcgctgaggaagttcatcgtcgacaccgtccagtccgaggtcgtcgggcggttcctgccgctgctcgagcaggccgagcgccatgggcgcactctggacatgcagcacgtcttcgagtgcttcgccttcgacaacatctgccacgtggccttcggcgacgaccccggctgcctagccaaggagagcgcggcggcaccccagggcccggagttcgcgcgcgcctttgactacgtggagggcgccatcctgggccggtttgctgtgccgggctttctgtggcgtctcaagagggcgctcaacatggagcccgagaagcagatccgtgaggcgctcgacgtcgtccacggctacgccgacaagatcatccggaggtgccgggagacaagggaggccgccgggccggagagcaggggcgacttcctcgcgcacatcgccgctcgcggcgacctcagcgacgagagcctccgggacgtcgtcaccaacctcctcctcgccgggcgcgacacaacgtcagctgcgctgacatggttcttctggctggtctccggccggcctgacgtcgagagcaa

SEQ ID NO: 23775 - protein, 339 aa, Panicum virgatum
  misc_feature: Ceres CLONE 1830395
  misc_feature: SWISSPROT Homolog: EC 1.14.13.15 Cholestanetriol 26-monooxygenase
  misc_feature (136)..(136): Xaa is any aa, unknown, or other
MQLSLASWPLLLVLLLPLVCLLYLRQGHKRKQQQPRPHASDDDLKAYPILGRFPHLARNGHRLVEWSVEVAKQSPTTRTMAFKAPGLPGVVITANPDNVEHIAKANFANYPKGEFQASALEDFLGHGIFNSDGEQXLWQRKAASFEFSQRSLRKFIVDTVQSEVVGRFLPLLEQAERHGRTLDMQHVFECFAFDNICHVAFGDDPGCLAKESAAAPQGPEFARAFDYVEGAILGRFAVPGFLWRLKRALNMEPEKQIREALDVVHGYADKIIRRCRETREAAGPESRGDFLAHIAARGDLSDESLRDVVTNLLLAGRDTTSAALTWFFWLVSGRPDVES

SEQ ID NO: 23776 - DNA, 661 bp, Panicum virgatum
  misc_feature: Ceres CLONE 1830395-R
  misc_feature: Encodes the peptide sequence at SEQ ID NO. 23777
gggacgacgttcatcaccttcgacgagctccgggagatgcactacatccaggccgccatcaccgagtcgatgcggctgtacccgccggtgcccatgggcatgcactactgcaagcaggacgacgtcctgccggacggcacgttcgtcgggaaagggtggtcggtgaaccactccgtgtacgcgatgtcacggctggaggagctgtggggcaaggactgcgaggagttcaggccggagcggtggctccgagaggacggcacgttccagccagagagcccgttcaggtacccggtgttccacgcggggccaaggatgtgcctcggcaaggagctggcctacatccagatgaagtccatcgtctcctgcgccttcgagaggttcagcttcaagtaccgtggcggcgatgagcacccggggctggaccacatcatcacgctaaggatgaaaggcggtttgccgatgcaagtgaccaagcagaggccggggccagaggcagaggcagaggcagggtaattaaactgttgtacctgtgctactactattttgcatgtaacattcacagcctccgatgaaggcacatccatctcgagcccagtctttcggttgttattgctttgttattcttagataataagaaataaagataaaatacgtgggtggt

SEQ ID NO: 23777 - protein, 170 aa, Panicum virgatum
  misc_feature: Ceres CLONE 1830395-R
  misc_feature: SWISSPROT Homolog: EC 1.14.14.1 Unspecific monooxygenase
GTTFITFDELREMHYIQAAITESMRLYPPVPMGMHYCKQDDVLPDGTFVGKGWSVNHSVYAMSRLEELWGKDCEEFRPERWLREDGTFQPESPFRYPVFHAGPRMCLGKELAYIQMKSIVSCAFERFSFKYRGGDEHPGLDHIITLRMKGGLPMQVTKQRPGPEAEAEAG

SEQ ID NO: 23778 - DNA, 1543 bp, Panicum virgatum
  misc_feature: Ceres CLONE 1830396
  misc_feature: Encodes the peptide sequence at SEQ ID NO. 23779
aaatcatccacctccctcgtcttcacttcctccacccctttcctcgccgagctcgagactccgcgtgctaatggcggcggcggcggacctcacggggaccaagcgggtcatggcctgcgcgctatgcaagcacctcaacgtcgatcccagcacggtatccaatacaactattgaacagagtgatattgcaagtgtgttttcacatattgtgaaatcatctcaggatgaggtgatgaagtgggtaaaattttccagtgattttgctggaagtgatggaaaacagcatgcattgcttgataatctgaatcaggatttgtcccagaagtctgtactgcttggtgatggtcttaaaccatcagttgctgatatcgtcgtgtttgctactgttcaagctttcgtgactcgtgtcagcgacagtgagttgcagaaatttcctcatgtatggcggtggatggactacattcagaacattgttgattttggtacaacttcgcaaaagataaatctggccaagtctgtctttgatccaccttctcatccgaagaaagctgataaagtagacactgaatcaagttcaaagaaagctgtttccggacagaagaatgctgacaagtcaaatggaagcactgactcaaagaaacctgcaggggagactaaggctcctgaaaaggaaactactgccgcgaaagacaacaaaacctctggtgagaagaagaaagataagtctgcaggaaaaactgcagagaaagcttcagagaaagctccggagaaaactgcagacaaggattcagagtgcaatataagtatcctgaatatacaggttggccttatccgtaaagcatggaagcatccatctgctgacagtcttttggttgaggagatagatttgggagatggtaatgtgcgtcaagttgttagtggtcttgcaaagtactgcagcccggatgatcttactaatcggcatgttgtcttgatcacgaatgtgaagcctgggaagctgagggatgtcatgtctgctggattggttctatgcgcttcaactgaagatcatacggctgtcgagcctttgattcctccagaaggagccaagattggagaacgcatttcatttgctgggtttgatgggaagcctgaagatgttctaaatccaaagaaaaagcagctggacaagattaccccgcatcttcgtaccgacgaaaatggaattgcaacattcaaagggataccctttactacatcagctggtccatgcaggtcttcgattcgcaacggaaatgttaagtgatgagctcatcaggcatgcagcatgctgattccagacattgatgtggtagaccacatgcgaggtggctgtaccattttgacttgcatcttgttttgcccatacaaaatgtgccaaacttcatctgaatcaattttctaatctctacaagtggctgagcagatagtttttgaatgtttagtatatacaatcaaatatccttgagttgccacaggcgtggtgccctgcgttggccaagagatctgggatggttttcttatc

SEQ ID NO: 23779 - protein, 404 aa, Panicum virgatum
  misc_feature: Ceres CLONE 1830396
  misc_feature (249)..(344): Pfam Name: tRNA_bind Pfam Description: Putative tRNA binding domain
  misc_feature: SWISSPROT Homolog: EC 6.1.1.1
MAAAADLTGTKRVMACALCKHLNVDPSTVSNTTIEQSDIASVFSHIVKSSQDEVMKWVKFSSDFAGSDGKQHALLDNLNQDLSQKSVLLGDGLKPSVADIVVFATVQAFVTRVSDSELQKFPHVWRWMDYIQNIVDFGTTSQKINLAKSVFDPPSHPKKADKVDTESSSKKAVSGQKNADKSNGSTDSKKPAGETKAPEKETTAAKDNKTSGEKKKDKSAGKTAEKASEKAPEKTADKDSECNISILNIQVGLIRKAWKHPSADSLLVEEIDLGDGNVRQVVSGLAKYCSPDDLTNRHVVLITNVKPGKLRDVMSAGLVLCASTEDHTAVEPLIPPEGAKIGERISFAGFDGKPEDVLNPKKKQLDKITPHLRTDENGIATFKGIPFTTSAGPCRSSIRNGNVK

SEQ ID NO: 23780 - DNA, 1147 bp, Panicum virgatum
  misc_feature: Ceres CLONE 1830405
  misc_feature: Encodes the peptide sequence at SEQ ID NO. 23781
aactcgtttccgcctaaaattacacttcccctgccctcccctcttctcctccggccgcggctcgaacttaaaccctagagccgccccccggtcgctctcgcgaccccaaatctcaaatcacccggagcgagcacacgcgcgaagggtttcgctcatggctcgcgtctacgtggggaatctggatccgcgcgtcacggcgcgggagatcgaggacgagttccgcacgttcggggttctgaggagtgtatgggttgctagaaaaccaccaggatttgccttcattgactttgatgaccgcagggatgcacaagatgccattcgtgaactggatggtaagaatggatggagggttgagctgtcaaccaaagctggtggtggacgtggccgagaccgtaatggttctgatatgaagtgctatgagtgtggtgaaactggtcactttgcacgtgaatgtcgcttacgaattggttccggaggcttgggtagtggaagacgccgaagccgaagtcctagatatcgcagtcgtagccgcagccgcagccgcagcccaaggtatcggaggagcccaagctatggcagaaggagctacagcccacgggatcgttctcctaggaggcggagttacagtaggtctccacctcctcgtgcacggagtctcagtaggtcgcctccacccgctcgtgcacggagtctcagcaggacgccgccacccccgcctccgagaaacaacagcaggtcgccaccagcaacccgagaactgagcaggtcgcctccgccaccacctgccagaaggagcaggagctatagcaggtccccagagcagcaaccccagcgcgatgaatccccatacggcaatgacgcctgagatccttagctgctccaagatgctgggaaaatgttaggggacccagcatgtttttcccgtccgcattggtacaactcctgtaattctaggattcatgagtcttgcacttcgtttcaatgttgtgtttcctgggaggacaccgctgctgatacaattgtggaggcaggagcctataacgtttctgtttcgagttttgactgggtgactttgggcgcttgtagctgtcgagacaaaatctggttcctgtgagatttgtattcttaggttgcttgttatttggac

SEQ ID NO: 23781 - protein, 236 aa, Panicum virgatum
  misc_feature: Ceres CLONE 1830405
  misc_feature (4)..(70): Pfam Name: RRM_1 Pfam Description: RNA recognition motif. (a.k.a. RRM, RBD, or RNP domain)
  misc_feature (85)..(102): Pfam Name: zf-CCHC Pfam Description: Zinc knuckle
  misc_feature: Useful for making plants with modulated flowering time
MARVYVGNLDPRVTAREIEDEFRTFGVLRSVWVARKPPGFAFIDFDDRRDAQDAIRELDGKNGWRVELSTKAGGGRGRDRNGSDMKCYECGETGHFARECRLRIGSGGLGSGRRRSRSPRYRSRSRSRSRSPRYRRSPSYGRRSYSPRDRSPRRRSYSRSPPPRARSLSRSPPPARARSLSRTPPPPPPRNNSRSPPATRELSRSPPPPPARRSRSYSRSPEQQPQRDESPYGNDA

SEQ ID NO: 23782 - DNA, 1906 bp, Panicum virgatum
  misc_feature: Ceres CLONE 1830413
  misc_feature: Encodes the peptide sequence at SEQ ID NO. 23783
aagccaagcaaacccaatggcggcggcgcttccctccctccgccgcctcctcgccctccgccgccaccgccgcctcctcctctccacgaccacgacccccaaccccgcttcccctgaggccgtgatctacaacatccacaacctctccagtgacccctcccgcgcgcttgccttgttccgccgctccgccgccgccggccagcccgtctgctccgccgcatacaacatcatgctccgcaccctcgcctctgacccgtcttccgcccagcgccacttctggccctttctccgcgagatgcacgaggctggccactccgtcgaccagggcacctacctcgccgccctcgcatccttcaagaaggccagcctctccgccgattacgccgccctcgccgcgcactacagcaagtcccgggaagaggccaagggcggcaccaccacctccgccgccgccgaggccgtcctggagctcgacggcgccgacctccatgcgaagctgggcgccatcggcctccttccgctcaccgagaccgccgtctccaaggtgctgcgggagctgaggggccatcccaccaaggcgctcgccttcttccgatgggctgggcgtcagcagggctacaagcacgcctcggtagcctacaatgccatggccagggtgctcgggcgggaggtatccatgcctgagttctgggacctcatccaggaaatgaaggccgccggcgtccacgtggatatcgacacctacgtcaagctctccaggagcttccagaaccggcatatgctcaaggaggctgtggagctctacgagctcatgatggatggtcctttcaagccagcccagaacgatgggccgctcatcatcaggcgtatctcgctgtctccgtcgccggaccttgaccttgtcaatcgggttgtcacaaagtttgaggccgtgtgggacaaaaagaccaagatgttgtttgatgggattcacagggcgctcaccagcaatgggaggtttgacgaggctgcagaggttgtgcagaggatgagagcgcaaggccaccagcctgacaatgttacatacagccaactggtgtatggtctctgcaaggctcgcaggttggatgatgctcgcaaagtatttgatcaaatggaggctgaaggctgcgtcccagatttgaagacttggaccgtgttgatccaagggcactgtgcggctggagatgtggacacagctctgcagtacttgacggagatgatagacaacaacttggatgcagacgccaatttgctggatgtgatggtcagaggtctgtgtggcaatcaaaaggttgatgctgcctacactttgtttgttgagatggtggacaaggctcacctgaggccttggcaaggcacttacaagcgcctaattgatgacttgctgaggataaagaagcttgacgaggcactggcccttctgaggtcaatgaaagtcctcaggtttccacctttcacggaaccattccctccttacattgctaagcacggtgcggttgaagacgcaagggactttctcaaggccttgacagtgatgaatacttgcccggcacctgctgcctacctgcatgttctcaagtcgttcttcgcagaggggagatattctgaggctcaagatttactttacaaatgccctatccacatccgcaagcaccctcacgtctctgaattgtttgaatctatcaaagttgagggtgcttctggactggagttgaagcaagctatggtcggtgagattgtgttgaaagctaaagcttagccttttgtcattgttagagtaaccttggtttggtatttatagtttgatgagaataagtagacgaggtttatcttttaccagatatcttttaaggatgtaccactcaactaagttgaatttcaggat

SEQ ID NO: 23783 - protein, 587 aa, Panicum virgatum
  misc_feature: Ceres CLONE 1830413
  misc_feature (348)..(382): Pfam Name: PPR Pfam Description: PPR repeat
  misc_feature (383)..(417): Pfam Name: PPR Pfam Description: PPR repeat
MAAALPSLRRLLALRRHRRLLLSTTTTPNPASPEAVIYNIHNLSSDPSRALALFRRSAAAGQPVCSAAYNIMLRTLASDPSSAQRHFWPFLREMHEAGHSVDQGTYLAALASFKKASLSADYAALAAHYSKSREEAKGGTTTSAAAEAVLELDGADLHAKLGAIGLLPLTETAVSKVLRELRGHPTKALAFFRWAGRQQGYKHASVAYNAMARVLGREVSMPEFWDLIQEMKAAGVHVDIDTYVKLSRSFQNRHMLKEAVELYELMMDGPFKPAQNDGPLIIRRISLSPSPDLDLVNRVVTKFEAVWDKKTKMLFDGIHRALTSNGRFDEAAEVVQRMRAQGHQPDNVTYSQLVYGLCKARRLDDARKVFDQMEAEGCVPDLKTWTVLIQGHCAAGDVDTALQYLTEMIDNNLDADANLLDVMVRGLCGNQKVDAAYTLFVEMVDKAHLRPWQGTYKRLIDDLLRIKKLDEALALLRSMKVLRFPPFTEPFPPYIAKHGAVEDARDFLKALTVMNTCPAPAAYLHVLKSFFAEGRYSEAQDLLYKCPIHIRKHPHVSELFESIKVEGASGLELKQAMVGEIVLKAKA

SEQ ID NO: 23784 - DNA, 558 bp, Panicum virgatum
  misc_feature: Ceres CLONE 1830424
  misc_feature: Encodes the peptide sequence at SEQ ID NO. 23785
atccacaagagaagaagaaacaagcctttagcaatactctcttctcttgtaacatagcgcagcaaaggttacttacatggcaacttccatgggttgcctcttcttgctctgccttgtttctcccctcctccttgccagtgccgtccacggccacccatggggcggcttgttccctcagttctacgaccattcatgccccaaggcgaaggagattgtgcagtccattgtagcacaggctgtggccaaggagaccaggatggcggcatccttggtcagactgcatttccatgactgctttgtcaaaggctgtgatgcatccgtgcttttttataacagcagcagcatagtcagtgagaaagggtctaactccaaccggaacttttttttttggcttgaggtggtcgaccagatcaaggccgctctcgaggctgcctgcccaggcactgtctcctgcgccgacatcctcgcccttgcagcccgtgactcaactgtcctggttggtggcccatactgggatgtgccacttggccggagggattcgctcggtgcaagcatcca

SEQ ID NO: 23785 - protein, 156 aa, Panicum virgatum
  misc_feature: Ceres CLONE 1830424
  misc_feature (43)..(156): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated phosphate use efficiency
MGCLFLLCLVSPLLLASAVHGHPWGGLFPQFYDHSCPKAKEIVQSIVAQAVAKETRMAASLVRLHFHDCFVKGCDASVLFYNSSSIVSEKGSNSNRNFFFWLEVVDQIKAALEAACPGTVSCADILALAARDSTVLVGGPYWDVPLGRRDSLGASI

SEQ ID NO: 23786 - DNA, 531 bp, Panicum virgatum
  misc_feature: Ceres CLONE 1830427
  misc_feature: Encodes the peptide sequence at SEQ ID NO. 23787
aaaccattcccctccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgtcgtcgactgcctggcgcgcgtgccccacgcgtcccaccgcgcgctgcgccgtgtctgccgcggctggcggagcgccgccgccgcgcccgccttcgccgcggcgcgcgccgccgcgggtgccgacgacgacctcgtctacatgctgcagttcgggaacccctccgccgccgccgaggccgacgaccgccggccctaggacggaggcgcgccgcccaccgcgcccgcctacggggtcgctgtctagaacgcgaccgcgggcgagtggcgccgggagcgcggcacgccccccgtgccgcccgtgtctgcgcctggtgccgcggctggcactccgcggtcccgtgctcgggggctgggacccgggccccgtcgagcccgac

SEQ ID NO: 23787 - protein, 89 aa, Panicum virgatum
  misc_feature: Ceres CLONE 1830427
  misc_feature (15)..(62): Pfam Name: F-box Pfam Description: F-box domain
MRSPRGGGRAHEHVDLIPGIPDDVVVDCLARVPHASHRALRRVCRGWRSAAAAPAFAAARAAAGADDDLVYMLQFGNPSAAAEADDRRP

SEQ ID NO: 23788 - DNA, 704 bp, Panicum virgatum
  misc_feature: Ceres CLONE 1830430
  misc_feature: Encodes the peptide sequence at SEQ ID NO. 23789
aaaagagccactcgttggtgtcctgggagtggggagtggcagccagtagcgtgagagctagcgagcagggttcaatatgggttccaggttcgcactactgtgcctccttggagtgctgggagcatcacctgccattgctgactccggcatctactaccagctcgctcttatgtggcccggagcgtactgcgagcagaccagcgccgggtgctgcaagccgacgaccggcgtgtcgccggcgagcgacttctacgtctccggcttcaccgtctacaacgcgacgaccaacgctccggtgaccggctgcaacaacgctgctcctttcgaccctaacgagggcctgtaccagtactggagcagcatcaagtgccccagcaacaacggcaagaaaaactggaagaacgcctggaagcagtccggcgcctgctccggcctcgaggagaaggactacttcgaggccgccctctacttccgcagccggatcaacccgctggtccgcctcaaggcccagcacatcgagccggacttcgggctgtacggcgtgaaggcgatcaagaacgtgttcaaggcgggcatcgccgcggagccggtggtccagtgcagcaagggccccttcgacaagttccagctgtaccagctctacttctgcgcggcggagagcggcaagttcatcgactgcccggcgccgaagcagtacacctgct

SEQ ID NO: 23789 - protein, 209 aa, Panicum virgatum
  misc_feature: Ceres CLONE 1830430
  misc_feature (26)..(206): Pfam Name: Ribonuclease_T2 Pfam Description: Ribonuclease T2 family
  misc_feature: SWISSPROT Homolog: EC 3.1.27.1 Ribonuclease T(2)
MGSRFALLCLLGVLGASPAIADSGIYYQLALMWPGAYCEQTSAGCCKPTTGVSPASDFYVSGFTVYNATTNAPVTGCNNAAPFDPNEGLYQYWSSIKCPSNNGKKNWKNAWKQSGACSGLEEKDYFEAALYFRSRINPLVRLKAQHIEPDFGLYGVKAIKNVFKAGIAAEPVVQCSKGPFDKFQLYQLYFCAAESGKFIDCPAPKQYTC

SEQ ID NO: 23790 - DNA, 521 bp, Panicum virgatum
  misc_feature: Ceres CLONE 1830438
  misc_feature: Encodes the peptide sequence at SEQ ID NO. 23791
aacaaagcttcagctagcttgcacaagagagtcttagcttggtgtggagagacgtgttagcatagccacgaaaagacagggagaggtggctatagctaggtagagagatagagagagaatggcaaggcaaggtgtagcctccatgttcgccatggcatttctcctcggggtctttgcatccatcccacaaagtgccgagtccatcggtgtgtgctacggcatgagcggccacaacctgccgccggcgagcacggtgatcagcatgtacaagtccaacggcctctcggcgatgcggctgtacgcgccggaccaaggcgcgctgcaggccgtgggcggaacgggcatctgcgtcgccgtcggcgcccccaacgacatgctctctggcctcgccgccagcccggccgcggcggcgtcctgggtgcgcaacaacatccaggcgtaccccttcgtatccttccgctacctgtgcgtggctcaagaagtcggaggcctcgcggcgcacggtctgtcgccggccaggg

SEQ ID NO: 23791 - protein, 134 aa, Panicum virgatum
  misc_feature: Ceres CLONE 1830438
  misc_feature (29)..(134): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
MARQGVASMFAMAFLLGVFASIPQSAESIGVCYGMSGHNLPPASTVISMYKSNGLSAMRLYAPDQGALQAVGGTGICVAVGAPNDMLSGLAASPAAAASWVRNNIQAYPFVSFRYLCVAQEVGGLAAHGLSPAR

SEQ ID NO: 23792 - DNA, 647 bp, Panicum virgatum
  misc_feature: Ceres CLONE 1830460
  misc_feature: Encodes the peptide sequence at SEQ ID NO. 23793
gttttcttcctctctgcggctccgggcgttttcttcctcttagcggctccggagatggcgggcgtcggctcggcggtgcggcggatctacctggctgtctacaattggatcgtcttcgccggatgggcgcaggtgctgtactacgcgattttggcgctgtggtcgagcggccatgaggctgtctacaacgctgtcgagcggccgctgcagttcgcgcaaacagccgccatcatggagattctgcatggacttgtaggtcttgtgaggtctccggtatctgctactcttccacaaattggatccaggttgttccttacatggggcatcttgtggagtttccctgagacccgtttccacattcttgtaactactctggtcataagctggtcgatcacagagatcattagatactctttttttgggatgaaggaagcacttggatttacaccttcatggctcctatggctgaggtatagcacctttatggtcttgtatcctactggtatctcaagcgaggttggcctgatttggattgccttaccatacataaagacatcggagaaatattgctttaggttgccgaacagatggaatttctcatatgattactactttacatccattcttgccctcatgatctatattcc

SEQ ID NO: 23793 - protein, 197 aa, Panicum virgatum
  misc_feature: Ceres CLONE 1830460
  misc_feature (55)..(197): Pfam Name: PTPLA Pfam Description: Protein tyrosine phosphatase-like protein, PTPLA
  misc_feature: Useful for making plants with modulated drought sensitivity
MAGVGSAVRRIYLAVYNWIVFAGWAQVLYYAILALWSSGHEAVYNAVERPLQFAQTAAIMEILHGLVGLVRSPVSATLPQIGSRLFLTWGILWSFPETRFHILVTTLVISWSITEIIRYSFFGMKEALGFTPSWLLWLRYSTFMVLYPTGISSEVGLIWIALPYIKTSEKYCFRLPNRWNFSYDYYFTSILALMIYI

SEQ ID NO: 23794 - DNA, 690 bp, Panicum virgatum
  misc_feature: Ceres CLONE 1830476
  misc_feature: Encodes the peptide sequence at SEQ ID NO. 23795
ctatgtgataaatggaaggaaatggtggaccagtggggctatggaccctagatgcaaagtcctgatattaatggggaaaacagatttttctgcacctaagcataagcaacagtcgatgatcttagtggacatcaacactcctggggtgcaaataaagcgaccgctattagtctttggttttgatgacgcacctcatgggcatgcggagattgtttttgagaatgtgcgtgtcccagcaacgaatatcctgcttggggaaggacggggttttgagattgctcaagggaggctcggtcctggaagactacatcattgcatgaggctaataggggcagcagaacgtggaatgggtctgatggttgacagggccttaagtaggactgcatttggaaagaggattgcacagcatggttcctttttatccgaccttgcaaagtgtcggattgagctggagcaggctagacttttggttctagaagcggccgatcaacttgaccgacatgggaacaagaaagcccgtggtatcctcgcaatggcgaaggttgcagctccaaatatggccctgaaggtccttgacatggcaatgcaagttcacggtgcagctggtgtctcttcggataccgtcttatcgcacctatgggcaactgccaggacactgcggatcgcagacggccctgatgaaatccatct

SEQ ID NO: 23795 - protein, 229 aa, Panicum virgatum
  misc_feature: Ceres CLONE 1830476
  misc_feature (87)..(229): Pfam Name: Acyl-CoA_dh_1 Pfam Description: Acyl-CoA dehydrogenase, C-terminal domain
  misc_feature: SWISSPROT Homolog: EC 1.3.99.3 Acyl-CoA dehydrogenase
YVINGRKWWTSGAMDPRCKVLILMGKTDFSAPKHKQQSMILVDINTPGVQIKRPLLVFGFDDAPHGHAEIVFENVRVPATNILLGEGRGFEIAQGRLGPGRLHHCMRLIGAAERGMGLMVDRALSRTAFGKRIAQHGSFLSDLAKCRIELEQARLLVLEAADQLDRHGNKKARGILAMAKVAAPNMALKVLDMAMQVHGAAGVSSDTVLSHLWATARTLRIADGPDEIH

SEQ ID NO: 23796 - DNA, 1359 bp, Panicum virgatum
  misc_feature: Ceres CLONE 1830485
  misc_feature: Encodes the peptide sequence at SEQ ID NO. 23797
attaaatatcccttacgcggccgtcccggccaggcggccaccagcatcagcgcgcggagtcttctacagttctacttcgcgcggcggatggcgtcggcgtcgggttcgggggctccagcagcggcggaggcgctccgccgccgccgcatcctctccagccggctctacctcgacgacgccccgagctccggctccaaggtcggtcacccgtccccgatcccttcctccgcaacctcgattcgctgcccgtgagtcgtaacaaccgcgcaggcaccagtggtctactcggcggcgtacgacatctcgttcaacgggatggagaagcagcacccgttcgattcgtcgaagtggggccgcgtgcgcagcttccttgaggacgcggggctcctccagagcgaccggatcgtcgagccgctcgaagcctcggaggatgatctgcttgtggtgcacccggggtcatacttgaacagccttaagagcagcgagaaggttgcccgcattgtagaggttccagcagtggcgctgctccctaacttgcttgttcagcaaaaacttctttatccattccggaagcaggtgggtggctctgttttatcagccaaactcgcactagaaaagggatgggctataaacattggtggtggcttccatcactgttcggcacaggaagggggtggattttgcgcctatgctgatatttccctgtgcatccattttgctttcgtctgtttaaatatctcaagagtaatgatcattgatctagatgctcaccaaggtaatggtcatgaaaaagacttcggcagtgagggaagagtttacactttggacatttacaattctggaatatatccttttgatcatgtggctaagaagtacattgatcaaaaggtcgagttagatagtgggacaaaaacagaagattatttggagaatcttgataaggctctcaaggtagcaaaaagtagatttcagccccagttgattgtgtataatgctggaactgatatcctagatggtgaccctttaggcagactaaaggttagtccagagggtgtggctattagagatgaaaagatttttagatttgcaaaggatcagaatattcctctactcatgctgacatcaggaggctatatggagtcaagcgctcgagttatagcagattcaattatcaacctatcgaagaaaaacctgatagatataggtacccgctgtatagaagttgaataatggtgataactatgtacttgcctgatggacgcacgccgtatatgagaaatgtaacactgattctgtacttgcacatgtcaaccagataaacggaaattgtttgatgtgaatgctttaaccctttgactt

SEQ ID NO: 23797 - protein, 304 aa, Panicum virgatum
  misc_feature: Ceres CLONE 1830485
  misc_feature (1)..(294): Pfam Name: Hist_deacetyl Pfam Description: Histone deacetylase domain
MEKQHPFDSSKWGRVRSFLEDAGLLQSDRIVEPLEASEDDLLVVHPGSYLNSLKSSEKVARIVEVPAVALLPNLLVQQKLLYPFRKQVGGSVLSAKLALEKGWAINIGGGFHHCSAQEGGGFCAYADISLCIHFAFVCLNISRVMIIDLDAHQGNGHEKDFGSEGRVYTLDIYNSGIYPFDHVAKKYIDQKVELDSGTKTEDYLENLDKALKVAKSRFQPQLIVYNAGTDILDGDPLGRLKVSPEGVAIRDEKIFRFAKDQNIPLLMLTSGGYMESSARVIADSIINLSKKNLIDIGTRCIEVE

SEQ ID NO: 23798 - DNA, 623 bp, Panicum virgatum
  misc_feature: Ceres CLONE 1830494
  misc_feature: Encodes the peptide sequence at SEQ ID NO. 23799
gcacacgcagagcgcgcaaggcgatccaattgaagaccgatcactgtccatggcatcggacaagctcctcgtcaccgccctcgcggccctgctggcggccgccggtggcgcctgcgcgagggagttgaggcggctctagatgccgtccgccgagatgatcgccgaagccggcggcatgccgctgatccacatgctccgcccgctgaggggctccggcggcacgcctgggccggcgagccagcgtgccgtgcgacagctggcggttcgccgtggagaccaactccgtgcgcggctggagcaccatccccgcccgctgctagagctacgtctgcaactacatgatgggcggccactacaggcgcgactccctcgctgtcttcgacgaggccgtctcctacaccgagagcatgcagctcgccagctacggttgggatgtctgggtgttcgacgtccacgagaccacgctctccaacctcccctactactccaagcacggcttcgggacctatccgtagaactgtacgctgttcggcgcgtacttgcaggatgctagcgcgccggcgctgccagagacgagacggctgtactacaggctgctagcactgtgcatcaagccggtgatc

SEQ ID NO: 23799 - protein, 57 aa, Panicum virgatum
  misc_feature: Ceres CLONE 1830494
  misc_feature: SWISSPROT Homolog: EC 3.1.3.2 Acid phosphatase
MGGHYRRDSLAVFDEAVSYTESMQLASYGWDVWVFDVHETTLSNLPYYSKHGFGTYP

SEQ ID NO: 23800 - DNA, 466 bp, Panicum virgatum
  misc_feature: Ceres CLONE 1830505
  misc_feature: Encodes the peptide sequence at SEQ ID NO. 23801
aagcaaagcaagcaccagaagctctctccctctcttgctgcctcccttctctcatttcaccttggtattacacgccactactacatcacagaaaacaagccttcctcccattggccatctctagctcacagcctactatctctaaccattgacattttgctgtattttccttaccactttgccgtagtaggtcgtggcaggcagtaagggtggtttcttgtaccaatggaggccaaggcttgagaaggccatgaacttgctccctctttgccctcctgattagccccttggcagccactgcgagatttgcagcggagcaggagatgcagcaaaggaagggagcaaacaaaacatggatctttccggggcgcacggggagctgccggtgccgatggcaatgcacggcggcggcggaggctcgccgtacctgggcctgcaccacgggcaccgccacgagcacccgcat

SEQ ID NO: 23801 - protein, 37 aa, Panicum virgatum
  misc_feature: Ceres CLONE 1830505
  misc_feature: The sequence is a functional homolog of SEQ ID NO 116 in the 10/714,887 US patent application
  misc_feature: The sequence is a functional homolog of SEQ ID NO 116 in the 11/435,388 US patent application
MDLSGAHGELPVPMAMHGGGGGSPYLGLHHGHRHEHP

SEQ ID NO: 23802 - DNA, 1561 bp, Panicum virgatum
  misc_feature: Ceres CLONE 1830506
  misc_feature: Encodes the peptide sequence at SEQ ID NO. 23803
gcaacccaattccgagcagacattcgccgccgccgccgcgacatcaccagagggcaccaagcgggggaatggcggagcggcgggtggcggagctgggtcccggcgcggcatgctgcggctggaaccactgtggccgccgcctcgcctccggcgccgtcgacggctccgtctccgtctacgactcgcacccgtccccctcctccaagtggcaggcccatgagcaggccattgtgaatgttgtctggcttcctccggagtatggggatgctgtagcttgtgcttgtgctgatgggacactgtctttgtgggaggaggttgctgaagacgatcaacttccagcctggagaaagcgtaaagtctttgagggtggcaactgtcgcatactaaatgtgcatttcggattacatctaggaagtctgaaaatggttactacatactcagatggccaaatcaagatctttgagctcttggattccttggaattggacaagtggcaacttcaggcagatttccaaaatgtgatggatccagtctctagatttggaaaacctgcatgcacttctgcatcaatagcatggaatccaagaagaagtgtaagccaacaagctagttttgcaattggcttcaattcagattctcctcatttcaactcttgtaagatttgggagtttgaagaagctcatcagcgctggcttccacttgttgagctcggtttacccgaggataagggagatagagtgtgtgctgtagcatgggctcctaacattggcagaccatatgagattattgcagttgcaaccaccaaaggaattgcaatctggcatataggtttgaacaccaactctgatggcagaccttcgacagagaatgttgctttactttctggtcacgatggcgagctggaatgggacatgggcggtatgacactcgcatccaccggaggtgatggcatggttaagctatggcaggccaacttggatggagtttggcatgagcaggctgttcttgactgtagtggatcacgtgtctagggattttcgttccccttgtgcaaacatgacactaggtgttgctgctcttgctgcagatttcttcggtgtttctttcttatctcgtgcgggcaattattgtgtggttagtttggcgctatcgaagtccggtccctcaacgacggcgcttgtattgctctaatgacatatcacgtgcgctatcacgtgctcgatgtaaacagtttttatggtgtaaccgaagcatgattgtaactcatcagtgctccggggaccaccattgagaggtccagaaaaggaaggcacgcaggtttgtattggaagttgcacaacgttcaccggaagctatcgctgggccgaggccgtccacttgttcacgcttccgctggatatgcatcatgtaacaactggtttgaaatgtttggcgtgtcctttcaaaataacactgatgtgcatgtgtcattaagagcagataaccctgttgctagctatgtgcggcgctatcacttttagatgtacaaactcccgttgctagtcaagttatttcagaatgc

SEQ ID NO: 23803 - protein, 320 aa, Panicum virgatum
  misc_feature: Ceres CLONE 1830506
  misc_feature (41)..(81): Pfam Name: WD40 Pfam Description: WD domain, G-beta repeat
MAERRVAELGPGAACCGWNHCGRRLASGAVDGSVSVYDSHPSPSSKWQAHEQAIVNVVWLPPEYGDAVACACADGTLSLWEEVAEDDQLPAWRKRKVFEGGNCRILNVHFGLHLGSLKMVTTYSDGQIKIFELLDSLELDKWQLQADFQNVMDPVSRFGKPACTSASIAWNPRRSVSQQASFAIGFNSDSPHFNSCKIWEFEEAHQRWLPLVELGLPEDKGDRVCAVAWAPNIGRPYEIIAVATTKGIAIWHIGLNTNSDGRPSTENVALLSGHDGELEWDMGGMTLASTGGDGMVKLWQANLDGVWHEQAVLDCSGSRV

SEQ ID NO: 23804 - DNA, 1608 bp, Panicum virgatum
  misc_feature: Ceres CLONE 1830512
  misc_feature: Encodes the peptide sequence at SEQ ID NO. 23805
atctctcaaacttgactgagcggactcaactgaatccgcaagccgaaccctcacgcctccttccatcgaaccggagcccgccgccccgctccgacgaagaagagaaggtcgccgtctcctcctcctccctccgtcggcaagggagtggcgatgtctacttcggtgcaatcgtcgtaccttcctgctaccactgagtcgatatcaaaggctcaggaggctaaggatgcttctgagtccatctcaatcctctaccgagtgctcgaagacccatcttcttcagcggatgcactgagagtaaaagagcttgccattacaaatctgacaaactacctcacgaaagaaaacagagctgaggatctcaggaatcttttgacccagctcaggcccttctttgcactgatccccaaggcaaagactgcgaagattgtgcgtggcatcattgatgctgttgccaagatacctggaacatctgagcttcagatctcactctgcaaggagatggtagaatggacccgtgcagagaagcgtaccttcctcaggcagcgtgtggaagcaaggctggcagcccttctgttagagaatcaggagtatactgaggcccttgcgctcctttctggtctcatcaaggaagtcaggagactggacgacaagttgcttcttgtggacattgaccttctggagagcaaactccatttctctctgagaaacctgccaaaggccaaagcttctctgactgctgcaagaactgcagccaatgccatttatgtgccaccatctcagcagggcaccattgatctgcagagtggaatccttcatgctgaagaaaaggactacaagactgcttacagctacttctttgaagcatttgaagctttcagttctctggaggaccctaaggccatcttcagcttgaagtacatgcttctgtgcaagataatggtcaatcaagctgatgacgttgcaggaatcatctcatcaaaggctggtctgaagtatctgggtcctgatgttgatgccatgaaagctgtggccgatgcctactccaaaaggtctctgaagtactttgaaactgccctccgagactacaaagcccagctggaggaagatcctatcgtccacaggcacctctcgtctctgtatgataccctactggagcagaacctctgcaggttgattgagccctactcgagggtggagattgcacacatagccgagatgattgagctgccaatcagccatgttgagaagaagctgtcccagatgatcctcgacaagaaattcgcggggactctggatcagggtgctggctgcctcatcatattcgaggataccaagaccgaggagatcttccccgccacgctcgagacaatcacgaatgtcgggaaggtcgtggacagcctttacatgagatcggccaagatcatggcttaaaatatgtgggtctactgtcagtttagctggccttagctctgcaagtgacaatgaattctgaatttgttctttttctttattcctttggagctgtgaaatgtttgagctacaattatgccatgttgctcatggacgagactgttgtttctgagtgatggaagagtatgttaacgcttt

SEQ ID NO: 23805 - protein, 426 aa, Panicum virgatum
  misc_feature: Ceres CLONE 1830512
  misc_feature (288)..(392): Pfam Name: PCI Pfam Description: PCI domain
MSTSVQSSYLPATTESISKAQEAKDASESISILYRVLEDPSSSADALRVKELAITNLTNYLTKENRAEDLRNLLTQLRPFFALIPKAKTAKIVRGIIDAVAKIPGTSELQISLCKEMVEWTRAEKRTFLRQRVEARLAALLLENQEYTEALALLSGLIKEVRRLDDKLLLVDIDLLESKLHFSLRNLPKAKASLTAARTAANAIYVPPSQQGTIDLQSGILHAEEKDYKTAYSYFFEAFEAFSSLEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPISHVEKKLSQMILDKKFAGTLDQGAGCLIIFEDTKTEEIFPATLETITNVGKVVDSLYMRSAKIMA

SEQ ID NO: 23806 - DNA, 1426 bp, Panicum virgatum
  misc_feature: Ceres CLONE 1830558
  misc_feature: Encodes the peptide sequence at SEQ ID NO. 23807
gttgtttgcttcccagttcttcttgctcctgtttcctgaagaactcttctttccctgcttctgttctgcccctaccttccattcaggttaacaatcccagagctcgaacctttctccggtggatccgcttcgccgccgtctccaatcccgcttctcgccggcgtttctttctttcagggaatctgaggaggggccgcgatgcggccgggcgccggagacgagctggcgcgggggtcttacgcgctgtaccacttcggcaccagcggctccgccgtcgccgctgccaccgtcgccacccacccgctcgatgttattaaagttaggcttcaaatgcagcatgctaggcaaagaggaaacttagttggaatgggaacaacatttacacaactggtcactagggaagggcctcggtcactctacctgggacttgcaccagcattgacgagatctgtcgtctatggtggccttcgattaggactgtatgaaccctgcaaacatgtatgcagttatgcctttggttcaacaaactttgcttttaagtttgcatctggaatcattgctggggcccttgcaactgctttaacaaatcccatggaggttttaaaggtgaggctgcagatgagtacaagtagtaccagtacaataggagagatgaggaaagttttagcacaggaagggctcaaagcactttggaaaggagttggtccagcaatggcaagagcaggctgcctcactgcatcacaaatggcaacctacgacgagtccaagcaggcattaatgaagtggacacctcttgaagaaggttttcaactacatctcatgtacagtgaagtctctgttctacattttgatgtctattcttcaatgaaaacatgaaatgaatggactgttaatctttatctgcttggaagctcgagttgcatagctggaacagctggtactcttgtgaccgcacctgtagacatggtcaaaacacggctaatgctgcaacaggagaccaaaggtgccagagtatacaggaatggattccattgtgcttaccaggttgtggtgacagagggtgtaaaatcactttataaaggtggatttgccacctttgcaagattaggccctcagacaacgatcaccttcatcgtgtgtgagaaactgcgcgaactagcagggatgactgctatctaataccacctaaaattgcatattcgttggtccaacagttggaggacatccaccaactgtgagtttttttgagggagaagataagcacacatagggcatttcaggcttgggaagtccaaactccttccagatttatattactttattctaaattttgaaatggtgtgaattgtacgtatatgggtatattttatatacctgacatacctagaaattgtcacacagcatatggacggagaacgttcttctc

SEQ ID NO: 23807 - protein, 225 aa, Panicum virgatum
  misc_feature: Ceres CLONE 1830558
  misc_feature (110)..(197): Pfam Name: Mito_carr Pfam Description: Mitochondrial carrier protein
  misc_feature (14)..(106): Pfam Name: Mito_carr Pfam Description: Mitochondrial carrier protein
MRPGAGDELARGSYALYHFGTSGSAVAAATVATHPLDVIKVRLQMQHARQRGNLVGMGTTFTQLVTREGPRSLYLGLAPALTRSVVYGGLRLGLYEPCKHVCSYAFGSTNFAFKFASGIIAGALATALTNPMEVLKVRLQMSTSSTSTIGEMRKVLAQEGLKALWKGVGPAMARAGCLTASQMATYDESKQALMKWTPLEEGFQLHLMYSEVSVLHFDVYSSMKT

SEQ ID NO: 23808 - DNA, 715 bp, Panicum virgatum
  misc_feature: Ceres CLONE 1830574
  misc_feature: Encodes the peptide sequence at SEQ ID NO. 23809
catctcatcatctttggaagcctgccactatctccgccaaggccacaccgatgccttcctccacgtccatggagcccgccgcagacgaggtggtcgtcgagtccccggcgcacttccgcatctacaagagcggcaggatcgagcgcctcaaccggcctccgatcctccccgccggcctcgacgaggccaccggggtcacctccaaggacgtcgtcctggacgccggaaccgacctctcagcgcgcctctacctcccgaagctccaggagccgtccaagaagctccccgtcctcgtctacttccacggcggtgcgttcctgctcgagtcagccgactccgccacgtaccacacctacgtcaaccccctcgcggccgcgtcgggcgtcctcgtggtgtccgtgagctaccgcctggcgccggagcacccgctcccggcggcctacgaggactcctgggccgggctccagtgggcggcgtcggcggaggacgagtggatcgccgagcacggcgacgtggcgcgccttttcctcgccggcgacagcgccggcgccaacatcgtgcacgacatgctgctgagggcctccgccaacggcgggccgcgcatcgagggcgccatcatgctccacccgtggttcggcgggaacacgcccctcgagggggagcccgagagcgcttcagcggccaccgctgggctctggacgtacgcgtgcccggg

SEQ ID NO: 23809 - protein, 215 aa, Panicum virgatum
  misc_feature: Ceres CLONE 1830574
  misc_feature (75)..(215): Pfam Name: Abhydrolase_3 Pfam Description: alpha/beta hydrolase fold
  misc_feature: SWISSPROT Homolog: EC 3.1.1.79 Hormone-sensitive lipase
MEPAADEVVVESPAHFRIYKSGRIERLNRPPILPAGLDEATGVTSKDVVLDAGTDLSARLYLPKLQEPSKKLPVLVYFHGGAFLLESADSATYHTYVNPLAAASGVLVVSVSYRLAPEHPLPAAYEDSWAGLQWAASAEDEWIAEHGDVARLFLAGDSAGANIVHDMLLRASANGGPRIEGAIMLHPWFGGNTPLEGEPESASAATAGLWTYACP

SEQ ID NO: 23810 - DNA, 1216 bp, Panicum virgatum
  misc_feature: Ceres CLONE 1830576
  misc_feature: Encodes the peptide sequence at SEQ ID NO. 23811
gtcttccgctccgccctgccccgccccggccagatccgcgctccggccgtccggcggccctcgtcgtggcccctctgctcgttccccttcctagccacccactgccaccatcgtctccattgcagccgacgctcccttctttggtgcctaccgccgcccttactcctacacccacggcgccgttgagccgcccccggcaccccaaacggcccgacgccttcctcgtgcctgtagcaaggctggtggtgcggaactaggagtaatcagttgtggtcctgtgctcttggtgtgcttttggtcagatgccgggttacttcgacatcgatgacatcctcatggaggatgagcctatttctgttgttttccatgtaactgcaaatggtgtcggcctgctagatcctggcgctgaaagtaactgtgtagagaagggtgccaaggtagagcttccgttttggcttgcgcatgggctgctgtctctggaacaagctgtgtcaataaatccgcctccatgcttcacacagaaaactcgaaaagagatccaagctgatgcggcctgtgtggacttgagggttcgttgcccctacttttatgagcttgggtgcaagattgttcctttggtgagtgacaagagcattggcctgtttttgcgttatgctttcaccagtcggtacaaagaggttctaagcaagtctcacagttcttccatgatgacagtgcccaagtttgtcccacgccttaccaaagaagaaactcgtgtatttgaatctgctagggaatcgatggctgctttcaagaagtggcgtgctggtggtgtgaggttgcataaggcttccatccttggcaggaagaggaagacaaagctgcctgatggggcttctactccttgaacatgcatgtttaaggtctccatggcatggagtgcttgagcagtctaccttatatgttcatctatgttcacagatttgagctgttagtgtgtagaaactagaaagagaaggataacaacaatttaatacttctgtcacacatctgtcttgtattgtggtgcaccttcgaagtgcatctctttagccagacaggacaggtgacagcagctctgatctgttctttgtttggagggagcaaatctgtaggagttttaacttagtatatagcaggctttgcagtttcaactttgagtatgtatggagacagtttggataagtttgatatgttg

SEQ ID NO: 23811 - protein, 194 aa, Panicum virgatum
  misc_feature: Ceres CLONE 1830576
  misc_feature (4)..(167): Pfam Name: Psf3 Pfam Description: Partner of SLD five, PSF3
MPGYFDIDDILMEDEPISVVFHVTANGVGLLDPGAESNCVEKGAKVELPFWLAHGLLSLEQAVSINPPPCFTQKTRKEIQADAACVDLRVRCPYFYELGCKIVPLVSDKSIGLFLRYAFTSRYKEVLSKSHSSSMMTVPKFVPRLTKEETRVFESARESMAAFKKWRAGGVRLHKASILGRKRKTKLPDGASTP

SEQ ID NO: 23812 - DNA, 1924 bp, Panicum virgatum
  misc_feature: Ceres CLONE 1830582
  misc_feature: Encodes the peptide sequence at SEQ ID NO. 23813
atcagtagatagagcccatccatctatctagctctactggtatagatcctctcgcatcggtaggagggcgagggcgagggtggggagaagggcacgggagaggccgccaccaggccaactacctagtgggggagggccggagggtgcgggatttctcgggggaggagcgcccgggaggacctgattgggggctccgggccgcgatctctgagcgcagatttggtgcctgcgatctgccatggattcggtttagttgtagaagaggaggagcaaataaatcaacaggaggaagaatttctcggggtgggcaagggagaaggcatgatgctggaagggaagccctacctcgtctcgcgctccctgccgagctcctgcgagcccgagacggagtgggcgtacctcgcgcacgaagtcctcagcggcaagcgcccggcgccggaagaagttgaggaagctgacggcggcggcaagcgcagcaagccgccgtctccgcagccgcacacgccggacatcgctgagggccacggctccagccgccatgcctccggtggtggggagcaacagggcactgggagcaaccccattaattctatcggccgtgacctgaccatcaattgcctcctccggctatcccggtcagactacggctcggtggcctccctcagccgggacttccgctccctggtccgcagtggggagatctaccgcctgcggcgccagaatggggtggcggagcattgggtctacttctcctgcaatgttcttgaatgggatgcatatgacccatatcgagatcgctggatccgggtgcccaagatgccaccagatgaatgcttcatgtgctccgataaggaatcacttgcagtcggcactgagctgcttgtgtttgagatggcgcgtattgtgttcagatacagcatcctaaccaattcatggacgagggctgatgcaatgaactccccccgctgcctgtttgggtcaacaagtgttggggagaaggccttcgtagctggaggcaccgattctatgggcaccatactgagctctgcagagatgtatgactctgagtcacatacctggacgcctctccccagcatgaatagggcaaggaagatgtgttctgggattttcatggatggcaagttctatgtaataggtggcgtagccaacaacaacaaagtactgacttgcggggaggagtatgacttgaagaggcggtcttggaggatcatcgagaacatgtctgaaggcctcaacggagtgactggtgctcctccccttattgcagttgtcaacaatgagctctatgctgctgattatagtgagaaggatctcaagaagtatgacaagaagaacaataagtggatcactcttggaaagctgcctgaacggtctgtctccatgaatgggtgggggcttgctttccgagcatgtggtgaccgattgattgtcatcggaggcccgaggacctatactggtggtactattgagctcaactcatggatcccaaatgatcagccgcctgtgtggaatatgattgccagacggccatctgggaactttgtgtataactgcgccgtgatgggttgctgagtccactgaataaaagatgaatgaagtggatatttatgaaggattgtatgctcagaggcggcttgtccaattgcttcagcccttattcttcgtagcgatttctgccttctgcccagttctggaattaactggacatcagctgattgtcagcagtctcatgtaacccttgagttctaatacttctatttccctgctaatccatttccacatttgcatttggatcaactgctcgtgatttcaaagatacgagactaggcaaaacaaatgtcatattaataatctagaaaaaaactttcagagggtttttatctattgatgtgaggaacctgtt

SEQ ID NO: 23813 - protein, 423 aa, Panicum virgatum
  misc_feature: Ceres CLONE 1830582
  misc_feature (214)..(260): Pfam Name: Kelch_1 Pfam Description: Kelch motif
  misc_feature (262)..(308): Pfam Name: Kelch_1 Pfam Description: Kelch motif
  misc_feature (86)..(133): Pfam Name: F-box Pfam Description: F-box domain
MMLEGKPYLVSRSLPSSCEPETEWAYLAHEVLSGKRPAPEEVEEADGGGKRSKPPSPQPHTPDIAEGHGSSRHASGGGEQQGTGSNPINSIGRDLTINCLLRLSRSDYGSVASLSRDFRSLVRSGEIYRLRRQNGVAEHWVYFSCNVLEWDAYDPYRDRWIRVPKMPPDECFMCSDKESLAVGTELLVFEMARIVFRYSILTNSWTRADAMNSPRCLFGSTSVGEKAFVAGGTDSMGTILSSAEMYDSESHTWTPLPSMNRARKMCSGIFMDGKFYVIGGVANNNKVLTCGEEYDLKRRSWRIIENMSEGLNGVTGAPPLIAVVNNELYAADYSEKDLKKYDKKNNKWITLGKLPERSVSMNGWGLAFRACGDRLIVIGGPRTYTGGTIELNSWIPNDQPPVWNMIARRPSGNFVYNCAVMGC

SEQ ID NO: 23814 - DNA, 1644 bp, Panicum virgatum
  misc_feature: Ceres CLONE 1830586
  misc_feature: Encodes the peptide sequence at SEQ ID NO. 23815
gaaagcgtcgctagctgggtcagcgcgctctctctcgctctcccttccagcggccgcctcacctcgccgcctctccgctatatatcagggctctcgctttgttcgagggtccatcagtttcttcctctcctcctcgccaagtcggtaccctctcttcagctacctcctgcagcagctgccagccacttcctgaaaagaacagttcggagtactgttgagaggtcagaagcagagtctcctcaaaaaaaaaaaaaaaaacagaagcggagagctagtagctcatctagcctgcagttgaggaacacgagggacatggcagagaagaggagacatggaggagggcatcatgtccatggtgttgggtttggagccggaggagttggacatgccgagcacgacgagaagcgcatggagccaaagaagctggacatgagcggcatgtccatggacaccatcccacatctcagcatgcctcttggcagcatcactaccttggatctctccaacaacaacctacagagtattccagagtccataatcgcgaggcttctgaacgtggtggtgctggacgtgcggtccaaccagctgacatcgctgcccaactccatcggctgcctctccaagctcaaggtcctcaacgtctccggcaacctcctccgcgacctgcccgccaccatcgaggaatgccgggcgctggaggagctgaacgccaacttcaaccagctgacgaagctgccggacacgctggggttcgagctccacggcctccgccgcctctccgtcaactccaacaagctggcctacctgccgtcgtccacctcccacatgacggcgctgcggtcgctggacgcgcggctcaactgcctccgcgcgctgcccgacgggctcgagaacctcggcggcctcgaggccctgaacgtgagccagaacttccagtacctacgggagctcccctacggcatcggcctcctcacctcgctccgggagctggacgtcagctacaactccatcgccgcgctcccggactccatgggctgtctcaccaagctcgcccggttcagcgccgcgggcaacccgctggtgtccccgcccatggacgtcgtcgagcagagcctcgacgccatgcgcgcctacctcagcgcgcggatgaacggcaccgacaagcaggacaggaggaagaagaagagctgggtgcccaagctggtcaagtacagcaccttctcggcggggatgatgacgcccggccgcgccaccaaggtgcacggcagcggcgccgagggcctgctcatgtcggactaccggtcgctcgacggcggcggcatcgcctcgccggggttcctcggcatgctgtcgccgcggcggctcttctcgccgcggaggaactcgcccaagcatcattgataaattacttggcatgtgtgcacctgcctgcttgcttgctgcttcgtgtgtgcagatagaacatgcatgctcctcgtattgtagcgtgattaagctgatgctgttgctactgcagatgtagtatatgttttttttttgaagagatacatgcatataaagcgtgtacagagtagtagtgggatagggcattcatgacttgatgtacataagaattaagggtgtccatttctcttttttcttgtt

SEQ ID NO: 23815 - protein, 362 aa, Panicum virgatum
  misc_feature: Ceres CLONE 1830586
  misc_feature: SWISSPROT Homolog: EC 4.6.1.1 Adenylate cyclase
MAEKRRHGGGHHVHGVGFGAGGVGHAEHDEKRMEPKKLDMSGMSMDTIPHLSMPLGSITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPSSTSHMTALRSLDARLNCLRALPDGLENLGGLEALNVSQNFQYLRELPYGIGLLTSLRELDVSYNSIAALPDSMGCLTKLARFSAAGNPLVSPPMDVVEQSLDAMRAYLSARMNGTDKQDRRKKKSWVPKLVKYSTFSAGMMTPGRATKVHGSGAEGLLMSDYRSLDGGGIASPGFLGMLSPRRLFSPRRNSPKHH

SEQ ID NO: 23816 - DNA, 712 bp, Panicum virgatum
  misc_feature: Ceres CLONE 1830597
  misc_feature: Encodes the peptide sequence at SEQ ID NO. 23817
atccagattcgtcgtgggggcaccggacaccccccattagccttactcccccatccaaatctgggtgtggtgggatccatggcggcggcggaggggccgaggaagaaggtcatcatcgacaccgaccccggaatcgatgacgcgatggccatcttcgtggcgctgcgctcgccggagctcgaggtgctcggcctcaccaccaccttcggcaacgtccacaccgccctcgccacgcgcaacgcgctccacctgctggaggccgttggccggaccgacatccccgtcgcggagggatcccatgtaacggtcaagaaagccatcaagctcaggatcgcgagcttcgtccacggctcggacggtctgggaaaccaggacttccctgcaccgactacgaaaccgatagatcagacggctgctgcattccttgttgagcaggcaaatctgtaccccggacaagttactgtcgttgcccttggtccgctgaccaaccttgctctggccatcgagcttgatccttcgttccccaagaagataggacagattattattcttggtggtgcgtattcggtcaatggaaacgtcaaccctgcagctgaggcaaatatatttggggatcctgacgcagcagatattgtgttcacctgcggtgctgatattttggccataggactaaatgtaacccaccaagtagttcttacagacgctgaccggg

SEQ ID NO: 23817 - protein, 211 aa, Panicum virgatum
  misc_feature: Ceres CLONE 1830597
  misc_feature (8)..(210): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MAAAEGPRKKVIIDTDPGIDDAMAIFVALRSPELEVLGLTTTFGNVHTALATRNALHLLEAVGRTDIPVAEGSHVTVKKAIKLRIASFVHGSDGLGNQDFPAPTTKPIDQTAAAFLVEQANLYPGQVTVVALGPLTNLALAIELDPSFPKKIGQIIILGGAYSVNGNVNPAAEANIFGDPDAADIVFTCGADILAIGLNVTHQVVLTDADR

SEQ ID NO: 23818 - DNA, 682 bp, Panicum virgatum
  misc_feature: Ceres CLONE 1830644
  misc_feature: Encodes the peptide sequence at SEQ ID NO. 23819
agtggctgccacgccgtcgccgtcctcgccgatagccgcgccgcgctgtcgtcatcctcgccgagagcggctccatcccatcgcaccccccgaacctcttcccctccactcccaagtcccaatgatgaagtccctcctcttctccgcccaccacacgccgccgctcctccccgccccgcgcctcctccgcctttgcgcctcctccgcctccgccacgccacgcgccgaccgcctcgtgcccctctcgagcgcggcgcggccgtgcagggggctcgcggcggtgtctctatcgcgcggcgcggcgggacggaggttgccgggcgtgtcggcgatgtcgtcgtcgaccccgccgctagggcccgtgcagaagtcagaggaggagtggcaggctatcctaacaccggagcagttcaacatcctccgcctcaagggcaccgagcggaggaagctcagtttagtgcgtgcaagaaccgatggttcgggttccggctctgcggcggccgaggcatccaccgtgggagacaatttggaaggggaggaaagcggtggcggggagttagttgcttcggctggctcatcggcagggaagcagccgcctcccgtcaatccccagattgaaaaggagctcaagaaggcagttcagaagactgtggcaacctttgcaacgagggcgtccatgaaa

SEQ ID NO: 23819 - protein, 186 aa, Panicum virgatum
  misc_feature: Ceres CLONE 1830644
  misc_feature: SWISSPROT Homolog: EC 1.8.4.12 Peptide-methionine (R)-S-oxide reductase
MMKSLLFSAHHTPPLLPAPRLLRLCASSASATPRADRLVPLSSAARPCRGLAAVSLSRGAAGRRLPGVSAMSSSTPPLGPVQKSEEEWQAILTPEQFNILRLKGTERRKLSLVRARTDGSGSGSAAAEASTVGDNLEGEESGGGELVASAGSSAGKQPPPVNPQIEKELKKAVQKTVATFATRASM

SEQ ID NO: 23820 - DNA, 721 bp, Panicum virgatum
  misc_feature: Ceres CLONE 1830645
  misc_feature: Encodes the peptide sequence at SEQ ID NO. 23821
ccacccaatccaccacacaccagccagaactcacgcgacacaccatccagatgacgatgcttagggtttccccgtcaccggccgccgccgccgccgccaccgccagccatgtctctcggcccgccgtgaccccggcttccgtccgggtgccggctccgcgcgtctcgccgtcggccgcggccgcatgcagggcggcgggcaagggcaaggaggtgctcagcggggtcgtcttccagcccttcgaggagatcaagggggagctctccctcgtgccccagacagcggacaagtccctcgcgcgccagaagttcgtcgacgaatgcgaggcggccatcaacgagcagatcaatgtggagtacaatgcctcctatgcgtaccactccctctttgcctacttcgaccgcgacaacgtggctctcaaaggatttgccaagttctttaaggaatcaagcgatgaggagagagagcatgctgaaaagttcatgaagtaccagaacacacgtggaggcagggtcagtctccagtccattgtcactcccttaacagagtttgaccaccctgagaaaggcgatgctttgtacgccatggagctggctctggctctggagaaattggttaatgagaagctgcacaacctgcatgctgtggcgaccaggtgcaatgatcctcagctgacagacttcatcgagagtgaatttctctcggagcaggttgaaagcat

SEQ ID NO: 23821 - protein, 221 aa, Panicum virgatum
  misc_feature: Ceres CLONE 1830645
  misc_feature (90)..(221): Pfam Name: Ferritin Pfam Description: Ferritin-like domain
  misc_feature: SWISSPROT Homolog: EC 1.16.3.1 Ferroxidase
MLRVSPSPAAAAAATASHVSRPAVTPASVRVPAPRVSPSAAAACRAAGKGKEVLSGVVFQPFEEIKGELSLVPQTADKSLARQKFVDECEAAINEQINVEYNASYAYHSLFAYFDRDNVALKGFAKFFKESSDEEREHAEKFMKYQNTRGGRVSLQSIVTPLTEFDHPEKGDALYAMELALALEKLVNEKLHNLHAVATRCNDPQLTDFIESEFLSEQVES

SEQ ID NO: 23822 - DNA, 644 bp, Panicum virgatum
  misc_feature: Ceres CLONE 1830654
  misc_feature: Encodes the peptide sequence at SEQ ID NO. 23823
ctctctctcgtcccccttctcccgcagcggttcctccctaccttcctcgcgccgcccgccgccgccgccgccgtgttccgttgccttgccgatggcttccgccaaggtggagaaccgaggcgcgctgtccaagaggtcgcgcaatgacgtgtctgtaagggagggggactggaattgtcctcagtgtggtaatgtcaacttcagttttagaaatgtttgcaaccgtggagcctgcggtgcaccccgtccatcaccgagtccaagttcaagaatgatgccagcacctcctcctgctggatatgatcggtcacctctattttacggagggggtggtggggcgccatctccaatccctcttggatctggtagctatggtgctccatatccacaccttgggatgcgttatggttatggtccaccagtaggagctcctggttcatatggccttttctcatcgtatggtcaacctggaccgatgggtggcatgggatatggccctggacctgagatgggccgatataactatgggtttagaggatctccaatgccggtttctagcccatggtctggtggagcattagtggaaaacaatgataacattgcttctcgaaagcgccgtggaggccctgatggacattctgagg

SEQ ID NO: 23823 - protein, 184 aa, Panicum virgatum
  misc_feature: Ceres CLONE 1830654
  misc_feature (23)..(54): Pfam Name: zf-RanBP Pfam Description: Zn-finger in Ran binding protein and others
MASAKVENRGALSKRSRNDVSVREGDWNCPQCGNVNFSFRNVCNRGACGAPRPSPSPSSRMMPAPPPAGYDRSPLFYGGGGGAPSPIPLGSGSYGAPYPHLGMRYGYGPPVGAPGSYGLFSSYGQPGPMGGMGYGPGPEMGRYNYGFRGSPMPVSSPWSGGALVENNDNIASRKRRGGPDGHSE

SEQ ID NO: 23824 - DNA, 565 bp, Panicum virgatum
  misc_feature: Ceres CLONE 1830667
  misc_feature: Encodes the peptide sequence at SEQ ID NO. 23825
acccctacccaccatcaccgactccccttgctctcttcctacctctctgctatctctctcggcacgcacgcgcgcgagctctccttcctcgtcgaggtgcattgatggcgaccgaagtggctgaggctccggtgccgctggcggaggcggcccccgacgccgcagcggaggcccccgccgcggccgcggccgccggcgacgcgaagccggccaaggccaagaagcccgccgcgccgcggaagcgcgcgaacccgacccacccaccctacgctgagatgatctcggaggcgatcacgtcgctcagggagaggaccgggtcgagccttttttttatcgccaagttcgtggaggacaagcagaagggcaagctgcctcccaacttccgcaagctgctgctcgtgcagctgaagaagctcgtcgccgccggcaagctcgccaaggtcaagaactcgtacgagctgccggcggggcgcgccccggtcgccgactagcccaaggcctagcccaatgctaagcctgctgccgccgagcccaaggccaagacaaatcctgccgtgaagaagcc

SEQ ID NO: 23825 - protein, 128 aa, Panicum virgatum
  misc_feature: Ceres CLONE 1830667
  misc_feature (51)..(121): Pfam Name: Linker_histone Pfam Description: linker histone H1 and H5 family
MATEVAEAPVPLAEAAPDAAAEAPAAAAAAGDAKPAKAKKPAAPRKRANPTHPPYAEMISEAITSLRERTGSSLFFIAKFVEDKQKGKLPPNFRKLLLVQLKKLVAAGKLAKVKNSYELPAGRAPVAD

SEQ ID NO: 23826 - DNA, 1065 bp, Panicum virgatum
  misc_feature: Ceres CLONE 1830687
  misc_feature: Encodes the peptide sequence at SEQ ID NO. 23827
acggccacaagtcacaaccttctcgtgctcaggtccccagccaacaaccatggcatctcccaataagctgctgctcctgctcgccacctccctcctgggctgcggcctcctggccgccgccaactacgcccccatgaccctgaccgtggtgaacaactgccccttcccggtgtggccgggcatccaggccaactccgggcacgacgtgctggagggcggcggcttcttcctcccggccctctcccacaagtccttcccggcgccgtcccacccctggtcgggccgcatctgggcgcgcacgggctgtgccgcgggcgccggcgcgcagctccgctgcgccacgggcgactgcggcgggcggctccagtgcggcgggctcggcggcgcggcgcccgcgacgttggcgcaggtgagcctccaccacggcggcggcggcggcgaccagacctcgtacggcgtgagcgtggtggacggcttcaacgtgggcctgtccgtgaccccgcacgagggccgcggcaactgccccgtcctcggctgccgccggaacctcacggcgacctgcccgggggagctccagctgcggtcccccgccggggccgtcctcgcgtgccggagcggctgcgaggcgttccgcaccgacaagctgtgctgccgcaacatgtacaacagcccgcgcacctgccgcgcctccaagtactcggagttcttcaagcgcgagtgcccgcaggccttcacctacgcgcacgacagcccgtcgctcacccaccagtgcgccgcgccgcgcgagctcaaggtcatcttctgccactagatacagccagccccgaggagtccggcgtcgctgtccgtcaacaagaagtgtcgctggctagtaggatttctggtgtgcgtgttggtctagttcgtgattctgtgccccccggttttctgtggtctctctggtcctgctctgtagactgtaggtactgtgcccgttggatgtgtgtgttggcgttctggccgtaaagactggtgtaatggtgccgctgctcagtttgcagtctgaaataaaggccatgtttagtt

SEQ ID NO: 23827 - protein, 253 aa, Panicum virgatum
  misc_feature: Ceres CLONE 1830687
  misc_feature (35)..(253): Pfam Name: Thaumatin Pfam Description: Thaumatin family
MASPNKLLLLLATSLLGCGLLAAANYAPMTLTVVNNCPFPVWPGIQANSGHDVLEGGGFFLPALSHKSFPAPSHPWSGRIWARTGCAAGAGAQLRCATGDCGGRLQCGGLGGAAPATLAQVSLHHGGGGGDQTSYGVSVVDGFNVGLSVTPHEGRGNCPVLGCRRNLTATCPGELQLRSPAGAVLACRSGCEAFRTDKLCCRNMYNSPRTCRASKYSEFFKRECPQAFTYAHDSPSLTHQCAAPRELKVIFCH

SEQ ID NO: 23828 - DNA, 1211 bp, Panicum virgatum
  misc_feature: Ceres CLONE 1830695
  misc_feature: Encodes the peptide sequence at SEQ ID NO. 23829
aaacgcgccctaactggtcgccgccccccctccgccgccgctgccacatctcctccgtccccttcttctcgccgccatggcaccaggcctctacgccgacatcggcaagaagaccagagatctgctgtacaaggactacaacacgcaccagaagttctccttcaccacctgctccccccacggcgtcgcaatcacagccgcaggaacaaggaaaaatgagtacatatttggcgagcttcacacccagattaagaacaagaagttgacagttgatgtcaaagcaaactcagagtcagatcttttgacaacaatcactgtggatgagtttggaacgccagggctcaaatcgattcttagcttggttgttccagaccagagatcaggaaagcttgaactccagtacttgcatgcatttgctggtgtgaatgcaagcattgggcttaatcccaaccctatggttaacttttctggtgtctttggaagcaaagcactctcggttggcgttgatgtttcatttgatacggcaactagcaatttcaccaagtacaatgcggcactgagccttaccaatccagatcttattgcttccctccatttgaataaccatggtgataccatggttgcatcctactaccacttggtaaagcatcattcaggcaccgctgtcggggctgagctgtcacacagcttctctagaaatgagagcacgctgatctttggttctcagcattcgttggatccccacaccatcgtaaaggcacgcttcaacaactacggcatggccagtgcccttgtccagcatgaatggcgccccaagtcattcatcaccatctctggtgaggtcgacaccaaggcaattgagaagagcacgaaagttggtttgtccttggtgctcaagcactgaaacaccggacgttttgggcttcaggattttccttctcagtttcagtggattggaataacatgggaaaacatggcctgaagaagtcatctttgtggcatcattttgatcttgaattacattttttcctccctccatgatctattccatagccaaatcttaggattgattgaccttgtgttttcattctcagcaccttctgttaataatctctggtgattgtgacagattgtaaagcttgtcgaacatgatggtgattgtttgttcagaaaaatgtgatgttgattacttggcattcatttctatgttc

SEQ ID NO: 23829 - protein, 275 aa, Panicum virgatum
  misc_feature: Ceres CLONE 1830695
  misc_feature (2)..(268): Pfam Name: Porin_3 Pfam Description: Eukaryotic porin
  misc_feature: Useful for making plants with modulated drought sensitivity
MAPGLYADIGKKTRDLLYKDYNTHQKFSFTTCSPHGVAITAAGTRKNEYIFGELHTQIKNKKLTVDVKANSESDLLTTITVDEFGTPGLKSILSLVVPDQRSGKLELQYLHAFAGVNASIGLNPNPMVNFSGVFGSKALSVGVDVSFDTATSNFTKYNAALSLTNPDLIASLHLNNHGDTMVASYYHLVKHHSGTAVGAELSHSFSRNESTLIFGSQHSLDPHTIVKARFNNYGMASALVQHEWRPKSFITISGEVDTKAIEKSTKVGLSLVLKH

SEQ ID NO: 23830 - DNA, 631 bp, Panicum virgatum
  misc_feature: Ceres CLONE 1830712
  misc_feature: Encodes the peptide sequence at SEQ ID NO. 23831
aaaccctagacatcccaagccccagcgccgccagcgagccagccactccaccactcccgacccgagccctcaggcggtcaggccccagcgcggcggcggcggcggcggcggcaagatggcggtgggaaagaacaagcggatcagcaaagggaagaagggtggtaagaagaagatcgtcgatcccttcgcgaagaaggattggtatgatatcaaggcgccctccgtcttctccgtgcgcaacattggaaagacgctcgtgtccaggacacagggtactaagattgcttctgagggtctgaagcaccgtgtctttgaggtctccctagctgatcttcagagtgatgaagaccaagcctacaggaagatcaggctccgtgctgaagatatccagggtcgtaatgtccttaccaacttctggggtatggattttactacagacaagctgcggtcgctggtcaggaagtggcagaccttgattgaggcccatgttgatgttaagaccactgatagctacatgctgcggctcttctgcatcgggtttacaaagaggagacccaaccaagtgaagcgtacttgctatgcacaggcctcccagatccgtcagatacgccggaagatggttgagatcatg

SEQ ID NO: 23831 - protein, 171 aa, Panicum virgatum
  misc_feature: Ceres CLONE 1830712
  misc_feature (11)..(171): Pfam Name: Ribosomal_S3Ae Pfam Description: Ribosomal S3Ae family
MAVGKNKRISKGKKGGKKKIVDPFAKKDWYDIKAPSVFSVRNIGKTLVSRTQGTKIASEGLKHRVFEVSLADLQSDEDQAYRKIRLRAEDIQGRNVLTNFWGMDFTTDKLRSLVRKWQTLIEAHVDVKTTDSYMLRLFCIGFTKRRPNQVKRTCYAQASQIRQIRRKMVEI

SEQ ID NO: 23832 - DNA, 1429 bp, Panicum virgatum
  misc_feature: Ceres CLONE 1830715
  misc_feature: Encodes the peptide sequence at SEQ ID NO. 23833
aactcaaccctgtgccctgtgcgtgctcggccccggaggtggagcagcttgcttccacatctcctccgccgtctccctcccgtgcgcgacacgccacagcggcgacgcgaagcggattaggccggcgagcacgggggacagccccgcccagcgagatctgcccgccggcggcggcaatggcttccgcgcacgaggaggccgcggcgtggtcggaggaggcggcgcggcgggtctggggcggcgccgtgccgctacaggtccacctccacgacgccgacgtcaccgcgctcccaccgccgccgcccttcctgacattggggccaagaatcgggtatttgccgcttttaatacctgtcatcaaggctcatttcagcaatgctctcccacctggtgttgacactgtttggtttgaatataaagggctgccattaaaatggtatgtaccaattggagttcttttcgaccttctatgcgcagatccagaaaggccatggaatctaatagtccattttaggggatacccatcagaaattttgtcaccatgtgagggtgaagatagtgtgaagtggagctacatgaatgcactgaaagaggccaccttcatcattactgggaacagtaagagtgttatgaacatgtcccaggctgatcaagttgctctgtgggaatctgtaatgaaaggtaacttggatgggtataagaatatctccatcaggcttaagcttggaccatttgaggaggatggcttagtacgaacagcctccacggagcgtcaacgtcaacaaagttctgatgagccggaatcccctggaattggcaaaccatgcagggtccctgttcgattatatgtgcgtggtgttcaagaagaccttgaggacatagaagatgcaatgcctgctcgtgactgggaaagtgtgtcctacataaatcgaccattcgagattcggaaggttgaaggcagaagctacatcaccatggagcatgctttacaaacattgcttcctgagttcttcagctcagacacccaaactgcagaggaactggagtcagctgctggtgattcagatatcatgaacccttcaagaagttctcaggaggcggaaccagcttcagcaagtctgcgggaggcggatatcaccaagaaagctaaagtgaagctagtaagggtacagggcatcgagctggacatggacatcccgttcctctgggtcgctaacaacttgaagaaccctgaatactacctccatatttgtgtatatgtcgcaaccagaaaacaatagctcaaaaagagtagatgaaaaaatgtcagatattgcacgtaggggtctgctccagaaatcgttggcttttgttctttgcattggtcaggcgttacactgttattctttgtacagacgcagaaatcgtaaccattttagtgttgatgcac

SEQ ID NO: 23833 - protein, 367 aa, Panicum virgatum
  misc_feature: Ceres CLONE 1830715
  misc_feature (87)..(363): Pfam Name: APG5 Pfam Description: Autophagy protein Apg5
MASAHEEAAAWSEEAARRVWGGAVPLQVHLHDADVTALPPPPPFLTLGPRIGYLPLLIPVIKAHFSNALPPGVDTVWFEYKGLPLKWYVPIGVLFDLLCADPERPWNLIVHFRGYPSEILSPCEGEDSVKWSYMNALKEATFIITGNSKSVMNMSQADQVALWESVMKGNLDGYKNISIRLKLGPFEEDGLVRTASTERQRQQSSDEPESPGIGKPCRVPVRLYVRGVQEDLEDIEDAMPARDWESVSYINRPFEIRKVEGRSYITMEHALQTLLPEFFSSDTQTAEELESAAGDSDIMNPSRSSQEAEPASASLREADITKKAKVKLVRVQGIELDMDIPFLWVANNLKNPEYYLHICVYVATRKQ

SEQ ID NO: 23834 - DNA, 559 bp, Panicum virgatum
  misc_feature: Ceres CLONE 1830729
  misc_feature: Encodes the peptide sequence at SEQ ID NO. 23835
acagcatcatcagttcactctccttcgtcctcttctcggttatcccaccaactccccaatcacaccccaattcaccaaatatcccattttcatcccagaacaatcccccaatccgccaaagattgccgattggggcctcggcaatggccgcccgagccgccgcgctgcttgccgccatcctcctgggggccctcggcgccgcgcggcgggccgacccggcgatcggggagaactggggcaccgtctcctcccgccgcgcgccgccgggcgtggcggtggacccgacgcgcgcgcaaccggatcagcaaggtcaagctcctccacgcccacccgggtgcgctgccaccgctcgccggccgcggcatacaggtcatggacggcgtcaccaacggcgagctcgcaagcattgcaggatcgcagggcgccgccgacgcctgggtcgcgcacaacgtgccgcggtacgtcggccgcggccgcctggacatccgatacatcggcgtgggcgatgagcccttcctgagacgctaccagggacaatgtgaatcatatagccttccag

SEQ ID NO: 23835 - protein, 62 aa, Panicum virgatum
  misc_feature: Ceres CLONE 1830729
  misc_feature: SWISSPROT Homolog: EC 3.2.1.39 Glucan endo-1,3-beta-D-glucosidase
MDGVTNGELASIAGSQGAADAWVAHNVPRYVGRGRLDIRYIGVGDEPFLRRYQGQCESYSLP

SEQ ID NO: 23836 - DNA, 415 bp, Panicum virgatum
  misc_feature: Ceres CLONE 1830748
  misc_feature: Encodes the peptide sequence at SEQ ID NO. 23837
atgctcaagtgcgcctcctattcgccgacaagatcctcccccggccgcttctcatccagcttccagtagtcggccgcctccgccgggagtacaactagatgtggttctgaaggattgaaggggtagggacgcttgcggcgggggccatggacccgaggatgggtgggcagccttccctgagcctggacctcttcgtcggcctgcccacggtgcgcccgggggcaccggcggccacgggcctcgtcaaggagaacttcttggccgtcaagaaggagagggagcaagtggaggcgctggaggcggacctccggctagtgggcgaggagaacaaccggatcagatagatggtgggggggctggtggtcaatttctccgagctgcaggggcaggtcaacgagatggtggccgcgggaaa

SEQ ID NO: 23837 - protein, 65 aa, Panicum virgatum
  misc_feature: Ceres CLONE 1830748
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDPRMGGQPSLSLDLFVGLPTVRPGAPAATGLVKENFLAVKKEREQVEALEADLRLVGEENNRIR

SEQ ID NO: 23838 - DNA, 1423 bp, Panicum virgatum
  misc_feature: Ceres CLONE 1830754
  misc_feature: Encodes the peptide sequence at SEQ ID NO. 23839
agtctcctccttgtaccggcggccattctcccttgcagtgtcgccctctctctctctctcgattctctctccagtccagccggggcagtcccccctccatcaggtgttgcctcctgcagatccaaattggaatttgggccttcgtctccacatcaccaatccggggagggagggggaggggagtgatgggggagtgcgaggacgcagaggagtacaggtgctgggaggagcttctcccggacgcgctgggcctcatcttccgcaacctaccgctccaggaggtgctcaccgtcctgccgcgggtgtgcaagtcctggggccgggtggtcgccggcccctactgctggcaggagatcgacatcgaggagtggagccagcagcagagcaagccggagcagatcggccgcatggtcgagctgctcgtcagccgcagcggcggctcgtgccgccgcatcagcgtctccgggctgccctgcgacccgctcctctcgttcataggagaccacgcacgagctcttcgcgccctggagattccgcggagtgagatcagcgactccatcgtggaaactgtggctccccggctatccaacgtcactttcctagacatcagcagctgcaccaagatcggggctcgcgccctggaggctttcggcaagcactgcaagtccctggtcgggctccggcgggtgatgcacccgatcgacctggcggacaaggagtgccagcacgacgaggcccacgccatcgcgtgcagcatgcccaagctccggcacctggagatggggtacatgctgatcacgacggaggcagtggcggagatcctggggcagtgccgcgagctcaagttcctggacctgcgcggctgctgggccgtggacgacaagtccctgcgggagcgccacccggggctgcgcgtgctgggcccgcgcgtggaggactgctacgagaacagctactgggaggagtgctccgactactcggacgacgactcgtccatctactcgtgggagttcatggacgacgtcgacggctactacgccgtcggcagcgacgacgaggccatctgggacgacgggcagggcctcgacctcgataacctcgaggtcaggttctacggcggcggcttcagcgagagcttcgccggcttcgactggccaccgtcgccgtgagatcactgcagcagttagttcttgcttgctttctttctactctgtgtgcggctgtgcgcgtgtgcgtgtgttgttcctgagctgagcttgcagacatgttgctgtaccgagtctgcgacatcactactccctctccctctagcttgcagatatgtcaagtggactgctaatagtagtacaatctagatgtaaactctggtgtttacatgaagcaaatcaacatgcgacggtgagatttcaccgtgccattctag

SEQ ID NO: 23839 - protein, 327 aa, Panicum virgatum
  misc_feature: Ceres CLONE 1830754
  misc_feature (11)..(59): Pfam Name: F-box Pfam Description: F-box domain
MGECEDAEEYRCWEELLPDALGLIFRNLPLQEVLTVLPRVCKSWGRVVAGPYCWQEIDIEEWSQQQSKPEQIGRMVELLVSRSGGSCRRISVSGLPCDPLLSFIGDHARALRALEIPRSEISDSIVETVAPRLSNVTFLDISSCTKIGARALEAFGKHCKSLVGLRRVMHPIDLADKECQHDEAHAIACSMPKLRHLEMGYMLITTEAVAEILGQCRELKFLDLRGCWAVDDKSLRERHPGLRVLGPRVEDCYENSYWEECSDYSDDDSSIYSWEFMDDVDGYYAVGSDDEAIWDDGQGLDLDNLEVRFYGGGFSESFAGFDWPPSP

SEQ ID NO: 23840 - DNA, 1275 bp, Panicum virgatum
  misc_feature: Ceres CLONE 1830755
  misc_feature: Encodes the peptide sequence at SEQ ID NO. 23841
tgcggccgggcccgctagttccgccgctcgcctacctccacacgctagccaatggcggccgccatgcggagcgccagcctcctacgtcttggattccgccaggtctcctctctggtgttccaggtgcccccttgctcggccccgagcctgggcctgaacctggccgttggccgtgccggattggtacgcctctgttgctcggcggccggggccggcgacgacgggggcaagaaggtgtcggcgcggctggcgctgacgcagcaggtgcttcgcgacgccgagaagcgtgccgcgtcggctggctctgaccccgccccaaagatcaccctggatcatgttactgttaattttgcaagaagtggtggccctggtggtcagaatgttaataaagtaaatacaaaggttgacatgcgattcaatgttaaagaagctcactggcttggagagagaatcaaggaacgaatattacaagcggaaaagaataggataaataaagacggtgagcttgtgatatcttctacaaaaactagaacacagaagggcaacattgaagatgctttgcagaagatacaggcaattattgatgccgcatcatatgttcctccaccccctacagaagagcagaagaaaaagatagaaaaaattgctgcagtcgctgaaaggaagagacttcagaataaaaaagtgctttcacagaagaaggaatttagacggaacagaactagctgggattgatggaaggaacataccttgcacaaaacgtctctgtttcctgctattccccagtgaacctggtgaacatttcagcgtggtaacttctggtgttttcttcctaatctgtttcttgatggtttaaaacttagtatgaataccttatcgattcaaatggactgggtgagtctgccaaatgtcttttactcagcttgctcttggatgtagcaaagcattcaggggtgtacataaatcgacatataaaaacaagacatggtgaaggcatctttggtgaagaagaaagctcagtttcataggcattgccagttcttgtttcgtccattggggaccggcctctgccgggaaacactgcttgggtcctgaaacgcggtatacataccagtcgtcctggtccctgaacttatcagatacgtactagatagtacacgtgtaactgagcactcatatgtaaaactgtaacaatttccttttggactttaggctgtgacaatttcttttgggactttaggctgtaacaatttctttttgaggacttaaaactgc

SEQ ID NO: 23841 - protein, 227 aa, Panicum virgatum
  misc_feature: Ceres CLONE 1830755
  misc_feature (82)..(188): Pfam Name: RF-1 Pfam Description: Peptidyl-tRNA hydrolase domain
MAAAMRSASLLRLGFRQVSSLVFQVPPCSAPSLGLNLAVGRAGLVRLCCSAAGAGDDGGKKVSARLALTQQVLRDAEKRAASAGSDPAPKITLDHVTVNFARSGGPGGQNVNKVNTKVDMRFNVKEAHWLGERIKERILQAEKNRINKDGELVISSTKTRTQKGNIEDALQKIQAIIDAASYVPPPPTEEQKKKIEKIAAVAERKRLQNKKVLSQKKEFRRNRTSWD

SEQ ID NO: 23842 - DNA, 1072 bp, Panicum virgatum
  misc_feature: Ceres CLONE 1830759
  misc_feature: Encodes the peptide sequence at SEQ ID NO. 23843
aagaaacgctcctcccttccctcgttcttcttcctcggcccaccccgcgacgacgaaaagcctagtttgaaacgccgaaagcgacgcccttcttccccgttcaaagcaatcgtgctccccttttctcctccccctttccaccagctgcacgcgtacgggcccgccccaaacaccaagctcgatcttggtctccagcataaccagaagagggggggggggggggtggcgctccggatcccatggcgccggtggtgtcggcgctggccaagtacaagctggtgttcctgggcgaccaggccgtgggcaagacggccatcatcacccgattcatgtacgacaagttcgacgacacctaccaggcgacgatcgggatcgacttcctctccaagacgatgtacctcgaggatcgcaccgtccgcctccagctctgggacacagctgggcaggagaggttccgcagcctgatcccgagctacatcagagactcctccgtggccgtcatcgtttacgatgtgactgacacgcaatcctttttgaatacgtcaaagtggatcgaggaagtgaatacacaaagaggcggcgatgtgctcatcttccttgtcggaaataaaactgaccttgtcgacaagaggaaagtgtccactgacgaaggagaagccaaagcacaggagcatggcgccatgttcatagaaaccagtgcaaaagctgggttcaacatcaagcctctgttccgcaagatcgctggatcccttcctggaatggacgctctctcgtcagcaaagcaggaagacatggtggacataaacctcaggccttccactgggtcgtcagcttcaggctcagcttcgcaggcggagcaaaagtcaggtggttgctcttgttgagacttgcagagttttgtgttcagagaagctgcagtagtagggatacaacatttgagttaatacttccgtagagatgaagagtaatattcatggggaagaggccaatttctgtgtacaaatatttttgtgaagttgccatacataactttttttggaacccaggaatatgatcaaatctgtgaaagctg

SEQ ID NO: 23843 - protein, 214 aa, Panicum virgatum
  misc_feature: Ceres CLONE 1830759
  misc_feature (12)..(173): Pfam Name: Ras Pfam Description: Ras family
  misc_feature (12)..(126): Pfam Name: Miro Pfam Description: Miro-like protein
  misc_feature: SWISSPROT Homolog: EC 2.7.11.1 Non-specific serine/threonine protein kinase
MAPVVSALAKYKLVFLGDQAVGKTAIITRFMYDKFDDTYQATIGIDFLSKTMYLEDRTVRLQLWDTAGQERFRSLIPSYIRDSSVAVIVYDVTDTQSFLNTSKWIEEVNTQRGGDVLIFLVGNKTDLVDKRKVSTDEGEAKAQEHGAMFIETSAKAGFNIKPLFRKIAGSLPGMDALSSAKQEDMVDINLRPSTGSSASGSASQAEQKSGGCSC

SEQ ID NO: 23844 - DNA, 628 bp, Panicum virgatum
  misc_feature: Ceres CLONE 1830760
  misc_feature: Encodes the peptide sequence at SEQ ID NO. 23845
tttcctgtcctctcccaatccctcgctttcccacctccatccaccggccgcgccccgcgccgccgaatctccggcgagatgtcgcgcttcgggcgatccggcccgccgccaatccgcgacacctactccctcctcgtcctcaacatcaccttccggacgacggctgatgacctcttcccgctcttcgacaagtacggcgaggtcgtcgacatctacatccccagggaccgcaggactggtgactcccgaggcttcgcgttcgtgaggtacaagtacgaggacgaggcgcagaaggcagttgataggctcgatgggagagtggtagacgggagagagatcatggtgcagtttgccaaatatggcccaaatgctgaacggattaataaagggagaatagtggagccagtaccaaggtcaagaggccgttccagaagccgcagtccaagacggaggtaccgtgatgattatcgagatgattaccgggatagagattatagacgacgaagtcgtagtcggagtagagataggtattcacgtgacagttacagagagagggattatcgtcgccatagcaggagtcgcagctacagccctgatggttacaagaagcatgggagggacagtttgt

SEQ ID NO: 23845 - protein, 183 aa, Panicum virgatum
  misc_feature: Ceres CLONE 1830760
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGPPPIRDTYSLLVLNITFRTTADDLFPLFDKYGEVVDIYIPRDRRTGDSRGFAFVRYKYEDEAQKAVDRLDGRVVDGREIMVQFAKYGPNAERINKGRIVEPVPRSRGRSRSRSPRRRYRDDYRDDYRDRDYRRRSRSRSRDRYSRDSYRERDYRRHSRSRSYSPDGYKKHGRDSL

SEQ ID NO: 23846 - DNA, 1367 bp, Panicum virgatum
  misc_feature: Ceres CLONE 1830821
  misc_feature: Encodes the peptide sequence at SEQ ID NO. 23847
attgaatccaacatccccctcctgctggtctagtctagcttctcccacccgatttgcggcgtctccagtgcacgctgcagccgcgcggcctggcggaatcttccttgctgctgctggtttccaagtggttctgctggcactggtggatgtctgatcgcgaggaagcaatggagtggtggggtgctcatgttttgtactaccgaacatgaaaggagcctttacaatggcaccgggaagcagcattgtgactgtggttcccgagtcagactgtggagatgatggcctttctgaggcacttgggggtattaggcttgatgtagactctacaagtaaaccatggtctacgtcactagccagtgttgcattatcatcactggctggcttgaatgatttgctcgaatgcccagtatgtacaaactcaatgcgtccacctatactacagtgcccaaatggccacacaatttgctccagctgcaagcatagggtagagaaccattgcccaacttgccgccaagaactgggaaacatcagatgtttggctcttgagaaggtggcagaacaacttcagcttccatgcaaataccaaagcatgggatgcactgaaattcacccgtacaagaacaaactcaagcatgaggagctctgcaggttcaggccatacaactgtccgtacgcaggttcagagtgtctgatcacaggtgatgttctgtttctggtgtctcatctcatcaatgaccataaggtggacctgcatgagggatgcacgtttaaccaccggtatgtgaagcccaacccttacgaagtggaaaatgctacatggatgctcacagtcttcaagtgtttcgggcagcacttctgcctgcactttgaggcattcctgcttgggatggcgccggtgtacatggcgttcctgcggttcatgggcgaggagagcgaggtgcagtgctttgggtacagcctggaggtgggcgggggcgggcggaagctgacatggcagggcacgccgcggagcatcagggacagccaccggaaggtgcgggacagctttgatgggctgatcatccaccggaacatggtgcttttcttctctggtggcagcaggcaggagctcaagctgcgggtcaccggccgcatctggagggagcaagggcaatgagcctattctctttcgtttatccttcatgcagacatgcagtagagaaaggcagcttctgccccttgccgtggttgaaattccattccatgttgaccctgtgcattttctgtacaaaaatacttttggcacggtgttgccaccgtgttcaaccctgattaacacgtggggaaagcctcggggaaaacctgactgactctcacgtgtgattccg

SEQ ID NO: 23847 - protein, 316 aa, Panicum virgatum
  misc_feature: Ceres CLONE 1830821
  misc_feature (108)..(307): Pfam Name: Sina Pfam Description: Seven in absentia protein family
MKGAFTMAPGSSIVTVVPESDCGDDGLSEALGGIRLDVDSTSKPWSTSLASVALSSLAGLNDLLECPVCTNSMRPPILQCPNGHTICSSCKHRVENHCPTCRQELGNIRCLALEKVAEQLQLPCKYQSMGCTEIHPYKNKLKHEELCRFRPYNCPYAGSECLITGDVLFLVSHLINDHKVDLHEGCTFNHRYVKPNPYEVENATWMLTVFKCFGQHFCLHFEAFLLGMAPVYMAFLRFMGEESEVQCFGYSLEVGGGGRKLTWQGTPRSIRDSHRKVRDSFDGLIIHRNMVLFFSGGSRQELKLRVTGRIWREQGQ

SEQ ID NO: 23848 - DNA, 664 bp, Panicum virgatum
  misc_feature: Ceres CLONE 1830833
  misc_feature: Encodes the peptide sequence at SEQ ID NO. 23849
gtttttctctctcctgcgcagcgccgtccctcgcctccgccgccgaatccgaggctccgatctcgggttcaccgcagcgcaccaagcacccccgcggctcgatctgctcctcctcctcctcctcctccgcgcttcagtcatggcgggaatgtcacctgagggttcccagtttgatgctaagcactatgattctaaaatgcaggagctgctgagcactggtgagactgaggagttcttcacttcctacgatgaagtgtttgagagttttgatgacatgggcctccaagagaatcttttgagaggcatttatgcttatggttttgagaagccttctgctattcagcagagaggaattgttcctttctgcaagggccttgatgtcattcagcaagcacagtcgggtacaggaaagacagcaactttctgttctggtatcttgcagcagcttgactacggcctggttgaatgccaggccttggtccttgcccccacccgtgagcttgctcagcaaattgagaaggtcatgcgtgcgcttggtgactaccttggtgtgaaagttcatgcttgtgtgggaggaacctctgtccgtgaggaccaaaggattcttgctagtggtgtgcatgttgttgttgggacacccggtcgtgtgtttgacatgttgcgt

SEQ ID NO: 23849 - protein, 174 aa, Panicum virgatum
  misc_feature: Ceres CLONE 1830833
  misc_feature (65)..(174): Pfam Name: DEAD Pfam Description: DEAD/DEAH box helicase
  misc_feature: Useful for making plants with altered alkaloid content
  misc_feature: Useful for making plants with altered lignin content
MAGMSPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDML

SEQ ID NO: 23850 - DNA, 425 bp, Panicum virgatum
  misc_feature: Ceres CLONE 1830837
  misc_feature: Encodes the peptide sequence at SEQ ID NO. 23851
aatcctctccctcttttctctgttgtgacctcacgggttgctataggccactgcgctcggttaccagcgccaagctgccccctcaatggcgtcccccatgctcggtgcatctccactcctcccgttggtgtgcgtcctcctgggggccgcgtcgtccacagtggtcgggctccaccagctactccccagcagcatccagaaaccagcatagcacttacctgtcgcccaactgcctggtgctcccggcttccctggcggacttcggccccctgagccacggctctacgtcccacactgttttgttcctttctgcggaggacctcctgtcccactactccggcgagggcggcgccatgctgtacatgcctgccgggaagtgggtgactggtcccttcaacctgactagccacttcaagctcttcctg

SEQ ID NO: 23851 - protein, 140 aa, Panicum virgatum
  misc_feature: Ceres CLONE 1830837
  misc_feature: Useful for making plants with altered carbohydrate content
SSPSFLCCDLTGCYRPLRSVTSAKLPPQWRPPCSVHLHSSRWCASSWGPRRPQWSGSTSYSPAASRNQHSTYLSPNCLVLPASLADFGPLSHGSTSHTVLFLSAEDLLSHYSGEGGAMLYMPAGKWVTGPFNLTSHFKLF

SEQ ID NO: 23852 - DNA, 645 bp, Panicum virgatum
  misc_feature: Ceres CLONE 1830840
  misc_feature: Encodes the peptide sequence at SEQ ID NO. 23853
cctcctcccacctgctcttgctctcccgccagcaggcggcctccctccgatgccgcctctcgttcctcggccaacccaggaggcccggcagggccgcggccgcccaggcccaggcgccgggggccggcgtgcggtgcatggcggccgtggacacggcgcccgcggccacggagacgagcagcgccaagagcagctacgagctcgtgacgctcacgacgtggctgctgaagcaggagcgggccggggtgatcgacaacgagatgaccatcgtgctggccagcatctccacggcgtgcaagcagatcgcggcgctcgtgctgcgcgcgcccatctccaacctcaccggcgtccagggcgccgtcaacgtgcagggcgaggaccagaagaagctcgacgtcatctccaacgaggtgttctctaactgcctcaagtcgagcgggcgcaccggcgtgattgcgtcggaggaggaggacgtgccggtggcggtggagcagagctactcgggcaactacatcgtcgtgttcgaccccctcgacggctcctccaacatcgacgccgccgtctccaccggctccatcttcggcatctacgcccccaacgacgagtgcctcgccgagatcgaggacaatgggacccttgattccg

SEQ ID NO: 23853 - protein, 214 aa, Panicum virgatum
  misc_feature: Ceres CLONE 1830840
  misc_feature (68)..(214): Pfam Name: FBPase Pfam Description: Fructose-1-6-bisphosphatase
  misc_feature: SWISSPROT Homolog: EC 3.1.3.11 Fructose-bisphosphatase
SSHLLLLSRQQAASLRCRLSFLGQPRRPGRAAAAQAQAPGAGVRCMAAVDTAPAATETSSAKSSYELVTLTTWLLKQERAGVIDNEMTIVLASISTACKQIAALVLRAPISNLTGVQGAVNVQGEDQKKLDVISNEVFSNCLKSSGRTGVIASEEEDVPVAVEQSYSGNYIVVFDPLDGSSNIDAAVSTGSIFGIYAPNDECLAEIEDNGTLDS

SEQ ID NO: 23854 - DNA, 1327 bp, Panicum virgatum
  misc_feature: Ceres CLONE 1830850
  misc_feature: Encodes the peptide sequence at SEQ ID NO. 23855
aattgtctgctccgtggttctgtgaaggagcaagaagaggacatggaggaagaggaggggcggaaggggataccttccctgctgaaaccaccatccccgcctgaaactgaagctggttctctgcagcaggaacacatcgcctctgatattacccagctcgtaggatggacaccactgatagaagtgaaaagaatcacccagaaggatgagggcaatgcccggattgttggcaagttggaatgctaccaacctctttgctctgtcaaggaccgcagcgctctgagaatggttgaagatgcagaggagaaaggccttatctcacctggcgtcacgacactggttgagccaactagcggcaatatggggataggtttggcgtacattgctgtgctcagaggttacaggttcgtagcagtcatgcctgctgagtactcacttgacaagcagatcttgttgcgatatctgggagcagaggtggttttaactaatcctacacttggctttcagggacaacttgacaaagtggaacacctcaagaaagaaatacccaatgtgcatgttctcgatcagtttgcaaatgcagctaatcctgaagcccacttcacatggactggacctgagatttggaaggatacggcaggcaaagtagacatatttgtggctggctcaggcactggaggtactatttctggtgttggtaaatatttgaagatgaagaacccagctgtgaaggtcatttgtgttgagcctgctgaaagtccagttatttcaggtggcaagccttctcggcataaaatccagggagttggcccaggatttgtacccaagaacttggacacctccctcgttgatgagatcattacagtaactgcagaagatgcaatggagaatgcaaggaggttggcaagggaagagggcctgctagctggcatatcatctggagcaaatttggcagcttgcctgaaggtggcatcaagagaagagaacaaagggaagatgattgtcacagtgttcccaagtggtggcgaaagatacatgaactctgacctctttgcagctgtaagagaggaatgcatcgccatgaccttctgatctcgacacttctgcagatctgctgatctggagtcgtgttctgctctggcatggaaggatgtgtagtccatttgcaggaagcaatttataaatgttgttgatcagaaacctttatagacttttgggtttgttgtagttgggcgtgcttgtttgctttctacttttctagattgacatcgaactttcagcataaaaaatcagcaaagctataacaaaatcagcaaagctattacag

SEQ ID NO: 23855 - protein, 349 aa, Panicum virgatum
  misc_feature: Ceres CLONE 1830850
  misc_feature (36)..(326): Pfam Name: PALP Pfam Description: Pyridoxal-phosphate dependent enzyme
  misc_feature: SWISSPROT Homolog: EC 2.5.1.47 Cysteine synthase
  misc_feature: Useful for making plants with modulated cold sensitivity
MEEEEGRKGIPSLLKPPSPPETEAGSLQQEHIASDITQLVGWTPLIEVKRITQKDEGNARIVGKLECYQPLCSVKDRSALRMVEDAEEKGLISPGVTTLVEPTSGNMGIGLAYIAVLRGYRFVAVMPAEYSLDKQILLRYLGAEVVLTNPTLGFQGQLDKVEHLKKEIPNVHVLDQFANAANPEAHFTWTGPEIWKDTAGKVDIFVAGSGTGGTISGVGKYLKMKNPAVKVICVEPAESPVISGGKPSRHKIQGVGPGFVPKNLDTSLVDEIITVTAEDAMENARRLAREEGLLAGISSGANLAACLKVASREENKGKMIVTVFPSGGERYMNSDLFAAVREECIAMTF

SEQ ID NO: 23856 - DNA, 1196 bp, Panicum virgatum
  misc_feature: Ceres CLONE 1830872
  misc_feature: Encodes the peptide sequence at SEQ ID NO. 23857
atctcttcctgctccctttcccctttcctcctgtcttttctttctttctttcctctagatctcgacagccggagctctagggcggcaggacggaggtgctgcgcggcagcccggcggtgcggcagcccaacggcggggaggcccggcaatccagtggtggggaggtccacgagcttcccgaggcgagcggcgctgcaaagctccgcgcgcgtcacgacggcccggtggcgttcgcctccggcaagcccccgcgggtttcaagttctgtactacacaaccttgacattgttggccagggggcatgagagtgtctatgaagctgttgagcagccgctgctattcgcacagactgctgccttactggagattcttcatgctattgtatttgtagggtttgtgagatctcccatctctgcaactattccacaactttctgggaggttgtttgttacatggggcatcttgtggagctttgctgagacacattcccacgttctcgttacttccttggtcctaagctggtctataactgaggtcataagatactctttctttggtttgaaagaagcatttggaattataccttacaggcacctgtggcttaggtacagtacatttcttgtgttgtatcctatcggtcttgtcagtgagcttggcttaatctatgccgcccttccttccatgaaggcatctggaaaatactgtctcaagatgcctaacaaatggaattcctcctttagctactactattttagtattattttatccatcctctacattccagggtttccatacttgttccattatatgctcacccaaaggaagaaggccttatcaaaggcaaaagctgcataatacttcataagagcttcctagttctggagtatccagtaacctgagaatggtggctcttgtttgcaacttaaacttcagtggaagcctgcagactggggaattatactactcttatattatctgttgcgataatgataaattaaaataaaactagataaggataatgttccacaaaagttaaatttgttaatagaagttttttatccttttgcaaatggagccacttccccagaatagaaccaagagggcctgtactaccatcatttttttaggtcaagatgcggtcattactcaaacctcaaatgagaaagaatgattagaaaggagaggtggatcagatc

SEQ ID NO: 23857 - protein, 284 aa, Panicum virgatum
  misc_feature: Ceres CLONE 1830872
  misc_feature (116)..(282): Pfam Name: PTPLA Pfam Description: Protein tyrosine phosphatase-like protein, PTPLA
  misc_feature: Useful for making plants with modulated drought sensitivity
ISSCSLSPFLLSFLSFFPLDLDSRSSRAAGRRCCAAARRCGSPTAGRPGNPVVGRSTSFPRRAALQSSARVTTARWRSPPASPRGFQVLYYTTLTLLARGHESVYEAVEQPLLFAQTAALLEILHAIVFVGFVRSPISATIPQLSGRLFVTWGILWSFAETHSHVLVTSLVLSWSITEVIRYSFFGLKEAFGIIPYRHLWLRYSTFLVLYPIGLVSELGLIYAALPSMKASGKYCLKMPNKWNSSFSYYYFSIILSILYIPGFPYLFHYMLTQRKKALSKAKAA

SEQ ID NO: 23858 - DNA, 689 bp, Panicum virgatum
  misc_feature: Ceres CLONE 1830874
  misc_feature: Encodes the peptide sequence at SEQ ID NO. 23859
gctgcagcgccggcgtgatcgccgtcgacctggcccgcgacatgctgcaggccagcggcgccgggctggccgtggtggtgagcacggaggctgtctccttcacgtggtacccggggaagcggcggtcgatgctgatcccgaacgccttcttccgcgccgggtgcgccgccgtgctgctgtccaaccggcggcgcgacttccaccgcgccaagtaccagctggagcacgtggtgcgcacgcacaagggcgccgacgaccgagccttccggtccgtgtaccaggaggaggacgagcagcggatcaagggcctgtccatcagccgcgacctgctggaggtgggcgggcacgcgctcaagaccaacatcaccacgctgggcccgctggtgctgcccttctcggagcagctgctcttcttcgcgggggtgctgttccgccacctgttcccgtccaaggcctcggcgccgccgccggggcaggaggcctccgccgccgccgcgccctacatcccggacttcaagcgcgcgttcgagcacttctgcatgcacgcggcgagccgcgacgtgctggagcacctgcaggccaacctggggctgcgcgacgccgacctggaggcctcccgcgccgcgctgcaccgcttcggcaacacctccagcagcagcatctggtacgagctggcctacctggacgcc

SEQ ID NO: 23859 - protein, 228 aa, Panicum virgatum
  misc_feature: Ceres CLONE 1830874
  misc_feature (1)..(146): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature: The sequence is a functional homolog of SEQ ID NO 2 in US patent 7038112
CSAGVIAVDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASAPPPGQEASAAAAPYIPDFKRAFEHFCMHAASRDVLEHLQANLGLRDADLEASRAALHRFGNTSSSSIWYELAYLD

SEQ ID NO: 23860 - DNA, 637 bp, Panicum virgatum
  misc_feature: Ceres CLONE 1830891
  misc_feature: Encodes the peptide sequence at SEQ ID NO. 23861
gaggctccgcctccgagcaccaccaaaccctagatctcgcaccggcggcggcggcagcagcagccatggccaagccctggggcggcgtctgcgcgtgggcgctggacgccgagcgcgccgaggaggaggagcgcgagcgcgccgcggccgtcccgccgcccgagcccgccggcggcgccgccagcttccccagcctccgcgaggcggccgcggccggcgggggcaagtccaagaagaagaacaagggcaccaccctctcgttctccgagttcaccacctacggcgcggccgcggcccagcgccgcgccgcgcccgtggagcccaggggcctcactccggacgagatgatgatgctgcccacggggccccgggagcgctccgccgaggagctcgaccgctcccgcggcttccgctcctacggcggcggcgggttcggcggccccggcggaggcgagcgccgcgggttcgacgaccagggccgccgcgggccgggccggagctcggatctcgacatgccctcccgcgccgacgaggtcgacgactggggggccactaagaagttcaccccggcggccaccgactctggccgccgcgacaggttcggcggaccgtccccgctcggccgcgcggatgacat

SEQ ID NO: 23861 - protein, 190 aa, Panicum virgatum
  misc_feature: Ceres CLONE 1830891
  misc_feature (1)..(190): Pfam Name: eIF-4B Pfam Description: Plant specific eukaryotic initiation factor 4B
MAKPWGGVCAWALDAERAEEEERERAAAVPPPEPAGGAASFPSLREAAAAGGGKSKKKNKGTTLSFSEFTTYGAAAAQRRAAPVEPRGLTPDEMMMLPTGPRERSAEELDRSRGFRSYGGGGFGGPGGGERRGFDDQGRRGPGRSSDLDMPSRADEVDDWGATKKFTPAATDSGRRDRFGGPSPLGRADD

SEQ ID NO: 23862 - DNA, 626 bp, Panicum virgatum
  misc_feature: Ceres CLONE 1830893
  misc_feature: Encodes the peptide sequence at SEQ ID NO. 23863
gaaactgcaaaccagtagcgaaatggctcccgctaaggaacgcctccacagccttctgctcctgttcatagcttgcatcctcaagcttagcaccgcagtgccctgcctcccggatcaggcttcttccctcctccagctaaaagcttccttcatcggtgacagtttaccatcatggcgagctggaacggattgctgccaccactgggagggtgtcacctgtgacatggccttgggaagagtcatttcccttgacctcggtgagttcgacctgatgagccgtcgtcttgatcctgcgctcttcaacctcacctccctcaggaacctcagccttgcattcaatgacttcaacgaagcctttctcccagtttctgggtttgagcggctcacagatatgatccacctcaacctctcgtgggcccattttgggtatcgtatcccaattggaatagcctgcctcaagaaccttgtcaccattgacttgtctggtaattatcatctgtatttcgaacggccaaatttccaagacttcatggcaaatatgagcaatctgagggagctttatcttgaccaaatggattttcgggacagtgcatcaacttggtccactgttttagcagattctgttc

SEQ ID NO: 23863 - protein, 201 aa, Panicum virgatum
  misc_feature: Ceres CLONE 1830893
  misc_feature (29)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPAKERLHSLLLLFIACILKLSTAVPCLPDQASSLLQLKASFIGDSLPSWRAGTDCCHHWEGVTCDMALGRVISLDLGEFDLMSRRLDPALFNLTSLRNLSLAFNDFNEAFLPVSGFERLTDMIHLNLSWAHFGYRIPIGIACLKNLVTIDLSGNYHLYFERPNFQDFMANMSNLRELYLDQMDFRDSASTWSTVLADSV

SEQ ID NO: 23864 - DNA, 661 bp, Panicum virgatum
  misc_feature: Ceres CLONE 1830895
  misc_feature: Encodes the peptide sequence at SEQ ID NO. 23865
gattgctctcgctcactcgcgcggcggcactcctctcagtcagggctcgcgcgcaatgtttaggggttgcggtctctttggccgcgcgcgccggggccgcggcgacctccggaagcgcggggagatgggcggggcgagctcgcgcgtggcgccggccgagccggtgggcgcggaggaggcggaggagcagggcggcggcgtggcgaggcagctggcgtgggccgaggtggaggccgccacgcgcgggttctcgtcccgggtggtcggccgcgacgggtgcagcacggtgtacctcgcctcgctccccgcctcgcgcctcggcgccgtcaaggtccactgcagcagcgagcgcctgcaccgcgccttccgccgggagctcgacgtgctcctctcgctccgccacccgcacatcgtccgcctcctcgggtactgcgacgagcgggacgagggcgtgctggtgttcgagtacgcgcccaacggcgacctccacgagaggctccgcgccggcggcgcggccggggccctgccctgggcgcgccgcgtcgccgtcgcgtcccaggtggccgcggcgctggagtacctccacgagggccgcgacccgtcggtcatccacggggacatcaaggcctccaacgtgctcctcgacgccaacctggacgcc

SEQ ID NO: 23865 - protein, 201 aa, Panicum virgatum
  misc_feature: Ceres CLONE 1830895
  misc_feature (67)..(200): Pfam Name: Pkinase_Tyr Pfam Description: Protein tyrosine kinase
  misc_feature: SWISSPROT Homolog: EC 2.7.11.1 Non-specific serine/threonine protein kinase
MFRGCGLFGRARRGRGDLRKRGEMGGASSRVAPAEPVGAEEAEEQGGGVARQLAWAEVEAATRGFSSRVVGRDGCSTVYLASLPASRLGAVKVHCSSERLHRAFRRELDVLLSLRHPHIVRLLGYCDERDEGVLVFEYAPNGDLHERLRAGGAAGALPWARRVAVASQVAAALEYLHEGRDPSVIHGDIKASNVLLDANLD

SEQ ID NO: 23866 - DNA, 1171 bp, Panicum virgatum
  misc_feature: Ceres CLONE 1830905
  misc_feature: Encodes the peptide sequence at SEQ ID NO. 23867
aaagagcctcgcgcgaccaccaacctatttttacacgccgcacgccgccgccgccgccgccgccgcctatacgtccccctgctccccccacctctttcttcttcttcttcttcttctccctctcgcgcgcccccgcacgccaaggcctccccgcacggcgccggcggtgcatgggcggccggacaacggcggcggcggcgacgaccaccggggcgccatgaccaccgccaccgccaccgccgtgaacgcgccggcggtcgcgcagctccgcgccggcgcccgccgccggaaggcggcgcagggccagggcccccggctcgacctgcgctgggcgcgcctgctccgcgtcgccgtcgtcagccgggtgctccgcttcgtgcgggaccagctgctcgcgtgctcctcctgcggcggcgggggcggcggcggcggcggcaggggcgcccggtaccgccgcctcggcccgcccgcgctgaccccggtggacaggggcgacgcctgcgtccccgccgccggcgacgccgacgacgcggcgccttgcgacgcggccgccgacggcgagaacgtcgtcagcctcaaggtcagcctgctcggcgactgccagatcggcaagacaagcttcatggttaagtatgtgggagatgacggggaggagcagaacggcttgcagatgacgggcctgaatctcatggacaagacgatggccgtccggggagctaggattgcctacagcatctgggatgtagcaggagacatccaagccgtcgaccacatcccaatcgcgtgcaagggcgccgtggcgatcctgtacatgttcgatctcacgagccggtgcacgcttaataatattctagattggtacgagagggcgaggaaatggaataagacggctattccaatcctaatcgggacaaagtttgatgactttgctcagattcctcttgaaatgcaatgggccattgttaaccaggtgagcactgcattttagaatactggtttgttctgatcgaaatgttgttcttggtagctttgcttcttggatacggggccttcagcatttccaatgtggtttttatctggctagcatagaaagctgagaacttgccttggttctgacgtgggtagctgtgatgcacatgcctgttttcatctgaaacgatgcagttcaacc

SEQ ID NO: 23867 - protein, 256 aa, Panicum virgatum
  misc_feature: Ceres CLONE 1830905
  misc_feature (121)..(235): Pfam Name: Miro Pfam Description: Miro-like protein
MTTATATAVNAPAVAQLRAGARRRKAAQGQGPRLDLRWARLLRVAVVSRVLRFVRDQLLACSSCGGGGGGGGGRGARYRRLGPPALTPVDRGDACVPAAGDADDAAPCDAAADGENVVSLKVSLLGDCQIGKTSFMVKYVGDDGEEQNGLQMTGLNLMDKTMAVRGARIAYSIWDVAGDIQAVDHIPIACKGAVAILYMFDLTSRCTLNNILDWYERARKWNKTAIPILIGTKFDDFAQIPLEMQWAIVNQVSTAF

SEQ ID NO: 23868 - DNA, 1475 bp, Panicum virgatum
  misc_feature: Ceres CLONE 1830910
  misc_feature: Encodes the peptide sequence at SEQ ID NO. 23869
ctcctcctcctccctgcctcgccctccccctttcccctccgcgtccagggcccgggccacccacccagccgcggatccgaggcgcagatccgatccggcgatggcgtccacggcggcgaggcggctgcgggagctgcaggcgcagacggggaacaagacctgcgtggactgcgcgcagcggaacccgcagtgggcgagcgtctcctacggggtgttcatgtgcctcgagtgctcgggcaagcaccgcggcctcggcgtgcacatcagcttcgtgcgctccgtcaccatggactcctggaccgaggcgcagctccgcaagatggaggccggcggcaacgaccgcctcaacgccttcctcgccgcgcggggcgtgcccaaggagacgccccacgtcgccaagtacaactccaacgccgcggccgcctaccgcgaccgcatcgtcgcgctcgccgagggcaggccgtggaccgacccgcccgttgtcaaggagacgcccggatctggggcgcccgcccccgccaggaagccgcccgtgcacgcctccgccgcgtccggaggcggcggtggcggcgacggcggctgggacgagtgggacgacgacttccggccggacatgaggcggaaccaatcggttggatcattcgccgctgcggggacgcagtcggggaggcagccgcctaggtccaaatcgacgcaggacatgtacactaggcagcagctggaggcgtcggcggcaaataaggaggatttcttcgccaggaggatggcggagaacgagtccaagcctgaggggatcccgccatctcagggcggcaagtacgttgggttcggatccagcccggcgccgtcggcgaataggaatggcggtgctgcccagggcgatgtcatgcaggtcgtctcccatcgcactcaagctcagccgctacaacttgctcgctcgatctgggctctatctgatattttctcccctcttcctcctactcggcggccgagataaaagagatcgatcgagaagatgtcggacggcacggcgacctgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagacgatcgacatcttcttcattcgaggtgataatgtgggacctcaagcgcgtgattattctggtgtaatctgctagctgcagctgtttgaaacgttgtaattttttttttcttctagtagtttctggttttccttgtttcttttgctttgggcgcggcgtacagtgcgcaccgtgctgggcgcgtcgtacgtcggcctggtgttattgctctgtatcgtccagttcctctgcacatttccgtccctgtactttgattaattaattgattcgtccttaatttcttcggtgg

SEQ ID NO: 23869 - protein, 298 aa, Panicum virgatum
  misc_feature: Ceres CLONE 1830910
  misc_feature (6)..(122): Pfam Name: ArfGap Pfam Description: Putative GTPase activating protein for Arf
MASTAARRLRELQAQTGNKTCVDCAQRNPQWASVSYGVFMCLECSGKHRGLGVHISFVRSVTMDSWTEAQLRKMEAGGNDRLNAFLAARGVPKETPHVAKYNSNAAAAYRDRIVALAEGRPWTDPPVVKETPGSGAPAPARKPPVHASAASGGGGGGDGGWDEWDDDFRPDMRRNQSVGSFAAAGTQSGRQPPRSKSTQDMYTRQQLEASAANKEDFFARRMAENESKPEGIPPSQGGKYVGFGSSPAPSANRNGGAAQGDVMQVVSHRTQAQPLQLARSIWALSDIFSPLPPTRRPR

SEQ ID NO: 23870 - DNA, 1014 bp, Panicum virgatum
  misc_feature: Ceres CLONE 1830940
  misc_feature: Encodes the peptide sequence at SEQ ID NO. 23871
ctacctcgcagccccgagcccggccgaagcttctggcgacgttgtccggatctactcccccaccctcgaccctcccgtcgttggcctcgtggttgcggcggcgatgaggggctccacagctgccctcatggcggcggcgctgctgatgctgctggtgtcgacggcgctgctgatgctgctggtgtcgccggctgccccggacacgtacgagcaggtggcccgccggatgttcgtggagtggaaggccaagaacaagatgacctataaatacgccggcgaagaggagtgccggtacgcggtgttcaggagcacccgctgccgcgtcgcccgggccaacgccgccgggaggaccccatccggcctcaacggtctcagcggctacgtcagtgaggaggtcttacgtgggcacggggtccggacgggggagaaatcgtacgaggaggagacccgccggatgttcgtggggtggaaggccaagtacgggaagacctacagagacgccggcgaggagctgtgccgttacatgttgttcaaggccaatcgccgcttcgtcgttaagctcaacgccgcagccgccggggaaacagcatacggcctcaaccaattcggcgacctcgctgacgaggaggtccgtggatgctacgacgggcgcggcgaggagatggggggaaagctcagcgccaggtgccatgagaggctgattcagtctcaggagggaaagctcagcgccaggtgccaggccgccgtcgcaggggacaccatctatgagaggctgattcagtcccaggtttgccggtgcgttgctttggaactgaaacaaacagagtctggaggtagcgtcattcctggagatgaagcacacatgtggatctgaacgtcactcccatttgttgccagacagccagagaattttagaataaagatgttgctaatgtaatatggtaactttgagatgaaaatgtatgcattcccaacctatgataaagatcgttctgatgtgtgttttcggttgtc

SEQ ID NO: 23871 - protein, 256 aa, Panicum virgatum
  misc_feature: Ceres CLONE 1830940
  misc_feature (119)..(176): Pfam Name: Inhibitor_I29 Pfam Description: Cathepsin propeptide inhibitor domain (I29)
  misc_feature: SWISSPROT Homolog: EC 3.4.22.14 Actinidain
MRGSTAALMAAALLMLLVSTALLMLLVSPAAPDTYEQVARRMFVEWKAKNKMTYKYAGEEECRYAVFRSTRCRVARANAAGRTPSGLNGLSGYVSEEVLRGHGVRTGEKSYEEETRRMFVGWKAKYGKTYRDAGEELCRYMLFKANRRFVVKLNAAAAGETAYGLNQFGDLADEEVRGCYDGRGEEMGGKLSARCHERLIQSQEGKLSARCQAAVAGDTIYERLIQSQVCRCVALELKQTESGGSVIPGDEAHMWI

SEQ ID NO: 23872 - DNA, 1314 bp, Panicum virgatum
  misc_feature: Ceres CLONE 1830944
  misc_feature: Encodes the peptide sequence at SEQ ID NO. 23873
gtccactcccttcctgaccctcgtcctctccttatccacgcagccttgcccctcgtcagatccacccacgcacaaggctccagcgctgggtgcgcaggccgcgctcgccctcctcctcaacttcacgctgctcgcccggtcgggctccgcccggctgctctctcctagggccgtgcgccctttcttgactcctgcccgagccgcgccgccgccaggggttcggtcggccaccggccatgcccgccagcgctgccgccaatgtagcacgcgcaggaggcacctgctcatggctggccgcgggcgtggtggagacgctcaggtggcgcggtggaggggcgctggtggaggggcccctgtgctcgtggccggccgccgtgcgcggtggagaggcgcgggcactgcgggctgcgcgcgtgccgtggctgtggctcgccgccgcatgatgcacgcgccgcagctctggccgctgccgctcgcagccgcgggcacggcctgagcgggtcccccgcaagcagcgccgccaagcatggcgcggctgacggcaaaaccaatgcggtgttcgcgtagatctacaccaacatgaccttgtaccacagctccatatgttgcacgttctttcgatttccctttgccgatttgttcatgtcctgctctgatcttgagtgttcgcgtcagcaggtgtaccctcacggatccaacttgactggatccatgtccaccggatccatcgctgctgcatcgtccccgctgggatggggagaggcggccctcccctccgtatgctcatcctccttggaggagggaaatacattaccatggtggaactgctgagtaggctctgatcgccatatctgttgggcctgattggccattgttctgaaggtgtacaaaggctacttgtgtatgagttcatggcaaatggggggctccaggagcacctctatccaaacagaggttcctgtggtgggatctcaaaattggactgggatacaagaatgagaagtgcacttgaagcagcaaaaggtttggaatatcttcatgagcctgttaatccacccgtcatacacagagacttcaagagcagcaatattcttctggacaaggacttccatgcaagagtttcagactttggtctagccaaacttggatctgatagagctggtggtcatgtcaactcaagttttaggcacacaaggctatgttgcataccttaagtgtttcttgattacacatgatctattggatttgattgtctttttctgtttacaaaacttgtacaaaattatgaagatgacattatgagttttttttgct

SEQ ID NO: 23873 - protein, 100 aa, Panicum virgatum
  misc_feature: Ceres CLONE 1830944
  misc_feature: SWISSPROT Homolog: EC 2.7.11.1 Non-specific serine/threonine protein kinase
  misc_feature: Useful for making plants with altered cell wall content and/or composition
  misc_feature: Useful for making plants with altered carbohydrate content
MANGGLQEHLYPNRGSCGGISKLDWDTRMRSALEAAKGLEYLHEPVNPPVIHRDFKSSNILLDKDFHARVSDFGLAKLGSDRAGGHVNSSFRHTRLCCIP

SEQ ID NO: 23874 - DNA, 1362 bp, Panicum virgatum
  misc_feature: Ceres CLONE 1830945
  misc_feature: Encodes the peptide sequence at SEQ ID NO. 23875
cctcctcaaagccccaggctcccccaactccctctccttgctcgctcgctctccatggacgctccaggaagctgcacgcctcctgcacgctaagtgatcacagaagctagctgctgccaagatttaccagttttgaccctgaaccaaacaggagctacctgctagctagctcctggtagaagcagcagcggctaacagtgtgcccgagcaggtgtactagctaatagctaagcgagctagctcgttatagctgtgcgcgtagcttgattgattggctagcggtattagcgttaggtagctggtgaatttttttgttggggggcatggagagcgcgccggtgctggtgaggcacgccggcggcgtggccgtggcggcgctgcggcagctgccgccggggttccggttccgccccacggacgaggagctggtggtgcagtacctccgccgcaaggccctgggcgtgccgctccccgccgccgtcatccccgtcgtccgcgacctctacagcctcgacccctgggacatccctgccgccgctgcagcagatgcgagcgagggggagaagtacttcttcgcggtccggccggcgggcgtcggcggcagcggatgcagcggcaagctgggcggcggcgccagggcagcgaccgcgagcgggcgttggaagccgtcggggaaggagaagccggtggtcctgccccggccgtgcggcggcgggagcctcctcgtcggcgtgaagcgagcgatgacgttcgcgccccggcggaataagaagaaggcgtcgtcggccgccctggccgccgggtgggtcatgcacgagtaccgccttgccgcgccgctgcacaagaacggctgcagcctggcgcaggccgaaggggagtgggtggtgtgccgggtcttccagaggagcagcaacagcaacagcccgagacggcgagcgacgccaccggccgccggccacgccgccgccgcgtcgccgtcgtcgtcgaccgccagctgcgtcacggacggctcggaccaggaggaggtcagcagctagcgacctcgcggccggccggccccaagaaacgcaaggtctgcacagctgctgctagcttgctgtgcctctcaaagagaggctggatcggagctgagttagcctatagccttaggctgaaaccaggaaacgaaaacgacctgccgaccttacttaattttcttgcttgctccaacatttcttgtcactttagttccttctctctttctctctctctctccccatctgtataatgtaatgcagtgtaatctagtgagaggaagcaggcagtaccggatcattaacaaacaagttaatcaggttcaggaagcttctagttgaggttttc

SEQ ID NO: 23875 - protein, 237 aa, Panicum virgatum
  misc_feature: Ceres CLONE 1830945
  misc_feature (22)..(169): Pfam Name: NAM Pfam Description: No apical meristem (NAM) protein
MESAPVLVRHAGGVAVAALRQLPPGFRFRPTDEELVVQYLRRKALGVPLPAAVIPVVRDLYSLDPWDIPAAAAADASEGEKYFFAVRPAGVGGSGCSGKLGGGARAATASGRWKPSGKEKPVVLPRPCGGGSLLVGVKRAMTFAPRRNKKKASSAALAAGWVMHEYRLAAPLHKNGCSLAQAEGEWVVCRVFQRSSNSNSPRRRATPPAAGHAAAASPSSSTASCVTDGSDQEEVSS

SEQ ID NO: 23876 - DNA, 1472 bp, Panicum virgatum
  misc_feature: Ceres CLONE 1830947
  misc_feature: Encodes the peptide sequence at SEQ ID NO. 23877
attgaagcaagaaagagacgccggggatgagcaggattcgcgggaaaggaaggagcagcaagcaagctgcaagggagagccgtcagctcaagaggatcgtcaagagcaagaagatgggcagcacgcagcagcagcagctgctcctgcagctcttcttattcttcctcctatctgcggtcgccccgcaggtagtcagagcagtgaaaccaatcccaaattccattcttggggtcgaggaaggagacaattccataggaatcatacagaaggacatcatagaggtggtcaacaagcatcccaatgctgggtggacggctgcacacaatccttactttgccaactatactgtaagtgaaatagcattcataattttatcttttccccgcttgttgaccttgaaaccatccctgttcctgcagattgcacaatttaaacgtatccttggagtgaagcccacaccaaagagtgtgctgaccgatgttcctgccaaaacttattcaagatcactgaaatttccaaaggagttcgacgccagatctaagtggtctcagtgcagcacaattgggaacatacttgagcatttcactatcagtcaatgacctactggcatgctgcgttttatgtgcggtgatggttgtgatggaggctatcctatcatggcatggcgctactttgttcaaaacggtgttgtcacagaggagtgcgatccatattttgatcaggttggttgcaagcatcctggatgtgaacctgcttatcctacactagtgtgtgaaaagaaatgcaaggtccagaaccaagtttgggaagaaaaaaagcatttcagtgtcaatgcgtacagaataaattctgatccagatgacataatgtcagaggtctacgaaaatggccctgtagaagttgctttcaatgtttatgaggattttgcccactacaaatctggagtatacaagcacattaccggtggcatgatgggtggccatgccgtcaagttgattggatggggaaccagtgatgctggagaagattactggcttcttgcaaatcagtggaacagaggctggggtgatgacgggtacttcaagatcatacgaggcagaaacgaatgtggcatcgaagaggacgttgttgctggaatgccatccacaaagaatatggtcagaaactacggtggttcctttggaacagctgtagtttgatcgctgccctaggactgaaatactgtcggatcggatagccatgtatttgtatagctgatgaactttgtaaagtactagccttgatggtgcatgtattttgtacaccagcacgttggcaaggctggcactggcaggttgctgagatggcaacttctgttctgaaacatttacgacagttgtggctgttccattttaagattcagctgtgtaacagaaagacagacagacataataagacgcctgctgcataagtgagtgcaaattgatacagcg

SEQ ID NO: 23877 - protein, 190 aa, Panicum virgatum
  misc_feature: Ceres CLONE 1830947
  misc_feature (79)..(146): Pfam Name: Propeptide_C1 Pfam Description: Peptidase family C1 propeptide
MSRIRGKGRSSKQAARESRQLKRIVKSKKMGSTQQQQLLLQLFLFFLLSAVAPQVVRAVKPIPNSILGVEEGDNSIGIIQKDIIEVVNKHPNAGWTAAHNPYFANYTVSEIAFIILSFPRLLTLKPSLFLQIAQFKRILGVKPTPKSVLTDVPAKTYSRSLKFPKEFDARSKWSQCSTIGNILEHFTISQ

SEQ ID NO: 23878 - DNA, 693 bp, Panicum virgatum
  misc_feature: Ceres CLONE 1830954
  misc_feature: Encodes the peptide sequence at SEQ ID NO. 23879
agggtttccttgtctccttacaaagcttcctctttccgccgccgccgccgcccctcaccgcgctgcagagaaccctctcacctcgctcgcggtcgcctcccagatctccccatggcgtcggagaagaaacagtcgaacccgatgcgggagatcaaggttcagaagctcgtgctcaacatctccgtcggcgagagcggtgatcgcctcacccgcgccgccaaggtactcgagcagctgagtgggcagtcaccggtgttctccaaggcgaggtacactgtgaggtcgttcggcatcaggcgtaatgagaagattgcgtgctatgtgacagtgaggggagagaaggcgatgcagctgctggagagtggcctgaaagtcaaggagtatgagctgctgaggaggaacttcagtgagactggctgctttgggtttggtatccaggagcacattgatcttggcatcaagtatgacccatctaccggtatctacggcatggacttctacgtcgtccttgagcgtgccgggtaccgtgttgcccgccgccgcaggtgcaagtcccgtgttggtatccagcacagggtcaccaaggaggacgccatgaagtggttccaggtcaagtacgagggcgtgatcctcaacaaggcccaagccaacacctcctaagtttcacaagaccttagcccccctctagagctc

SEQ ID NO: 23879 - protein, 182 aa, Panicum virgatum; identical to SEQ ID NO: 12122
  misc_feature: Ceres CLONE 1830954
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5

SEQ ID NO: 23880 - DNA, 531 bp, Panicum virgatum
  misc_feature: Ceres CLONE 1830956
  misc_feature: Encodes the peptide sequence at SEQ ID NO. 23881
attcgctgcttgaagaaacccccgaggcccagcccgcaatggatagacggatatagagagagggcaaggagaagagatggagggggaggaggaggatgttcgcctgggcgccaaccagttctcggagcggcaccccatcgggacggcggcccgcggcgccagggatgacaaggactattaggagccccctccggcgcctgtgttccaccccggtgagctcaagtcctggtcgttctaccgagcgtctatcgccgagttcgtccccaccttcctcttcctctacatcaccatcctccccgtcatgggcgtctcctactccaactcctagtgcgccaccgtcggcatccagggcatcccctgctccttcggatgaatgatcttctcgctcctctactgcaccgcctgcatctccggagggcacatcaatcccgcactgacgttcgggctgttcttgcccaggaagctgtccctgactagggccgtcttctacttcatcatgccatgcctctgtgctatctgaggagctggagt

SEQ ID NO: 23881 - protein, 48 aa, Panicum virgatum
  misc_feature: Ceres CLONE 1830956
  misc_feature: Useful for making plants with modulated drought sensitivity
  misc_feature: Useful for making plants with modulated water use efficiency
  misc_feature: Useful for making plants with modulated cold sensitivity
MIFSLLYCTACISGGHINPALTFGLFLPRKLSLTRAVFYFIMPCLCAI

SEQ ID NO: 23882 - DNA, 674 bp, Panicum virgatum
  misc_feature: Ceres CLONE 1830993
  misc_feature: Encodes the peptide sequence at SEQ ID NO. 23883
aaaatccgacgcgattcctccgagccgccgccgccccgatcccgctgcggaggcggcgtatcgctgccaacccgtggctccgctcgcctaccgactgaacacacaagagtgttgggaatggagatccagtcgtccggccggtccatcgacgtgctgatggagaaggtgctgtccgtgaacatcctctcctcggactacttcaaggagctctacaagttcaagacctaccacgaggtggtcgacgaaatctaccaccaggtcgaccacgtcgagccctggatgaccggcaactgccgcgggccctcctccgccttctgcctcctctacaagttcttcaccatgaagctcaccgtcaagcagatgcacggcctgctcaagcacccggactccccctacatcagagctattggatttctctacctgcgatacgttgcagaaccaaaaacactgtggacttggtacgagccctacatcaaggatgacgaggagttttcccctggatcaaatggaaaaatgactacaatgggcgtttacgtgcgtgatctccttcttggccaggtcactgtccatcttgagaagctgaagcttccaacaaagcagtcaggaatgacaggggattccaataggcatgaatcaaatgatactgcccgaaggcctccgtccgtaaaagcttc

SEQ ID NO: 23883 - protein, 185 aa, Panicum virgatum
  misc_feature: Ceres CLONE 1830993
  misc_feature (1)..(158): Pfam Name: PRP38 Pfam Description: PRP38 family
MEIQSSGRSIDVLMEKVLSVNILSSDYFKELYKFKTYHEVVDEIYHQVDHVEPWMTGNCRGPSSAFCLLYKFFTMKLTVKQMHGLLKHPDSPYIRAIGFLYLRYVAEPKTLWTWYEPYIKDDEEFSPGSNGKMTTMGVYVRDLLLGQVTVHLEKLKLPTKQSGMTGDSNRHESNDTARRPPSVKA

SEQ ID NO: 23884 - DNA, 1446 bp, Panicum virgatum
  misc_feature: Ceres CLONE 1830994
  misc_feature: Encodes the peptide sequence at SEQ ID NO. 23885
cccgcgcagccgccgtccgccgaatcgccggggaggggctttcgaggcgcgagcggaagcaagccatgtcgcggtggcgcgcggccgcctgccgcatctcggccgccgccgcatcccggaacgccgcggcggagtcccgcgtcctcgccagggcctgcgcgaagtctccgactgtgccgccgcctccgctccaaaccctctcgagaaccttctccaactccgccgccgctgccgccgccacctccaccgccacatcacgcggccctggcgcagccgccccagcttccgccgggccgagacccgaggtcagactgaattctatgttcctgtccaagccctgttcattagcgttgccacctgactccccttttagagcagcagatccacagtatgaaggcatcaagcgcttcatgctcacactgttgttgttctacagcaagcaaagcaaggccattagaggagcaaatgttgtttatgatcgaatcacttctcaagttgatgctcctgctatttatgatgtttttcagttggagaaaacatttaaaacaacattttcattgcttgttctccatatgtggcttgttctacgccgcttgaaggaagaagggaaggatggtgttaaatttggacagtacatctatgaaatgtacaaccacgatgtggagctcagagtttcaaaagctggggttaacttgctcttaacaaaatggatgaaagagctagagaaaatattctatggaaacatcgttaagtacgatgctgcgataagcgcagaggctcatcaggatgattttgtaaacgtcatctggaggaatatttatgctgaggaaggttcagaggcaatggaagcagctgctgcccctgctgtccaggcattggcaagatacacacgaagggaggcaacttgtctatcattgactgacaaagatgctatgttctctggaaacttcaagttcacatccctgctgccgccaactcccagccccagcccaaagaagcccgcacgatgaactgccatggtacatcagtgtttcatgtgaagattggtaaacagcaggatcagtggatacctgtcattctctcagcaacacaaataacaggatttttttttccatcacttgtttattctggggtcctctggatcgaaacttttgatggatatacctggttctagataggaagttcattgtcaatcttatgcaagctatccaattgctgtagctgtcctactaccagaacggagccttctttttgtttcttttctttctttcttttttttgccaatccttttccttggctgttttggacttgatcatcattccaatgggaagtgatagagaggtaaccctatagatgtgttatctaaatacgtacgtgatggctgtcatggttgtttggatgatctgggaaaagaatgcaatcaggcttatctgaagttgtcgcctt

SEQ ID NO: 23885 - protein, 314 aa, Panicum virgatum
  misc_feature: Ceres CLONE 1830994
  misc_feature (151)..(305): Pfam Name: Ubiq_cyt_C_chap Pfam Description: Ubiquinol-cytochrome C chaperone
MSRWRAAACRISAAAASRNAAAESRVLARACAKSPTVPPPPLQTLSRTFSNSAAAAAATSTATSRGPGAAAPASAGPRPEVRLNSMFLSKPCSLALPPDSPFRAADPQYEGIKRFMLTLLLFYSKQSKAIRGANVVYDRITSQVDAPAIYDVFQLEKTFKTTFSLLVLHMWLVLRRLKEEGKDGVKFGQYIYEMYNHDVELRVSKAGVNLLLTKWMKELEKIFYGNIVKYDAAISAEAHQDDFVNVIWRNIYAEEGSEAMEAAAAPAVQALARYTRREATCLSLTDKDAMFSGNFKFTSLLPPTPSPSPKKPAR

SEQ ID NO: 23886 - DNA, 1785 bp, Panicum virgatum
  misc_feature: Ceres CLONE 1831023
  misc_feature: Encodes the peptide sequence at SEQ ID NO. 23887
atccgcgtccgcgcaaacggcggtcctcctcggcatgagcggcttcttggctgtggccggtaagatcggcaccttcctgctttgggtgctcttcctggtgctgcaaacggccacccggatcgtcggcagcctcctcgctgggccagccgagcggcaggaggacccgctgcaagagtcggcggcggcagcgcgccgcaggtcgccgccagcctcgccgcgccgcgacccctacgagccggcgtctgcgccgcctcagcagctctggggcccgcctccgctgccgtactctccctctgctcccgcggcggatgagtactcctcgtcctcgagcttccggcggcggagcgcgccgccgccgctgccgtctgaggacgtagtggcccatgcgcattccgtgtcggcgcctccgctgagggcaatcgagacgcgggcggtgccagcgagggcggtggctgctgggggtaggcggcccaggctggagaggaagtactccaagattgttgaccagtaccgctccctggatgaggttattgaagcattagcacaagctggtctggagtcttccaatttaatcataggaattgatttcacaaagagtaatgaatggacaggaaagaattccttcaatggtatgagcctgcatcatattggtgacaccccaaatccttatgaacaggcaatatcgatcattgggcaaaccttatcagcatttgatgaggataatttaattccttgctatggttttggagatgcatctacacatgaccaagatgtatttgccttttatcctgatgaaagaccatgcaatggttttcaggaagctttagctcgatacagagaaattgttcctcaccttcgcctttctggtcctacatcattcgctccaataattgaaatggctacaaccattgttgagcgaagtggtggccaataccatgttttagtaatcatcgctgatgggcaggtcacacgaagtgtagataccgaatttggtcagttaagtacccaggagcaaatgacagttgatgctattgtacaagccagcgaatttcccttgtccataattctcgttggagttggagatggtccatgggatatgatgaaggaatttgatgacaacataccagctaggtcttttgacaatttccagtttgtcaacttcactgcgatcatgtcaaaaaagataagtcaaagcaaaaaggagacagagtttgccctttcagcactcatggaaattccgttgcagtacaaggcaacattagagcttggaattttaggacgtcgacttgtaaagtcgcccgagcgagttccacttcctcctccttttgcaagttatagcacagtttcaagagcagcaccatctcgggcaaatagctatcgaagcgtgccttcacgtcctagagaggagccaactgtagattcaacaatcacagcatcagtcacatccccaccagctgttgaaactagagtttcagaacccctgatgtgcccagtttgcctttccaaaccccgggacatggcatttggttgtggccaccagacatgctcggaatgtggaccacaagtcgcagattgtccaatctgtcgaaggcccattgatacgagagtaaaattgtactagtcgtcatcatgccatcatctgttgcgactaactaggtttagctgaatcgcatgtgagcaggaagtagaacccattgaaaaggaactcttattagacttgatgatgtagtgtgtatttattcaataaatcagctgtacaaagatagagaataatagttctttgct

SEQ ID NO: 23887 - protein, 528 aa, Panicum virgatum
  misc_feature: Ceres CLONE 1831023
  misc_feature (201)..(349): Pfam Name: Copine Pfam Description: Copine
MSGFLAVAGKIGTFLLWVLFLVLQTATRIVGSLLAGPAERQEDPLQESAAAARRRSPPASPRRDPYEPASAPPQQLWGPPPLPYSPSAPAADEYSSSSSFRRRSAPPPLPSEDVVAHAHSVSAPPLRAIETRAVPARAVAAGGRRPRLERKYSKIVDQYRSLDEVIEALAQAGLESSNLIIGIDFTKSNEWTGKNSFNGMSLHHIGDTPNPYEQAISIIGQTLSAFDEDNLIPCYGFGDASTHDQDVFAFYPDERPCNGFQEALARYREIVPHLRLSGPTSFAPIIEMATTIVERSGGQYHVLVIIADGQVTRSVDTEFGQLSTQEQMTVDAIVQASEFPLSIILVGVGDGPWDMMKEFDDNIPARSFDNFQFVNFTAIMSKKISQSKKETEFALSALMEIPLQYKATLELGILGRRLVKSPERVPLPPPFASYSTVSRAAPSRANSYRSVPSRPREEPTVDSTITASVTSPPAVETRVSEPLMCPVCLSKPRDMAFGCGHQTCSECGPQVADCPICRRPIDTRVKLY

SEQ ID NO: 23888 - DNA, 400 bp, Panicum virgatum
  misc_feature: Ceres CLONE 1831028
  misc_feature: Encodes the peptide sequence at SEQ ID NO. 23889
acccaccaactcaaagggggaggaacagccgccgccaacgccgccgccgccgcgcgcggagtcccaccaccactccagtactccattaccgagcgcgcgcgcgagagagagagggagaggggaggcgcctcggcggcggagatggcggcgggagcagggacgcgggaggagatggtgtacatggcgaagctggcggagcaggcggagcggtacgaggagatggtggagttcatggagaaggtcgccgcggcggcgggccccggggagctcaccgtccaggagcgcaacctgctgtccgccgccgaccgaaacgtcgtccgcccgcgccgcgcgtcgcggcgcatcctctcgtctctcgagcagaatgaggaggcacgaggcgccccggggctcgccgctg

SEQ ID NO: 23889 - protein, 86 aa, Panicum virgatum
  misc_feature: Ceres CLONE 1831028
  misc_feature: The sequence is a functional homolog of SEQ ID NO 809 in the 11/479,226 US patent application
  misc_feature: Useful for making plants with modulated water use efficiency
  misc_feature: The sequence is a functional homolog of SEQ ID NO 801 in the 11/479,226 US patent application
  misc_feature: Useful for making plants with modulated drought sensitivity
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
MAAGAGTREEMVYMAKLAEQAERYEEMVEFMEKVAAAAGPGELTVQERNLLSAADRNVVRPRRASRRILSSLEQNEEARGAPGLAA

SEQ ID NO: 23890 - DNA, 914 bp, Panicum virgatum
  misc_feature: Ceres CLONE 1831028-R
  misc_feature: Encodes the peptide sequence at SEQ ID NO. 23891
caccggctggcggtcgcctaaagaacgtcatcggcgcgcgccgcgcgtcgtggcgcagcgtctcttccatcgagcagaaggaggaggcccgcggcgccgcgggccacgccgctgccgccagggactaccgcggccgcgtcgaggccgagctctccggcatctgcgcggggatcctgcgcctcctcgacgaccgcctcgtccccgccgccgccgccgtcgacgccaaggtcttctacctcaagatgaagggcgactaccaccgctacctcgccgagttcaagaccggagccgagcgcaaggacgccgctgactccatcctagccgcctaccaggccgcccaggacatagccataaaggagctgccgcccacgcaccccatcaggctcggcctcgcgctcaacttctccgtcttctactacgagatcctcaactcgccggaccgcgcgtgctcgctcgccaagcaggacttcgatgaagccatttcagaactggacactcttggggaagagtcctacaaggatagcaccctgatcatgcagcttcttcgtgacaacctcaccttgtggacttctgacatgcaggatgatggcggcgatgaaatgagggatgccagcaagcccgaggatgagcagtagccatcgattcaagcaactgccgtctctatctcttaaccctttgggtagtcgtgatgcttgtacaaggaccattttcgtgtgtcctttatcatcggatctgcttacctttcgttttgttatattcctatattgtgttatccatgtattgttttactttcctactggaaccctgttagtgtgtgggagagaataacctaagcctgcctttaactagtacaaggattgtcaactcttttgtactatgattgaatggttatgcatgttccatatatatccagc

SEQ ID NO: 23891 - protein, 210 aa, Panicum virgatum
  misc_feature: Ceres CLONE 1831028-R
  misc_feature (1)..(196): Pfam Name: 14-3-3 Pfam Description: 14-3-3 protein
  misc_feature: Useful for making plants with modulated drought sensitivity
  misc_feature: Useful for making plants with modulated water use efficiency
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
PAGGRLKNVIGARRASWRSVSSIEQKEEARGAAGHAAAARDYRGRVEAELSGICAGILRLLDDRLVPAAAAVDAKVFYLKMKGDYHRYLAEFKTGAERKDAADSILAAYQAAQDIAIKELPPTHPIRLGLALNFSVFYYEILNSPDRACSLAKQDFDEAISELDTLGEESYKDSTLIMQLLRDNLTLWTSDMQDDGGDEMRDASKPEDEQ

SEQ ID NO: 23892 - DNA, 643 bp, Panicum virgatum
  misc_feature: Ceres CLONE 1831041
  misc_feature: Encodes the peptide sequence at SEQ ID NO. 23893
atcctccatcccaagcccgtcgaaaccctagcccgaaatcccggcaaaagtctcgctctcgccgcctccccggcgccatgggcaagaagcggaggctggagaccaaatccgcggcagccgctaagtctaccccggccgctgcagccaaatccgccactgctactgccgctagcctatccgaggtcatcgcccccgccatggcgcggaaggaggtgaagctgcccgaggaggcaggcgtcaagggaggaggaggacgacgacgacgggtacgacccgttcgggctcggcaagcccgtggagtacctgcagttcgacctggactcgctggaccagaacctggccaagaacgaggccggcggcatcatcggcacccggttcgagtcctcggaggtgaagtccaccccgttccagccctacagcgaggtgttcggcctccagcggttccgcgagtgcgagctcatccacggccgctgggccatgctcgccaccctcggcgccctctccgtcgagtggctcaccggcgtcacctggcaggacgccggccaggtggagctggtggacgggtcgtcctacctggggcagccgctgcccttctccatctcgacgctcatctggatcgaggtgctcgtgatcggctacatcg

SEQ ID NO: 23893 - protein, 55 aa, Panicum virgatum
  misc_feature: Ceres CLONE 1831041
  misc_feature: Useful for making plants with modulated water use efficiency
  misc_feature: Useful for making plants with modulated biomass
  misc_feature: Useful for making plants with modulated drought sensitivity
  misc_feature: Useful for making plants with modulated phosphate use efficiency
MLATLGALSVEWLTGVTWQDAGQVELVDGSSYLGQPLPFSISTLIWIEVLVIGYI

SEQ ID NO: 23894 - DNA, 649 bp, Panicum virgatum
  misc_feature: Ceres CLONE 1831049
  misc_feature: Encodes the peptide sequence at SEQ ID NO. 23895
agaccaccagccgcagccgccgccgccgtccggcagcggaaccccggaaggaaggagcgagtcggggagggcgggttggtgaggtggtgggaacccgcgcggcgggagcgggggcgaggatggcccccgccgcggggaggaaggtggcggtcgccgccgtgcagttcccctgcaccgacgtcgaggccgagaacgtcccccccgccgagaggttgattagggaagcgcacaagaaaggtgcgaagattgtactcattcaggaattgtttgaggggcactatttctgtcaagctcaaaggatggatttctttcgtcgtgctaagccttataaaggcaacccaactatcgcaaggatgcaacagcttgcaaaggagttggaagttgtgatacctgtcagtttttttgaagaagcaaacaatgcccattactattcagtggcaatcattgatgctgatggtactgatcttggcctctatcgcaaatcacacattccagatggaccaggttatcaagagaaattttatttcaaccccggtgacactggctttaaggctttcaaaaccaagtatgcgacgattggtgttggaatctgctgggatcagtggttcccggagtgtgcaagagcaatggctcttcagggggccgaaat

SEQ ID NO: 23895 - protein, 176 aa, Panicum virgatum
  misc_feature: Ceres CLONE 1831049
  misc_feature (10)..(176): Pfam Name: CN_hydrolase Pfam Description: Carbon-nitrogen hydrolase
  misc_feature: SWISSPROT Homolog: EC 3.5.1.53 N-carbamoylputrescine amidase
MAPAAGRKVAVAAVQFPCTDVEAENVPPAERLIREAHKKGAKIVLIQELFEGHYFCQAQRMDFFRRAKPYKGNPTIARMQQLAKELEVVIPVSFFEEANNAHYYSVAIIDADGTDLGLYRKSHIPDGPGYQEKFYFNPGDTGFKAFKTKYATIGVGICWDQWFPECARAMALQGAE

SEQ ID NO: 23896 - DNA, 680 bp, Panicum virgatum
  misc_feature: Ceres CLONE 1831081
  misc_feature: Encodes the peptide sequence at SEQ ID NO. 23897
tctgatagcgcaaaagatcttataaggagaatgctgaatcctcgccctgcggaacgcttaacagcacatgaagttctatgtcatccatggattcgtgatcatggagtagctcctgatcgtccacttgatccagctgtcttatctcgcattaaacaattctctgcaatgaataaattgaagaaaatggctttacgagttatagctgagagcctctcagaggaggaaattgctgggttgaaggaaatgttccagaccatggacactgataacagcggtgcaattacatatgatgagctaaaagaaggattgagaaaatatggctccacactaaaggatactgaaattcgtgatcttatggatgcagtaagttcttacgtgtatttttggctataacgacctggtcctggaatctaatgttgccaatgccttttggttttgtcttatataagctgttagttgacttgacaacataagctgcctcctgccagctcataatactatatgcgacttcttcaagaatctagttcttggctacttaaaaagtcaatccattatttgttgcagtttcaacttatgtgtgatctgtttttattacatatctgtgattaggatgcattgccatagcaacatcttgccttttaatttcttccttttgtctgtgacattgcaaataaagcttc

SEQ ID NO: 23897 - protein, 130 aa, Panicum virgatum
  misc_feature: Ceres CLONE 1831081
  misc_feature (78)..(106): Pfam Name: efhand Pfam Description: EF hand
  misc_feature: SWISSPROT Homolog: EC 2.7.11.1 Non-specific serine/threonine protein kinase
SDSAKDLIRRMLNPRPAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAVSSYVYFWL

SEQ ID NO: 23898 - DNA, 585 bp, Panicum virgatum
  misc_feature: Ceres CLONE 1831085
  misc_feature: Encodes the peptide sequence at SEQ ID NO. 23899
cgcgcacccaccaacccaaagggggaggaacagccgccgccaacgccgccgccgccgccgcgcgcggagtcacaccaccactccagtactccactaccgagcgcgcgcgagagagagagagggagaggggaggcgcctgggcggcggagatggcggtgggagcagggacgcgggaggagatggtgtacatggcgaagctggcggagcatgcggagcggtacgaggagatggtggagttcatggagaaggtcgccgcggcggcgggcgccggggagctcaccgttgaggagcgcaacctgctgtcggtcgcctacaagaacgtcatcggcgcgcgccgcgcgtcgtggcgcatcgtctcttccatcgagcagaaggaggaggcttgcggtgcctcgggctactccgctgccgtcaggggctaccgcggccgcgtcgaggccgagctctccggtatctgcgcggggatcctgtgcctcctcgacgaccgcctcgtcctcgccgccgccgccgtcgacgccaaggtcttctacctcaagatgaagggcgactaccaccgctacctcgtcgagttcaagaccggatccg

SEQ ID NO: 23899 - protein, 145 aa, Panicum virgatum
  misc_feature: Ceres CLONE 1831085
  misc_feature (8)..(145): Pfam Name: 14-3-3 Pfam Description: 14-3-3 protein
  misc_feature: The sequence is a functional homolog of SEQ ID NO 809 in the 11/479,226 US patent application
  misc_feature: Useful for making plants with modulated drought sensitivity
  misc_feature: Useful for making plants with modulated water use efficiency
  misc_feature: The sequence is a functional homolog of SEQ ID NO 801 in the 11/479,226 US patent application
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
MAVGAGTREEMVYMAKLAEHAERYEEMVEFMEKVAAAAGAGELTVEERNLLSVAYKNVIGARRASWRIVSSIEQKEEACGASGYSAAVRGYRGRVEAELSGICAGILCLLDDRLVLAAAAVDAKVFYLKMKGDYHRYLVEFKTGS

SEQ ID NO: 23900 - DNA, 984 bp, Panicum virgatum
  misc_feature: Ceres CLONE 1831094
  misc_feature: Encodes the peptide sequence at SEQ ID NO. 23901
atcaaacacgcaatcccgccgccaactctgttgacgaccccgcgccggcgtcgccccgcacccacgccaccgctaacgtccggccgccgccatggcctcatcctcatcctccgagtccgagtccagcaagcccgcgcccgcgcccgcgcgccctccgtcccgcgacttccttgcccacctcgaggcctacctcgcccgccgcgacggcgtcgacaagttcctcaagatctcccgctactccgcgcgcctcgcgctcgccgcgggcccgccgctgccgcccgccgccgccgcccgcctcaagtccttcgagtccagcgttgggctcagccgcaaggccttccgcctcggcaagttcgtgcagtccctcaacgccctccgcgcccacccgtacccgcccccggccctcgccatcctcgcctgcggcggcgagggcgtctactacttcctcgagcagttcgtctggctcgccaaggctgggctcctgcccgcgcacctcctcccgcgcctccagcgcctcagcgcctgggccgagctgctgggctacgtcggctccatcgcgattaagctggaagaggtggcgaggatcgaatcgtccgtcaagaagcgcctcgccgacggctgcggggaggagagcgaggccgtgaggacgatgcggggtaagctgctgctgaagcggatgtcggtggtgcaggacgtggcggacgcggtcatggcgctcggagacgtcaccgacgggaagggtttgctcgggagctccacgctgatggcatccgcaggcctgctctcggcgttgatcagcacgcacaagaactggaattcctgttgagtcctgaaggtatatgttatagatagctcattatatgatgatgaaataaagctctgatgaggagcgaccactaagggctgctttccagaatctgggtgctcccaaaactgatattgatgctctgtgctctgatgaatgaatgaagttcatgccggttc

SEQ ID NO: 23901 - protein, 244 aa, Panicum virgatum
  misc_feature: Ceres CLONE 1831094
  misc_feature (27)..(241): Pfam Name: PEX11 Pfam Description: Peroxisomal biogenesis factor 11 (PEX11)
MASSSSSESESSKPAPAPARPPSRDFLAHLEAYLARRDGVDKFLKISRYSARLALAAGPPLPPAAAARLKSFESSVGLSRKAFRLGKFVQSLNALRAHPYPPPALAILACGGEGVYYFLEQFVWLAKAGLLPAHLLPRLQRLSAWAELLGYVGSIAIKLEEVARIESSVKKRLADGCGEESEAVRTMRGKLLLKRMSVVQDVADAVMALGDVTDGKGLLGSSTLMASAGLLSALISTHKNWNSC

SEQ ID NO: 23902 - DNA, 1227 bp, Panicum virgatum
  misc_feature: Ceres CLONE 1831112
  misc_feature: Encodes the peptide sequence at SEQ ID NO. 23903
aaacccagccgaccagtataaaaactagcctccctcgccgccacctcgccatcgacgacctatcgaccccctggtagttgtctccgtctagcgctttccactcccaccgagctctatccacaccgctttccactctccttctgctcctctcgtcatcgtccatggagggcaaggacgcctccgccgcgccaccggccggcgcgccgcagcccgcggctcctgctcctcccgcggcggggcagccgcagccgcagccgcccgaggcggcgcggtggggcaagcggcagatgggcccgcaggcggcgcccggggcgcacccggagaaccaggaggcggcgcgggggacggcggcgcgcggggaccaggagctgccgccctacgtcatcgtgggggagcccgtggcggcgccgaggcagaaaggggacagccccatggagcacatcctcgacttcttcaacgcctggagccgcaaggccgaggagctcgcgtccaacatctggttcaacctgaagacggcgccgtcgatgtcggacgcggcgatgggcaagctgagcctgggcgccaaggcgctgtcggagggcgggttcgagaagctgtacaggcagaccttctccgcgggccccgacgagcagctgcagaagaccttcgcgtgctacctgtcgacggccaccggccccgtcgccggcacgctctacctgaccaccgcgaccgtcgccttctgcagcgaccggccgctctccttcgccgcgccgtcggggcagaccgcctggagctactacaaggtggcgatcccgctggacaaggtcgcggcggtggagccggtgacgaccaaggagagcccgccggagaagtacgtgcacgtcgtcaccgtcgacgcccacgacttctggttcatgggcttcgtcagctacgacaaggccgtgcaccacctcaccgaggccgtcgtctcccaccgctcgtcgtcccagtaccagaagcagggcgtcgccggcgccgccgccgccgccgccgccggccagtgatgagagctccgttcgccggagacgcgtgtgtagctagccctgtgcagtgtagcgactagtgagtgctttgtgtcatgcttgttgcttgtgagatggacggtctaccgactcctgtgtgcgtgtggtacatttccgtggtatttgtgaattgtttgatgtgtatacacttgttaatactacctccatttcatagttcgcgatttcg

SEQ ID NO: 23903 - protein, 286 aa, Panicum virgatum
  misc_feature: Ceres CLONE 1831112
  misc_feature (144)..(222): Pfam Name: GRAM Pfam Description: GRAM domain
MEGKDASAAPPAGAPQPAAPAPPAAGQPQPQPPEAARWGKRQMGPQAAPGAHPENQEAARGTAARGDQELPPYVIVGEPVAAPRQKGDSPMEHILDFFNAWSRKAEELASNIWFNLKTAPSMSDAAMGKLSLGAKALSEGGFEKLYRQTFSAGPDEQLQKTFACYLSTATGPVAGTLYLTTATVAFCSDRPLSFAAPSGQTAWSYYKVAIPLDKVAAVEPVTTKESPPEKYVHVVTVDAHDFWFMGFVSYDKAVHHLTEAVVSHRSSSQYQKQGVAGAAAAAAAGQ

SEQ ID NO: 23904 - DNA, 1268 bp, Panicum virgatum
  misc_feature: Ceres CLONE 1831126
  misc_feature: Encodes the peptide sequence at SEQ ID NO. 23905
aacacccccgatccccatcccgtctccggcgaacgcgcgtcgcccggccatgcgcagctgctgagatattgggagcgagcgccacgacgccaccggccatggaggagggctacgccaacctccccaccagccacctccttggctccgtccccgctgtgacgcaagacgataggaagcccgccacccccgatgcccaagatgtaggcgccacctcgcggttgcaggagttcccgcctgctcttggtggtaatggaggagggtatcggccaccaggcgccccagcagatggagatgtagaaaaccaagcaaattggaaaggatacttcaatgttgcatcttatgccccatacttcaatgttgatactgatgttgtagttgacaggctcatcagctcagtttatccaatggatggtttttacaggaagattgatgctaatcctgacatgtatgggcctttatggatcacaactactcttatattcatgctagctgcattgggtaactttgctacttatctgatgcaaaagaaaaggcatctggacatatggaactttgatgttggttatttcaattgggcagcatcagtcatgtatggttatgctatcattgtgcccgccatcttctttttcctgtttcagtattttggatcacgcccaagtcttgttcgattttggtgtatgtggggatattctctatttgtcttcatacctgcatctgtacttttgcttattcctgtggaatttcttcggtgggtcatcattgctcttgctggtggtgcatcatcctggttcattgctttaaacttgaaggaatgcacagaaggagctgatctgatggttttgatagctagtgcagcagtgctgcagtttgctctggcactgttcatcaaagttttcttttttgcctgagtttttcttgatgattttgcaaaggtgacctgatgtgctctttgtccacggcttatttgggcaaacatcttttgaaggggcaaggcagacaagttttactcaacaacttgacatacatatgaccctagattgttaagccttaggtgtcctatttgcaacttctgtctctcttgctcgtgtagtgaacagattctactgcgtgccttacagagtttactgagtttggcacctaaatttgcaaccaaaattcttcccacgctgctcagtgagaaagcgcagttttgcactgctgctttgtacaattctttgttggataccaggatctcgtgattaagtatactgtttgtgtacctgtgcatc

SEQ ID NO: 23905 - protein, 269 aa, Panicum virgatum
  misc_feature: Ceres CLONE 1831126
  misc_feature (85)..(250): Pfam Name: Yip1 Pfam Description: Yip1 domain
MEEGYANLPTSHLLGSVPAVTQDDRKPATPDAQDVGATSRLQEFPPALGGNGGGYRPPGAPADGDVENQANWKGYFNVASYAPYFNVDTDVVVDRLISSVYPMDGFYRKIDANPDMYGPLWITTTLIFMLAALGNFATYLMQKKRHLDIWNFDVGYFNWAASVMYGYAIIVPAIFFFLFQYFGSRPSLVRFWCMWGYSLFVFIPASVLLLIPVEFLRWVIIALAGGASSWFIALNLKECTEGADLMVLIASAAVLQFALALFIKVFFFA

SEQ ID NO: 23906 - DNA, 637 bp, Panicum virgatum
  misc_feature: Ceres CLONE 1831138
  misc_feature: Encodes the peptide sequence at SEQ ID NO. 23907
cgtccgctccgccgccgccgccgctcgacgtccgtccgtccgtcgatccggttcgctgctgtccgcgctcgcgtcaggacaggcgatggcgaggagctcgttcaagctggagcaccccctcgagaggaggcaggctgaggccaaccgcatcagggagaagtaccctgacagaatccccgtcattgttgagaaggccgagagaagcgatatccccgacattgacaagaaaaagtctgtccgttcttatccaatttaagaataattccattgcatttctattgtttgaatggttttcttgataatataacttttgtgcctcagaaacaatagcttgcagtgatttttgttcaatgtcaactcttgatagtgcaaaactgttggttctttcgctcagccgtgggcattacccctgtgacagtcatcccttcagagttgtatatctctaataagtcccaggtcttaacttcctggtcaagaatttgttcgaatagttctcttgacattagagttttatttgcttctgaaagtatagcttgtagcattttttcatcattgattttgtcaaactcttgatggtgcaaaactgttggttgttggctttgccttgggcattatccctgtgccaaccatgcctttc

SEQ ID NO: 23907 - protein, 56 aa, Panicum virgatum
  misc_feature: Ceres CLONE 1831138
  misc_feature (14)..(53): Pfam Name: MAP1_LC3 Pfam Description: Microtubule associated protein 1A/1B, light chain 3
  misc_feature: Useful for making plants with modulated nitrogen use efficiency
MARSSFKLEHPLERRQAEANRIREKYPDRIPVIVEKAERSDIPDIDKKKSVRSYPI

SEQ ID NO: 23908 - DNA, 1561 bp, Panicum virgatum
  misc_feature: Ceres CLONE 1831140
  misc_feature: Encodes the peptide sequence at SEQ ID NO. 23909
aacgatgcgcactacttccacccttgttccactctcccacatcagcttgaatgagcctcctcccctcctccaaatgagtgccatcgagttccgttctgctggtgctggggccatggagctcggagaagtgatggggctgcagcgaggcatcgccagcgccgcgccgtcgcccagggagggcgacctgggtctcctcaagcaagcaggcctcgcacaggcagcagctgcagcggcttcccacccctcgcccttccttgacgagcagaagatgctcagattctccaaggctgctcaggcattgccctcaggcttggatcttggaaggccaaatgagcaggctttcctgctatccaggaccaagaggccctttactccctcccagtggatggagctggagcaccaggctctcatatacaagtatctccatgcaaaggccccaataccttccagcctgctcatttcaatcagtaaaagcttcaggtcatccaatagagtgagctggacacctctttatcaagggaacaccaatgcagactctgatccagaacctggaagatgccgtcgaacagatggcaagaaatggcgatgctccaaggaggcaatggctgatcacaagtactgtgagcggcacatcaacagaaatcatcatcgttcaagaaagcctgtggaaaaccaacctaaaaagaccaccaaagaggcgcctgctgctgctgctggctcgttgccatgtgctgtgtcacagggtagtttgaagaaggcaaaagttaacgactcgaagccaggcactgtcagctattggacagatagtttaaacaggacaatgttgagcaaagagaaagcaaaccagccaacagaagacaacagtgctccactgctaaattctacaaatcgacaacccaccttgtccctgctctctcaactgaagcagcataataaaccagataagttcaaccctgcagtgcatagtgagtcaatctcctcagatacaatattgaaagcctgggaaagcagaaatcagccaagccataagagcatttccaccacacagctgcatgatgctgaatccctccagtcagttcttcaaaacttcagcctggcaaagaatgagaacaccgattctaagaaaaacaaatattctgattccatgctagtttcagcaactttctaccactccactgaaggtccacagacaacctgccttacacctaacatgacacaagtgcaggccgattgcatctcaagttcttgggagctgcctcaaggtggacctctgggcgagatcttaacaaactccaagaataatgacgactcaaacaaaaagtgtgaatctaggtcatatggttggttattgaatcttgaccattcaccatgattcctcaatttatgaagagcttgacatagatatctcaccatgaaagcgactcagaaacaaaggttgagatgaccttgatatttgtcccatgcatgctcgctatttttttactttcgttttgtagtattcagctagttgaattatctgtaattctgaatctggctgtatcttaaactagttttgtgacag

SEQ ID NO: 23909 - protein, 432 aa, Panicum virgatum
  misc_feature: Ceres CLONE 1831140
  misc_feature (156)..(201): Pfam Name: WRC Pfam Description: WRC
  misc_feature (97)..(133): Pfam Name: QLQ Pfam Description: QLQ
MSAIEFRSAGAGAMELGEVMGLQRGIASAAPSPREGDLGLLKQAGLAQAAAAAASHPSPFLDEQKMLRFSKAAQALPSGLDLGRPNEQAFLLSRTKRPFTPSQWMELEHQALIYKYLHAKAPIPSSLLISISKSFRSSNRVSWTPLYQGNTNADSDPEPGRCRRTDGKKWRCSKEAMADHKYCERHINRNHHRSRKPVENQPKKTTKEAPAAAAGSLPCAVSQGSLKKAKVNDSKPGTVSYWTDSLNRTMLSKEKANQPTEDNSAPLLNSTNRQPTLSLLSQLKQHNKPDKFNPAVHSESISSDTILKAWESRNQPSHKSISTTQLHDAESLQSVLQNFSLAKNENTDSKKNKYSDSMLVSATFYHSTEGPQTTCLTPNMTQVQADCISSSWELPQGGPLGEILTNSKNNDDSNKKCESRSYGWLLNLDHSP

SEQ ID NO: 23910 - DNA, 1622 bp, Panicum virgatum
  misc_feature: Ceres CLONE 1831149
  misc_feature: Encodes the peptide sequence at SEQ ID NO. 23911
ggaggcttgcaatcccatctgctcccgacacgggccccgcccccacaccgccggcgccggcgaccgtttcctcctcctcctccgctcgtggagagggccaccggagggaggccggccaatttactaggaccgtcccatatgggcgcggaggcagagcacccgcagcagcagcagcctccgtccgccctccggcccggcagggaggcggcggcggaggcgcccgcggtgctggggctccaggtctccgcgctcatcgaccacgtcgcgcgcgtcgactggtccctcctcgaccgcgtcccaggcgaccgcggcggctcgcagcaggtgtccattgacgagctgaatcatattcttactgaagtgaatgcccacatccttccttcccgcaatgatctcactccaataactactatagccggtggaagcgttgccaacacaattcgtgggctctcagctggttttgggatatcaactggaataattggagcttgtggagacgacagccagggcattttgtttgtcaacaatatgagttttagtggtgtagatctcacaagattaagggccaaaaaagggcatactgctcagtgtgcgtgcttggtcgatgcaagcggcaatcgcaccatgcggccatgcctatctagtgcagtcaagatgcaggccaatgagtttagaaaagaggatttcaaaggttccaaggtgctttctttttgcttcgttcgtgcacaccatttcatgatatattattcttagaaaaaaaaatcatcctagcatatgtctttgttaattctgaattttttgatgcagtggcttgttgtgagatatgcacaacagaacatggaacagattattgaagctattaggattgctaaacaggaaggcctttcagtttcattagatttggccagttttgagatggttcgtgactctaggtcaaaactcattaaccttttggagactggcaacattgacctttgcttcgccaatgaggatgaagctagagaggttatagggggaggtccgacatcagatccagaggaggcgcttgcattcttgggcaagtactgcaaatgggctgtggtgacacttgcttcaaaggggtgcatggcgaaacatggcaaacaggtcgttcaagtgccggcgatcggggagagcaacgcggtggacacgaccggagcaggcgacctgttcgcgagcgggttcctgtacgggctggtgaaggggctgccgcttgaggagtgctgcaaggtcggggcgtgcagcggcgggtcggtgacgcgggcgctgggcggggaggtgcggccggagaattggcagtggatgtacaagcagatgcacgccaggggcctgctgctccccaagctcaagaactgaactgctgctgcgctgcttctgtagctgtagcgtattagcagcaagagctgctgtatcttaccactcctaagaggccattatccagccctcctgttattgattgttgcggttgccttaccctacttagaatattgttggtttatcatgcgtgattcatggcatggtgaagggcaggctggcatatattggttgatttgttgatgaaccactcgtaagatttattcagtcgaaaggagtatattgattac

SEQ ID NO: 23911 - protein, 199 aa, Panicum virgatum
  misc_feature: Ceres CLONE 1831149
  misc_feature: SWISSPROT Homolog: EC 2.7.1.20 Adenosine kinase
MSLLILNFLMQWLVVRYAQQNMEQIIEAIRIAKQEGLSVSLDLASFEMVRDSRSKLINLLETGNIDLCFANEDEAREVIGGGPTSDPEEALAFLGKYCKWAVVTLASKGCMAKHGKQVVQVPAIGESNAVDTTGAGDLFASGFLYGLVKGLPLEECCKVGACSGGSVTRALGGEVRPENWQWMYKQMHARGLLLPKLKN

SEQ ID NO: 23912 - DNA, 1076 bp, Panicum virgatum
  misc_feature: Ceres CLONE 1831198
  misc_feature: Encodes the peptide sequence at SEQ ID NO. 23913
atcagtcagcagcaggggttcgttcgtttcgttccacatgccaatgtgtctacctaggttcagtttcgttcggttggggcctgtgcgggtgctcaactgctcatctttgtcatcgagtagcagtagcaatggtggactggtggtggtggtggtcgcatgattcggccggcgccaatgatgggctggctgaacggccagggcggcggccggtgatattcccggcggtggaggccctgttcgttcatgggcatctgcaaggcgacggccagtggttggggattccaaaagctgaaggcttcccgaaggtgctgatcgacgggccctacggcgcgccggcgcaggactacaagcagtacgacgtggtgctgctggtggggctgggcatcggcgccacgcccatgatctccatcatcaaggacatcatcaacaacatgaagatgctcgacggcgacctggaggccggctccggcgccggcggcgacgggtccgtgtcggcggcctccttccgcacgcggcgggcctacttctactgggtgacccgggagcagggctccttcgagtggttccgcggcgtcatggacgaggtggccgagaccgacaagaagggcgtcatcgagctccacaactactgcaccagcgtctacgaggagggcgacgcccgctccgccctcatcgccatgctccagcagctcaaccacgccaagcacggcgtcgacgtcgtctccggcacccgcgtccggacccacttcgcccgccccaactggcgcaacgtctacaagcgcatcgccctcaaccaccgcgaccagcgcgtcggagtgttctactgcggtgccccgatgctgaccaaggagctgcgtgacctcgcgcaggatttctcgaggaaaaccaacacaaagttcgatttccacaaggagaacttctaattcatttagcctcgacaagtttagcgtatatatggatgtagagagaggaagtagaacaaagtaggtattgcttgattgtgaccggccagttgggtcaaaatcccatcagttttttgtttactttagaagaactaataatacaaatgcctttgt

SEQ ID NO: 23913 - protein, 306 aa, Panicum virgatum
  misc_feature: Ceres CLONE 1831198
  misc_feature (118)..(289): Pfam Name: NAD_binding_6 Pfam Description: Ferric reductase NAD binding domain
  misc_feature: SWISSPROT Homolog: EC 1.6.3.1 NAD(P)H oxidase
QSAAGVRSFRSTCQCVYLGSVSFGWGLCGCSTAHLCHRVAVAMVDWWWWWSHDSAGANDGLAERPGRRPVIFPAVEALFVHGHLQGDGQWLGIPKAEGFPKVLIDGPYGAPAQDYKQYDVVLLVGLGIGATPMISIIKDIINNMKMLDGDLEAGSGAGGDGSVSAASFRTRRAYFYWVTREQGSFEWFRGVMDEVAETDKKGVIELHNYCTSVYEEGDARSALIAMLQQLNHAKHGVDVVSGTRVRTHFARPNWRNVYKRIALNHRDQRVGVFYCGAPMLTKELRDLAQDFSRKTNTKFDFHKENF

SEQ ID NO: 23914 - DNA, 658 bp, Panicum virgatum
  misc_feature: Ceres CLONE 1831200
  misc_feature: Encodes the peptide sequence at SEQ ID NO. 23915
tcaccaatttgttcttgttcttcttggtccccgtagcagagatccagagccttttagtttctggtctctgatctttcttccctttcctgtggaatagtttgtcgtagttagcaaaagaggttctttttccacacctctttgtgcttttttgtccattaataggtagatctgtgtagagcaaccatacttgtcctgcctgttctttgattttagctaagaacaaggctatttattatttcttttgtccccaaagaaaaagccaaaaaaaatccaacccaagtagattcttcttcgatggccgccgctataaatcttccgggacccagcgaggatctgatacgagcgatggagtgctttatggaagaggatgctccatcccctctggtcatgccgccggccaccaccttcccggcgccgttccccacgggggcccacgggctgagctactcggcccatccgccggcgacccacctcagcccggcccaggagcagttcatccaggcccagctccacctgcagcggaacccaggcctcggcccccgggcgcagcccatgaagcccgcggtccccgtgccgccggcgccgcgcccgcagaagctgtaccgcggcgtgcggcagcgccactggggcaagtgggtcgccgagatccggctccccc

SEQ ID NO: 23915 - protein, 121 aa, Panicum virgatum
  misc_feature: Ceres CLONE 1831200
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
MAAAINLPGPSEDLIRAMECFMEEDAPSPLVMPPATTFPAPFPTGAHGLSYSAHPPATHLSPAQEQFIQAQLHLQRNPGLGPRAQPMKPAVPVPPAPRPQKLYRGVRQRHWGKWVAEIRLP

SEQ ID NO: 23916 - DNA, 544 bp, Panicum virgatum
  misc_feature: Ceres CLONE 1831208
  misc_feature: Encodes the peptide sequence at SEQ ID NO. 23917
gttgcctccctccagccgcctccgctcatggcgtccatggcgttctcactggcaggagccttcaagggcctctccctcgcgaccccttcctcttccatgcgcccgtccttcctccgcggtgaccgcgccgcgctctccgtcggcggcgccgcggtgggcgtgccggtgccggcgcggcggctgaccatccaaatggcgcacaagaagggagccgggagcacaaagaacgggcgcgactccaaggggcagcgtctgggagtcaagatatacggcgaccaggtcgccaagcccggcgcaatcatcatccgccagcgcggcaccagggtctatcctggaaataatgttggaatgggcaaggatcatacactcttttctttgatgagaaataaagcaaagaatctgtccaatggcagagggcaaagactccggcgatcttttctccagcagcaagctagtcgcggacgccgctgcgtccgtgttccagcataagaacacagacaacatcgacaaaaaggaggtcgccggagcggctgcagatatcctg

SEQ ID NO: 23917 - protein, 153 aa, Panicum virgatum
  misc_feature: Ceres CLONE 1831208
  misc_feature (57)..(137): Pfam Name: Ribosomal_L27 Pfam Description: Ribosomal L27 protein
  misc_feature: Useful for making plants with modulated biomass
MASMAFSLAGAFKGLSLATPSSSMRPSFLRGDRAALSVGGAAVGVPVPARRLTIQMAHKKGAGSTKNGRDSKGQRLGVKIYGDQVAKPGAIIIRQRGTRVYPGNNVGMGKDHTLFSLMRNKAKNLSNGRGQRLRRSFLQQQASRGRRCVRVPA

SEQ ID NO: 23918 - DNA, 482 bp, Panicum virgatum
  misc_feature: Ceres CLONE 1831211
  misc_feature: Encodes the peptide sequence at SEQ ID NO. 23919
gcaacgcacaccaacccaagaacaaggaggggagagaaggaaggaaaaaaaaaaggaattttgatcgcccagagtgtggtagtagaatagcaatttgatctcggaattttgatcgcccagagtgtggtagtagaatagcaatttgatctctccttgttcgaggtcagtgcgcgaggcaataatggtggccgtggaggctgcggcggcggcggtggagggcccgatccgggcggaggccgaggtggaggtgaagggcgatgccccggccgtgggggaggaggaggagaaggagtacaagagcgacatgaggaagctggaggagctcatgtccaagctcaacccctgcgcgcaggagttcgtgccgtcgtcgcgccgcgccgcggcgccggcggtgaagccggcggggggaggcgtgctctccgccgacgcgccggtgttcgtgtccgctgccgagtactacggcgctgccggcgggcacctgc

SEQ ID NO: 23919 - protein, 100 aa, Panicum virgatum
  misc_feature: Ceres CLONE 1831211
  misc_feature (47)..(64): Pfam Name: PAM2 Pfam Description: Ataxin-2 C-terminal region
MVAVEAAAAAVEGPIRAEAEVEVKGDAPAVGEEEEKEYKSDMRKLEELMSKLNPCAQEFVPSSRRAAAPAVKPAGGGVLSADAPVFVSAAEYYGAAGGHL

SEQ ID NO: 23920 - DNA, 1345 bp, Panicum virgatum
  misc_feature: Ceres CLONE 1831214
  misc_feature: Encodes the peptide sequence at SEQ ID NO. 23921
aagcgtcctgttcctccaccgctcgggctaccgagtactgacacctcggcggcggctgcacgatcgcttagttcgcggaggaggacgcgcgcaggcaacgatgatgctcatggactcggcgcgccgcaccggctgctccccggtctgcctggacctcagcgtcggcctctcgccgtcgccgccgaagacgggcgcgaccgaccctcccgccggtggctgcgggatggtgtcgtccatgaccgacgagcaggtaactagctactgatccatcgcgccctgtcttcctcgccgccgctccggcttccttgctctcgatcgcgtcgtctctgtctgaaccggcggtcacaatgctgcgacccaggccaggaccctggaggccaagtgcacccaggtcagcgaggagaaccggcggctcgccgagaaggtcgcctacctgtacgccagccagatcgccaggccgggtccagactccccgggctcgacgcgcgcctcgcaagccgcgtcgccgccgccgccgccggctgcgagcaggaagaggagcagggacagcatggacgagccgccgaattcgggcgacgccgacggcagcggcagggccgaggccgccgagagcacccccagcgacgccttggagggctcctgcgggcggatcaaggtcagcagggtctgctcccggatcgacccctccgacaccacgctcaccgtcaaggacgggtaccaatggcggaagtacgggcagaaggtcacccgcgacaacccgtccccgcgagcctacttccgctgcgccttcgcgccctcctgccccgtcaagaagaaggtgcagaggagcgcggaggacagctcggtgctggtggccacgtacgagggcgagcacaaccacccgtgcccgacgcgcgccggcgagctccccagctgcgcggcgcgcggcgggtccgtgccgtgctccatctccatcaactcctccggcccgaccatcacgctggacctcaccaagaacggagcggggggcggcgtgcgggtgctcgaggccgccggggcgcccgacctcaaggagctgtgccaggagatcgcgtccgcggagttccggacggcgctggtggagcagatggcgagctcgctcaccagggattccaagttcaccgacacgctcgccgccgccatcctgaagcagctgccggattactaagtctccagtgtccggtgtcgtagctcaaagagtttgcgagactgcaacagattttctttcatggtagcaatagtgtatgtctattgggattagagcataatctccccagatttacatgcatagtttcaattccaaataatattgtacattttacaagtc

SEQ ID NO: 23921 - protein, 211 aa, Panicum virgatum
  misc_feature: Ceres CLONE 1831214
  misc_feature (52)..(112): Pfam Name: WRKY Pfam Description: WRKY DNA -binding domain
  misc_feature: The sequence is a functional homolog of SEQ ID NO 108 in the 10/225,068 US patent application
  misc_feature: The sequence is a functional homolog of SEQ ID NO 1330 in the 11/479,226 US patent application
  misc_feature: The sequence is a functional homolog of SEQ ID NO 218 in the 10/225,066 US patent application
  misc_feature: The sequence is a functional homolog of SEQ ID NO 2458 in the 10/374,780 US patent application
  misc_feature: The sequence is a functional homolog of SEQ ID NO 620 in the 10/412,699 US patent application
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MDEPPNSGDADGSGRAEAAESTPSDALEGSCGRIKVSRVCSRIDPSDTTLTVKDGYQWRKYGQKVTRDNPSPRAYFRCAFAPSCPVKKKVQRSAEDSSVLVATYEGEHNHPCPTRAGELPSCAARGGSVPCSISINSSGPTITLDLTKNGAGGGVRVLEAAGAPDLKELCQEIASAEFRTALVEQMASSLTRDSKFTDTLAAAILKQLPDY

SEQ ID NO: 23922 - DNA, 631 bp, Panicum virgatum
  misc_feature: Ceres CLONE 1831216
  misc_feature: Encodes the peptide sequence at SEQ ID NO. 23923
gagctagcaacgcagaggctgcctgcttcctggtcgccgcctcgcgtcgtcgatcggcgcggtgtttctcacggctaccaagatagtagggctggcaaaccggtggccggccgccggcgcggcggccgaggagatggggagcctcgacggccacgcgctgcagggccaccaccacggctacgccgcccactcccacgtcggcgccgacagcggcggcggcggcaacagcaacaacgacgaggacgacgcgtcgccgccgccggcgtcgtcgggtggaggagcgggggcgggctcgcgccggccgcgcgggcggccccccgggtccaagaacaagcccaagccgcccgtggtggtgacgcgggagagccccaacgcgatgcgctcccacgtgctggagatcgccagcggcgccgacatcgcggacgccatcgcgggcttatcccgccgccgccagcgcggcgtctccgttctcagcgggaccggcgccgtcaccaacgtcacgctgcggcagcccgcgggggccggggccgccgccgtcgcgctgcggggccgcttcgagatactctccctgtcgggtgccttcctcccggcgccggcgccgccgggggccacggggctcgccgtgtacctg

SEQ ID NO: 23923 - protein, 165 aa, Panicum virgatum
  misc_feature: Ceres CLONE 1831216
  misc_feature: The sequence is a functional homolog of SEQ ID NO 1418 in the 10/374,780 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 1412 in the 10/374,780 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 2038 in the 10/374,780 US patent application
  misc_feature: The sequence is a functional homolog of SEQ ID NO 2370 in the 10/374,780 US patent application
  misc_feature: The sequence is a functional homolog of SEQ ID NO 264 in the 10/714,887 US patent application
  misc_feature: The sequence is a functional homolog of SEQ ID NO 264 in the 11/435,388 US patent application
  misc_feature: The sequence is a functional homolog of SEQ ID NO 536 in the 10/225,066 US patent application
  misc_feature: The sequence is a functional homolog of SEQ ID NO 1413 in the 10/374,780 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 1403 in the 10/374,780 US patent application
  misc_feature: The sequence is a functional homolog of SEQ ID NO 1404 in the 10/374,780 US patent application
  misc_feature: The sequence is a functional homolog of SEQ ID NO 32 in the 10/669,824 US patent application
  misc_feature: The sequence is a functional homolog of SEQ ID NO 32 in the 10/870,198 US patent application
  misc_feature: The sequence is a functional homolog of SEQ ID NO 348 in the 11/435,388 US patent application
  misc_feature: The sequence is a functional homolog of SEQ ID NO 350 in the 10/714,887 US patent application
  misc_feature: The sequence is a functional homolog of SEQ ID NO 2528 in the 10/374,780 US patent application
  misc_feature: The sequence is a functional homolog of SEQ ID NO 256 in the 10/225,066 US patent application
  misc_feature: The sequence is a functional homolog of SEQ ID NO 298 in the 11/435,388 US patent application
  misc_feature: The sequence is a functional homolog of SEQ ID NO 300 in the 10/714,887 US patent application
  misc_feature: The sequence is a functional homolog of SEQ ID NO 48 in the 10/669,824 US patent application
  misc_feature: The sequence is a functional homolog of SEQ ID NO 48 in the 10/870,198 US patent application
  misc_feature: Useful for making plants with modulated biomass
  misc_feature: Useful for making plants with modulated flowering time
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: Useful for making plants with modulated light quality response
  misc_feature: The sequence is a functional homolog of SEQ ID NO 1495 in the 11/479,226 US patent application
  misc_feature: The sequence is a functional homolog of SEQ ID NO 1838 in the 10/412,699 US patent application
  misc_feature: The sequence is a functional homolog of SEQ ID NO 2078 in the 10/374,780 US patent application
  misc_feature: The sequence is a functional homolog of SEQ ID NO 296 in the 11/435,388 US patent application
  misc_feature: The sequence is a functional homolog of SEQ ID NO 298 in the 10/714,887 US patent application
  misc_feature: The sequence is a functional homolog of SEQ ID NO 4 in the 10/669,824 US patent application
  misc_feature: The sequence is a functional homolog of SEQ ID NO 4 in the 10/870,198 US patent application
  misc_feature: The sequence is a functional homolog of SEQ ID NO 54 in the 10/225,066 US patent application
  misc_feature: The sequence is a functional homolog of SEQ ID NO 718 in the 10/412,699 US patent application
  misc_feature: The sequence is a functional homolog of SEQ ID NO 1401 in the 10/374,780 US patent application
  misc_feature: The sequence is a functional homolog of SEQ ID NO 30 in the 10/669,824 US patent application
  misc_feature: The sequence is a functional homolog of SEQ ID NO 30 in the 10/870,198 US patent application
  misc_feature: The sequence is a functional homolog of SEQ ID NO 342 in the 11/435,388 US patent application
  misc_feature: The sequence is a functional homolog of SEQ ID NO 344 in the 10/714,887 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 1407 in the 10/374,780 US patent application
  misc_feature: The sequence is a functional homolog of SEQ ID NO 20 in the 10/669,824 US patent application
  misc_feature: The sequence is a functional homolog of SEQ ID NO 20 in the 10/870,198 US patent application
  misc_feature: The sequence is a functional homolog of SEQ ID NO 356 in the 11/435,388 US patent application
  misc_feature: The sequence is a functional homolog of SEQ ID NO 358 in the 10/714,887 US patent application
  misc_feature: Useful for making plants with modulated low light sensitivity
  misc_feature: The sequence is a functional homolog of SEQ ID NO 88 in the 10/669,824 US patent application
  misc_feature: The sequence is a functional homolog of SEQ ID NO 87 in the 10/669,824 US patent application
MGSLDGHALQGHHHGYAAHSHVGADSGGGGNSNNDEDDASPPPASSGGGAGAGSRRPRGRPPGSKNKPKPPVVVTRESPNAMRSHVLEIASGADIADAIAGLSRRRQRGVSVLSGTGAVTNVTLRQPAGAGAAAVALRGRFEILSLSGAFLPAPAPPGATGLAVY

SEQ ID NO: 23924 - DNA, 476 bp, Panicum virgatum
  misc_feature: Ceres CLONE 1831245
  misc_feature: Encodes the peptide sequence at SEQ ID NO. 23925
accacgcctcacgccgggcgagcgcgacactccctctccctcgcctccgcctccgcgcgaggcatcgtgtccgcgagcgaggtagcagcagccagagcaggagccgagaggagagggggggccggccatgacgatggcaatgcgcgcggtggccgcggccgcggtgctcctcctggcggcggccgggggcgcgtcggcggcgacgctagcgctgtacaaccggtgcggcgagacggtgtggccgggcatccagccgagcgcgggcaaggagctcctctcccgcggcgggatgcagctggcgcccggccacgcggcctccatccggctccccgccggctggtcggggcgcgtgtggggccggcaggggtgcacgttcgactcggcggggcgcgggcggtgcgccacgggcgactgcgggcggacgctctactgcaacggcgccgggggcgcgccgccggccacactggcggagatca

SEQ ID NO: 23925 - protein, 116 aa, Panicum virgatum
  misc_feature: Ceres CLONE 1831245
  misc_feature (31)..(115): Pfam Name: Thaumatin Pfam Description: Thaumatin family
MTMAMRAVAAAAVLLLAAAGGASAATLALYNRCGETVWPGIQPSAGKELLSRGGMQLAPGHAASIRLPAGWSGRVWGRQGCTFDSAGRGRCATGDCGRTLYCNGAGGAPPATLAEI

SEQ ID NO: 23926 - DNA, 1211 bp, Panicum virgatum
  misc_feature: Ceres CLONE 1831255
  misc_feature: Encodes the peptide sequence at SEQ ID NO. 23927
acctcctcttatcgcctccgcgctctaatggcctcacaccccaccacgcagtaaacgaagaggacgggccccactccctggcacccacccccgcgctccttccatgaggcagccgcacctctcgccgcagccctcccccgtcctctcctcccacttctcgccgccggcggcgccaggggcctcgccgtggcggcggcggctgctgcaccgggggcgggccttccacccgccgctctcctcgctgcgggagcccaacaaggccacgctacgcaaggcctcgcccaacgtccccttccgcctcggcggcggcgggagcggcaaccccaaggaccgccgccccgccgccgatgaggaggaggaggaggcggagggttctggcggcgccggggcggtcacagggacgctgctcgctggagcgctcctggttggggtcgtagggggctttggggcggccggctacgtgtacaaggaccagatcaactccttcctcacgcagttctctgggttcattgatggttatggtcctgctggatatgctcttttcgtacttgtatatgcaggcttggaggttcttgcaattccagcaatacctttaaccatgtcagcgggtctgttatttggcagtgtcactggtacaattattgtttcagttagtggaacactagctgcagcggtcgccttccttattgctagatactttgccagagagcgaattctcaaactggttgaaggaaataagaagtttctagctattgataaggcaattggtgaaaatggatttaaagttgttactctgctacgtttgagtcccttattgcctttctcccttgggaactacctatatggcttgacttcagtgaagttcttgccttatgtcttgggcagttggttgggaatgcttccaggatcatgggcttatgtcagtgctggtgcatttgggcgagctataattcaagatgaatcagagattggtttgcaaggaaatggccagctatggacactgggtgtagggttattatttacagccgttgctgctgcttatgtaacaaggcttgcaaaggatgctgtaaaggagatcgacgattagaatggtaggacactctagtagaaacggggggcccatctggatagtatactagcacattgtacatcactggcacctttggtgcaatctaatctactaatagaaattcagagcaattttctgacgg

SEQ ID NO: 23927 - protein, 327 aa, Panicum virgatum
  misc_feature: Ceres CLONE 1831255
  misc_feature (159)..(278): Pfam Name: SNARE_assoc Pfam Description: SNARE associated Golgi protein
MRQPHLSPQPSPVLSSHFSPPAAPGASPWRRRLLHRGRAFHPPLSSLREPNKATLRKASPNVPFRLGGGGSGNPKDRRPAADEEEEEAEGSGGAGAVTGTLLAGALLVGVVGGFGAAGYVYKDQINSFLTQFSGFIDGYGPAGYALFVLVYAGLEVLAIPAIPLTMSAGLLFGSVTGTIIVSVSGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRAIIQDESEIGLQGNGQLWTLGVGLLFTAVAAAYVTRLAKDAVKEIDD

SEQ ID NO: 23928 - DNA, 656 bp, Panicum virgatum
  misc_feature: Ceres CLONE 1831289
  misc_feature: Encodes the peptide sequence at SEQ ID NO. 23929
ggcaaactgacccagtctgccacaccagcagtaacaggccactccgtgctcttgcggacacagttgaagcaggcaagcagcagccgccgccgccagcagagcgaggcggggagcagagcataccggtgaggcgagcgcccggcgtcttaagcgaaggcaagtgcggctgatctgatccctccttccctcccgctgcagtcgacagggggggtgaccggaatcctactctgctgccccggttcttcctagcctggttcctcgatccctgtttcggttgggtctgcgcgcagggggaacgggccaacggggccccggtcgccatggaggaagcggggagggggaagggctgcggcttgctcaaagtcgctgtggcgcgcggccgcagcctcgccgtcagggacttcacctccagcgacccgtacgtcatcgtccgcgtcgccgacacgactgcaaagacaaaagtcatcaacagttgcctaaatccagtttggaatgaagagataacattctccatgaaagaaccagtaggagtcatcaaatttgaggtgttcgactgggaccggttcaagtatgacgacaagatggggcacgctttcctggacctgcagcctgtggcagcagcgacaaagctgcggcgagcgctgcggctcacggca

SEQ ID NO: 23929 - protein, 111 aa, Panicum virgatum
  misc_feature: Ceres CLONE 1831289
  misc_feature (13)..(92): Pfam Name: C2 Pfam Description: C2 domain
  misc_feature: SWISSPROT Homolog: EC 2.7.11.13 Protein kinase C
MEEAGRGKGCGLLKVAVARGRSLAVRDFTSSDPYVIVRVADTTAKTKVINSCLNPVWNEEITFSMKEPVGVIKFEVFDWDRFKYDDKMGHAFLDLQPVAAATKLRRALRLT

SEQ ID NO: 23930 - DNA, 651 bp, Panicum virgatum
  misc_feature: Ceres CLONE 1831296
  misc_feature: Encodes the peptide sequence at SEQ ID NO. 23931
aacactagtacaccggtcatacgcagcaccaaccgccatggcctccctcgccgccgtctccgtgcagccggtcgccgtgaagggcctcgccggcagctccatctccggcaggaggctcgccgccgtcaggccgtcgcgccgcgccggggccggcacctgcgcctgccgctccgcccgcaggccccgcggcgccgccgtggtggccaagtacggcgacaagagcgtctacttcgacctcgacgacatcggcaacaccaccgggcagtgggacctctacggctccgacgctccctcgccctacaacccgctccagagcaagttcttcgagacgttcgcggggccgttcaccaagaggggcctgctgctcaagttcctgctggtgggcggcgggtcgctgctagcctacgtcagcgcgtcggcgtcgccggacctgctgccgatcaagaaggggccgcagcagccgccgcagccggggccgcgcggcaagatctaagttcagttgttccttctcctcatccatctgtctctactagctgcttgcttgtaccgccgctagctccggacgccatggatcgtccttgcctgtcgttgtgctgctgatattcgatcgcgctgcctgtttatcactggtggcccgtctcgacctcacga

SEQ ID NO: 23931 - protein, 151 aa, Panicum virgatum
  misc_feature: Ceres CLONE 1831296
  misc_feature (5)..(151): Pfam Name: PSI_PsaH Pfam Description: Photosystem I reaction centre subunit VI
MASLAAVSVQPVAVKGLAGSSISGRRLAAVRPSRRAGAGTCACRSARRPRGAAVVAKYGDKSVYFDLDDIGNTTGQWDLYGSDAPSPYNPLQSKFFETFAGPFTKRGLLLKFLLVGGGSLLAYVSASASPDLLPIKKGPQQPPQPGPRGKI

SEQ ID NO: 23932 - DNA, 1720 bp, Panicum virgatum
  misc_feature: Ceres CLONE 1831298
  misc_feature: Encodes the peptide sequence at SEQ ID NO. 23933
accaccgcctcctccgcaccgtcgtcgccatggctctcctcaagaactctctcctgctccaggggcggctgcgccatgcggcggcggcgtcgttcgctgcgcggcgcggcgcggcgacgtccacggaggagtaccagcgccggaactacgcggagaacgcctccgagtacaacacggtcatggggtccctcgttgcccagcgcaggccctatcttctgcgcgatgcttatgatgacatgatgcttgactgcgtccaacctgtgcgggacacattccacacactcatagtgggtaccatgaaaggcagcagactacaagatgctctctacttccgtgatcagatgaaagaaatgggcttgcagcctgatgttaacatttacaacttcttgatctccacttgtggaaaatgcaagaacccagatgcagcaatcatgcttttagaagaaatgaaggcacatggcgttaagttgaaaggagaaacctacatttgtctgttgaatgcacttgcagcaacagggcgaactgatcaagtttatgcaatagttagtgatatgagtgctgctggtcttggattaaacaagtactgttatgctggactgataaccgcattcaaaaacaagacaccaaccaccgaggagactatggcaaagattcttgactttgtcgagcagtcaaaaggttggaaatatgttgaaagagtatcaaaggacaatgctgagaatgtaatgatgaatgtttcagaggaggagctgtacaatctaccaacagcagaatatgtaaatagacgaggaggatttgtccttaagcagttcacagtttatcatgttgcaatccatgcttgtgccgaactgcggagcaaagagacgcttgaagcacttcttgaaatgttcaataaagataatagagatggatctacttatgatgcctttatagtgatgcaagctatgaggtgttatctgcgttgtggagatattgattctgctattaagatgtttgaagaatataccagttcaagattcccagctgcagagttgtatgcgacacttgctgagggagctatgattgggcacactccaagaggaatgcaagttgctcaagaaaccctagagaaaatggtttcaagaaatttcttcttgaatccgaggatgggaagtgatctcctaatcgcagctgccggtgaaaagactggtggatatacgacagcgaattatgtctgggattacctgcaaagccgtaatatcactccatcacttcctgctgttgaagcataccacaagggtttgaaggaacgagaaattcctgctgatgatccacgacttctcagcgttacccgtgttttggacaacctgaatgtccgatttggtccaagaagaacattcagtaacacagaaacaatgctcatgtccttgagtcgatgcaagaaggaatttgtcttcacaagacatgtggatgcaaagtaatgtttacactccataaaaccaaagaactctattaggatcacttaaagaaagaccgtgaaccataaggcatatgaagggaacagcaggtggaagctgaatgaccagaaatagaagtaggttattttcaggatttgtcaagacatttttcacctgccaagcctaaactcaaattctcagaattttgatttgaacttcaatctacccatgttgcctaccgttgtctgaggaccatttatcaaagtttgtgatttggagagttc

SEQ ID NO: 23933 - protein, 476 aa, Panicum virgatum
  misc_feature: Ceres CLONE 1831298
  misc_feature (115)..(149): Pfam Name: PPR Pfam Description: PPR repeat
  misc_feature (80)..(114): Pfam Name: PPR Pfam Description: PPR repeat
MALLKNSLLLQGRLRHAAAASFAARRGAATSTEEYQRRNYAENASEYNTVMGSLVAQRRPYLLRDAYDDMMLDCVQPVRDTFHTLIVGTMKGSRLQDALYFRDQMKEMGLQPDVNIYNFLISTCGKCKNPDAAIMLLEEMKAHGVKLKGETYICLLNALAATGRTDQVYAIVSDMSAAGLGLNKYCYAGLITAFKNKTPTTEETMAKILDFVEQSKGWKYVERVSKDNAENVMMNVSEEELYNLPTAEYVNRRGGFVLKQFTVYHVAIHACAELRSKETLEALLEMFNKDNRDGSTYDAFIVMQAMRCYLRCGDIDSAIKMFEEYTSSRFPAAELYATLAEGAMIGHTPRGMQVAQETLEKMVSRNFFLNPRMGSDLLIAAAGEKTGGYTTANYVWDYLQSRNITPSLPAVEAYHKGLKEREIPADDPRLLSVTRVLDNLNVRFGPRRTFSNTETMLMSLSRCKKEFVFTRHVDAK

SEQ ID NO: 23934 - DNA, 583 bp, Panicum virgatum
  misc_feature: Ceres CLONE 1831300
  misc_feature: Encodes the peptide sequence at SEQ ID NO. 23935
aagcttgcttgcttgcttctcccggccgatttcactaccattccttgctcgactttgagagcggtggagagcctttgtacgtagctgcagcctgcagatgatcttctctgctttagttctactgttctgcttcacctggtccattcgtttcaagacagccgccgctgcaggccatggatcagcaggaacagaccagaactatggcaccttagatcaggtgaaggagaagctccaacaggtcgggctcgagtcatctaaccttataatcggggtggatttcaccaagagcaacgaatggacagggaagcattgtttcgacgggagaagcctgcatcacctcggcgacgctccgaacccttacgagcaggcgatcggcatcatcgggagaacgctgtcagcgtacgacgaagacaacaggatcccatgcttcggcttcggggacacatcaacgcacgatcgaagcgtcttcaacttctacagagatggccgggcgtgcaacggagtttcagaagcactgcagcgatacagagagatcgcccctcacattcggctctctgggccgacatctctagctccgatcata

SEQ ID NO: 23935 - protein, 161 aa, Panicum virgatum
  misc_feature: Ceres CLONE 1831300
  misc_feature (77)..(161): Pfam Name: Copine Pfam Description: Copine
MIFSALVLLFCFTWSIRFKTAAAAGHGSAGTDQNYGTLDQVKEKLQQVGLESSNLIIGVDFTKSNEWTGKHCFDGRSLHHLGDAPNPYEQAIGIIGRTLSAYDEDNRIPCFGFGDTSTHDRSVFNFYRDGRACNGVSEALQRYREIAPHIRLSGPTSLAPI

SEQ ID NO: 23936 - DNA, 1377 bp, Panicum virgatum
  misc_feature: Ceres CLONE 1831309
  misc_feature: Encodes the peptide sequence at SEQ ID NO. 23937
ctctcacgctcatttttctcacaaaaatccgcacagaatctattctgaggaaggatcgtaagtgagctgaagccatggccgtggatccaagcatcgcggcggacgccgaggccgcggcgcgccggagcgaggaggcggcggagtccttcttccgcggcgcgccgccgctccgcgagcgcgaccgcgtcgccgccagcgtggccaacttcgtcgtccgccgctccgcaggcgggcctgccggaggctccagggtgatttgcatcacctccggcggcaccacggtgcccctggagcagcgctgcgtgcgctacatcgacaacttcgcctctggccagcggggggcggccgccaccgagtattttctcaaggcgggctatgctgtcatcttcatctatcgccgtgggagcaagcagccttactgtagatttcttccagaggattcgtttctcgatctttttgagcttggtgaagactcagagatccaagttccccaatctcattccactgtggtcaaggcagctattagcaattatcgcaaggcgattggtgaaggcctgcttctgaaacttcccttcgctacaattttcgaataccttcagttactacagatggtagccacttctatgaattgcttggggcaccatggaatgttctttcttgctgctgcagtttctgacttctatgttccatgggaaagtatggctaaacataaaatcgagtcagcagttggccctttgaacatgcaactcaaccaagtccctaagatgcttttcatcctcagaaaaaattgggctccttcagcattttgtgtatcattcaagctcgagaccgatccaaacattcttctaaagaaggcggagatggctctgaaaaagtatggtatggacgtggtggttgcaaatgagcttgcaagctacaaaaatgtagtggtcatggtcacgagcagtgggagaacgaccgtgagcaggagcagcaaggaagaagacctggaagagcagctaaccgagcacctgatgaaaatgcacacagagcacatcacatagtccagttcggaggaccgtcaagcggactcgagctgaggtgattatatacgacacggtgacggcgagtatcagctatccaaccttttggttctcctagcaagttgccgcagagctcacctggttcatcaccggatgatcacaccaatatctacacgcacttgaattcgaatgtgagctatagctaatgccgcagttgtcatggtactgttcatgtggtgtacagatggtgtaaagagaggatttgagactagagctttgcaaaaacacgaagggggcagttgtcgtctctatttttttttgaccctcatgaatcgtgatacattgattccgtgct

SEQ ID NO: 23937 - protein, 322 aa, Panicum virgatum
  misc_feature: Ceres CLONE 1831309
  misc_feature (55)..(302): Pfam Name: DFP Pfam Description: DNA / pantothenate metabolism flavoprotein
  misc_feature: SWISSPROT Homolog: EC 6.3.2.5 Phosphopantothenate--cysteine ligase
MAVDPSIAADAEAAARRSEEAAESFFRGAPPLRERDRVAASVANFVVRRSAGGPAGGSRVICITSGGTTVPLEQRCVRYIDNFASGQRGAAATEYFLKAGYAVIFIYRRGSKQPYCRFLPEDSFLDLFELGEDSEIQVPQSHSTVVKAAISNYRKAIGEGLLLKLPFATIFEYLQLLQMVATSMNCLGHHGMFFLAAAVSDFYVPWESMAKHKIESAVGPLNMQLNQVPKMLFILRKNWAPSAFCVSFKLETDPNILLKKAEMALKKYGMDVVVANELASYKNVVVMVTSSGRTTVSRSSKEEDLEEQLTEHLMKMHTEHIT

SEQ ID NO: 23938 - DNA, 636 bp, Panicum virgatum
  misc_feature: Ceres CLONE 1831329
  misc_feature: Encodes the peptide sequence at SEQ ID NO. 23939
  misc_feature (546)..(546): n is a, c, t, g, unknown, or other
aaaattccacctatgccgcgctcaaaacgcccgccgcctggctttttcaacaagtccgggcccacgcggcggcggactgacgcggacgctccgtcttccggtggcggcgcgggagcttttccggtagggttagagtcgggagccggcggagaaattcccctccgcccaaacttgaaaccgcaaaacccaccgatgccgcgcccaaagcgcccgccgcctggctttttcgatgagtccaggcacaagcggcggccgacggcggcggacgcgggcgctccgtcttccggtggcgccgcaggaggagcgggcagctgctgcgatctcagccgcgcgttcgggcgctgccgcgcgctcctggacgacctgctgcggcacgacgacgggtgggtattcgaggcccccgtggacgcgcgcgccctcggcctccgcgactactacaccgtcatcgccgaccccatggacctcggtaccgtgctccgccgcctcgagcgccgccgctacgccgacccgtccgcgttcgccgccgacgtccgcctgacgttccgncacgccatgtcctacaacaaccagggcgaccccgtgtacgagagcgccgccgagctctccgggatattcgaggacggctgggccctcatc

SEQ ID NO: 23939 - protein, 147 aa, Panicum virgatum
  misc_feature: Ceres CLONE 1831329
  misc_feature (47)..(136): Pfam Name: Bromodomain Pfam Description: Bromodomain
  misc_feature: SWISSPROT Homolog: EC 2.3.1.48 Histone acetyltransferase
MPRPKRPPPGFFDESRHKRRPTAADAGAPSSGGAAGGAGSCCDLSRAFGRCRALLDDLLRHDDGWVFEAPVDARALGLRDYYTVIADPMDLGTVLRRLERRRYADPSAFAADVRLTFRHAMSYNNQGDPVYESAAELSGIFEDGWAL

SEQ ID NO: 23940 - DNA, 576 bp, Panicum virgatum
  misc_feature: Ceres CLONE 1831337
  misc_feature: Encodes the peptide sequence at SEQ ID NO. 23941
acaggccacagcccagggagcgcggcccgcacacgcacacgcacacgcctcctgtgtaccccgcgtgagctgctgccgagagagagagagacaggtacatgccccccagcctcgcctcgtatgcggcggcggcggcggccatgccgaccctggacctccgccccgagatggctcacgcgcaccagcccgccatgtcgccctcccaccacggcggggacggcaatggcgccgccgtcgcccccacccccatgcccaagaggctggaggggaaggtggccattgtgaccggcggcgcgcgggggatcggcgaggccatcgtgcggctgttcttttagcacggggcccgggtggtgatcgcggacatcgacggcgcggcgggcgatttttttttctcccccctgggcccgcaggtcagcttcgtgcgctgcgacgtgtccgtggaggaggacgtcaagcgggccgtggactgggcgctgtcgcgccacggcggccgcctcgacatctactgcaacaacgccggggagctgggccgtcagacacgcgccgccaagagcatcctctccttccacgtgggcg

SEQ ID NO: 23941 - protein, 78 aa, Panicum virgatum
  misc_feature: Ceres CLONE 1831337
  misc_feature (53)..(77): SWISSPROT Homolog: EC 1.1.1.288 Xanthoxin dehydrogenase
  misc_feature (51)..(76): SWISSPROT Homolog: EC 1.1.1.51 3(or 17)-beta-hydroxysteroid dehydrogenase
MPPSLASYAAAAAAMPTLDLRPEMAHAHQPAMSPSHHGGDGNGAAVAPTPMPKRLEGKVAIVTGGARGIGEAIVRLFF

SEQ ID NO: 23942 - DNA, 1064 bp, Panicum virgatum
  misc_feature: Ceres CLONE 1831343
  misc_feature: Encodes the peptide sequence at SEQ ID NO. 23943
ctcatcagctctttctcacctcgcttccaagcgacaccaaaagcggcggccgggggagggtacgggtacgggtacggcgggcacgggagccagctcggggactgcgtcgccggctttctgcgccgcttctccttccagccgttccgggagaacccgctcctcgggccctcgtcctccactttggagaaaatgggagcccttgactggaacaaaattgttcatcagcaccaaggctggcgccttattagctgcatctggctccatgctggcctaatccatttggttgtgaacctgctgagtttgctgtttattggaatccgccttgaacagcaatttggatttgttcgcattggtgccatatacctactatccggttttggtggcagcgtgctgtctgcactcttcctacggaacaactacatctctgttggtgcatctggagctttatttggcctgcttggatccatgctctcagagctactcatgaactggactatttattccaacaaggcagcagccataataactctcctgtttattatcgcgctcaacttggctattgggatactacctcacgcagacaactttgctcatattggtggattcgctactggcttcctcttgggctttgttctgttggctaggcctcaatttggttggatggagcgccatgagttgccagagactagccaacctcctaagtacaaagcataccaatatgtgctgtgggttttggcactcgtcttgctattggttgggtttgtgatttcactggtgatgcttttcaaggggaagaatgggaacgatggttgtcactggtgccactacctgaactgcgtgccaacatcgaagtggaagtgcaacacctaggcgcctcagttttccacttacacttccgacgaaatgtgtagtgttcagattcagaagaccatgttttatgctgtttgtatgtagatatgaacaagttctttgttctttattggattggactttcctggtttctgtaaactactttgttaagccttgcgtgtttataaatcgagggttgataccttttcaagctc

SEQ ID NO: 23943 - protein, 289 aa, Panicum virgatum
  misc_feature: Ceres CLONE 1831343
  misc_feature (72)..(217): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
LISSFSPRFQATPKAAAGGGYGYGYGGHGSQLGDCVAGFLRRFSFQPFRENPLLGPSSSTLEKMGALDWNKIVHQHQGWRLISCIWLHAGLIHLVVNLLSLLFIGIRLEQQFGFVRIGAIYLLSGFGGSVLSALFLRNNYISVGASGALFGLLGSMLSELLMNWTIYSNKAAAIITLLFIIALNLAIGILPHADNFAHIGGFATGFLLGFVLLARPQFGWMERHELPETSQPPKYKAYQYVLWVLALVLLLVGFVISLVMLFKGKNGNDGCHWCHYLNCVPTSKWKCNT

SEQ ID NO: 23944 - DNA, 1189 bp, Panicum virgatum
  misc_feature: Ceres CLONE 1831355
  misc_feature: Encodes the peptide sequence at SEQ ID NO. 23945
gccgtttctcatttctcaaccaagaagaaagaagccgccccgccccgccccgtccatccatcaaggtcgtaggtcgaggagcccggcggccgccatggactaccagcaggctgcgaccaacggccgccaccacaacgacggcgacgccgccgagtggaagcaggtcgccgagctgagggccgtcaccgaggcgcaggaccctgcctgcaaggaggaggacgactacatgctgcgtcggttcctccgcgcccgcgaccaccacatcggcaaggcatcggcgatgctgctcaagtacctcaagtagaagccgacggccaagccccgcggctgcatctccgagtcggaggtggcgcacgagctgtcccagggtaagttgtgcctgcagggccacgaccggcaggggcggcccatgatctacggcttcggcgcccggcaccacccctccaaccgcgacctcgacgagttcaagcgcttcgtcgtctacgtgctggacgccaccgtcgccaggctgccccccgggcaggagaagttcgccgccgtcgccgacctcaagggctggggctactccaactgcgacatccgggcctacctcgcggcgctcgagatcatgcagaactactacccggagcgcctcggccgggtgttcctcatccacgtgccctacgtcttcatggccgcctggaagatcgtctaccccttcatcgacgacaacaccaagaagaagttcgtcttcgtctcccacaaggacctcgacaggacgctccgggaggccatcgacgacgcccagctgccggaggtgtacggcggaaagctcaagctcgcgtcgccggccaagagtaagtgatcatcactacgtactgatgatctgaatctctagtgatggcacggcggttcagcaatcagcagagacgacgaccccgtgcatcggtgcatgctgtattattggaggatggtacgatccagtctccagaggtagtaccaagcgtaacacgtacgtacggctttcgacacaaattctgttaaatccatcgagtgccactgtgtcagacagaccggatgaacactatggcagttagctagtactaggtaaattagtaactttatttttccccatgcatttccttggctgactacatgtactctgtaataatggactacaacacaaggacaaggcacagaaagacgacgt

SEQ ID NO: 23945 - protein, 144 aa, Panicum virgatum
  misc_feature: Ceres CLONE 1831355
  misc_feature (1)..(144): Pfam Name: CRAL_TRIO Pfam Description: CRAL/TRIO domain
  misc_feature: SWISSPROT Homolog: EC 3.1.3.48 Protein-tyrosine-phosphatase
MIYGFGARHHPSNRDLDEFKRFVVYVLDATVARLPPGQEKFAAVADLKGWGYSNCDIRAYLAALEIMQNYYPERLGRVFLIHVPYVFMAAWKIVYPFIDDNTKKKFVFVSHKDLDRTLREAIDDAQLPEVYGGKLKLASPAKSK

SEQ ID NO: 23946 - DNA, 1170 bp, Panicum virgatum
  misc_feature: Ceres CLONE 1831361
  misc_feature: Encodes the peptide sequence at SEQ ID NO. 23947
ctcttccccccattccgcaccaacttcctttccacgccagggcccgagctccgtgctagggtttcctctcccgccgccgccgccgccaccgccgccggtggaggaggagctgagcgactagcgccgggaagggaccatggggacgccggagacgtcgcgcgagccgtgcccggaccggatcctggacgacgtgggcggcgcgttcgggatgggcgccgtcggcggctccgtcttccacttcctcaagggcgcctacaacacccccaacgggatgcgcctgtcgggcggcgcgcaggccgtgcgcatgaacgcgccgcgggtggggggcagcttcgccgtctggggcggcctcttctccaccttcgactgcgccatggtctacgcgcgccagaaggaggacccctggaactccatcgtagctggcgccgccacgggcggctttctatccatgcgccagggcgcgggggccgcggggcggtcggcgctcatgggcgggatcctccttgccctcatcgagggcgccgggctcatgctcaaccgcgtcctggtaaacccgccgctgcccgccgaggatcccaacctcaccgcggccatgggtcccggaaggttcccgggcctcccgcaggcgccgccggtcgtggcgcctcctgaggccgcgagctccggcggtgcgggtggctggtttggggggctgttcggcaagaaggaggaggagaaggccagctcgagcgggggcaagtcggagatcctggagagcttcgacacaccgagcaccccgataccatcattcgagtataagtgaggaaaaaggtttgctgatggaactgttgcttacctggtcttggaacgtggtgattggaattggagatgcagatcagcaatacaataaccgtgaggacaagtgattcacttgctcgataacttattcccgcctttgcccctctgctttgacggctcatatctatgagtccctgcttgtgtatgtataagccttctgaacgtggcagattggctactttttgaaatgatgtagtagtagcagaacaagcagaagcagttgtgtactgcctatatgatagcatttgtgtcgtgtgcaatgtattgcactcgagaaaacccgtgttctatatcttatgctggcctgtgaagggacagtaattttttagttcg

SEQ ID NO: 23947 - protein, 221 aa, Panicum virgatum
  misc_feature: Ceres CLONE 1831361
  misc_feature (4)..(133): Pfam Name: Tim17 Pfam Description: Tim17/Tim22/Tim23 family
MGTPETSREPCPDRILDDVGGAFGMGAVGGSVFHFLKGAYNTPNGMRLSGGAQAVRMNAPRVGGSFAVWGGLFSTFDCAMVYARQKEDPWNSIVAGAATGGFLSMRQGAGAAGRSALMGGILLALIEGAGLMLNRVLVNPPLPAEDPNLTAAMGPGRFPGLPQAPPVVAPPEAASSGGAGGWFGGLFGKKEEEKASSSGGKSEILESFDTPSTPIPSFEYK

SEQ ID NO: 23948 - DNA, 1222 bp, Panicum virgatum
  misc_feature: Ceres CLONE 1831375
  misc_feature: Encodes the peptide sequence at SEQ ID NO. 23949
gtcatcctcgcgccgctccactctccctccatctctctctcgccgccgtcccgggccggagaggagcgcgcgcgcgctaccgagtcccgagaaagatctccttccgccagctccagcgcggcgcgggccagctcgatcgatcgccgccgccgctgcctcgctcgagccggtcgatggggagggcgccgtgctgcgagaaggaggggctgcggcggggcgcgtggagctccgaggaggaccagcggctggtggcctacatccggcagcacggccaccccaactggcgcgcgctgccgcggcaggccgggctgctccgctgcggcaagagctgccgcctccgctggatcaactacctccgcccggacatcaagcgcggcaacttctccgccgacgaggaggccctcatcgtccgcctccaccgcgagctcggcaacaggtggtccgcgatcgcggcgcagctgccggggcgcaccgacaacgagatcaagaacgtgtggcacacccacatcaagaagcgtttggaaggcgacccggagggcggcgcctccgccgccggccggccgaagcagaaggcgcgcaagagcaagcccgccgcggccaggaacaagaagcaggccgccgcgaaggccgacaacagcgagacgttcatgacggcgtcgccggggctgtcgagcagcgtgagcagcggcgtcacgacgttctccgcggcggccgagtccaccgcggtggtgtcgtcgggcgacaccgcggccaccacaagcgcgagcctccagcccgaggccgccaaggcggagacggagatggagatggagatggagatggagagcttcagctcggcggagttcccgcccatcgacgagagcttctggtcgtcgccggacgtggtggacatgggcctcggcgccatggacgaggagctgggcctcgcgagcccgccgtcggcggccacgagggacgaggacatggagttctggctcaagatgctgctcgagtccggcgacatggacctcagcgtcgtcttgtaacagcaattagtgcagaacccgagcttaattagccgccaccttgcaagattagagcctctactattttcttttttctttcttttctcagttattatcctttccccattttccgccgacgagaaaatgttgggaaattcgatcgggtgatttcaccctgcttagaaaaaggaatactagcaagatttcgtttgttcttt

SEQ ID NO: 23949 - protein, 283 aa, Panicum virgatum
  misc_feature: Ceres CLONE 1831375
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: Useful for making plants with altered cell wall content and/or composition
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1010 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 824 in the 10/412,699 US patent application
  misc_feature: The sequence is a functional homolog of SEQ ID NO 1002 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 296 in the 11/479,226 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: Useful for biocontainment applications
  misc_feature: The sequence is a functional homolog of SEQ ID NO 442 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1564 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 126 in the 10/412,699 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 36 in US patent 7193132
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
MGRAPCCEKEGLRRGAWSSEEDQRLVAYIRQHGHPNWRALPRQAGLLRCGKSCRLRWINYLRPDIKRGNFSADEEALIVRLHRELGNRWSAIAAQLPGRTDNEIKNVWHTHIKKRLEGDPEGGASAAGRPKQKARKSKPAAARNKKQAAAKADNSETFMTASPGLSSSVSSGVTTFSAAAESTAVVSSGDTAATTSASLQPEAAKAETEMEMEMEMESFSSAEFPPIDESFWSSPDVVDMGLGAMDEELGLASPPSAATRDEDMEFWLKMLLESGDMDLSVVL

SEQ ID NO: 23950 - DNA, 1778 bp, Panicum virgatum
  misc_feature: Ceres CLONE 1831387
  misc_feature: Encodes the peptide sequence at SEQ ID NO. 23951
accgacacactcccactcgtttcgcccccatcctccgccgccgtcccccccacagatctcgccgcggccgccgctcccgccatggccgcgcgccgcctcctcctccccctcctcgccgtcgcgggatccctcgccttccccgcggcggccgagatcaagacggagtccttccgggaggacccgcgcgcctccatcatgttcgagaaattcggcttctccaagtcgggcgccgtccggatcgtcgtcacgggcgccgccgtctcctcccccgtcgcgcgggcggacctcaagcagctgggattcttcctcctctccgacgagtccctcctctacgccatcgacgaggcgcaggaggggccctcgcgggagaagcgcgccgcggcgaccaacggcggcggcgaggaccccgacggcggctccggcggcgccggcgccgggtgcgtgctctccagcccctacgtcaagaagctcttcaccttccacgacatgaagggcggccactacaacaagtcattcccggtcacccgccccgacgagtacaccctcttcttcgccaactgcgcgccggaggcgctcgtctccatgcgcgtccgcacggagatgtacaacgtcaacgcagacggctgcaaggactacctccccgtcggccaagcgcccgtgccggccatctacggcttcttcgccttgtgctacgccgcgttcctcgccgcctgggggcacctcaccctctcccgcgaccgcgtcaacgcgcaccagatccaccacctcatgtccggcctcctcgtcgcgcgcctcctctactgcctctccgccgccgaggaccagcactacatccgcgtcaccgggacgccgcacggctgggacgtcgccttctacctcttccagctcgtgaagggcgtcgtcctgttcgcggtgatcgcgctggtcggcaccggctggtccttcttgaagcccgtcctgcaggaccgggagaagaaggtgctcatggccgtgatcccgctccaggtcaccgctaacatcgccgcagctgtgattggggagaccgggcccttcttgcagagctgggtgacatggaaccagatcttgctgtttgtggacgtcgcgtgctgctgcgcggtgctcttcccggttgtgtggtcgatccggtcgctcagggagacatccaagaccgacggcaaggcggcgcgcaacctctccaagctcactctgttccggcagttctacgtcgtggtgattgggtacctgtacttcactaggatcgtcgtgtatgcgctcaagaccgttgccagctacaagtaccggtgggtgagcatcttggcagaggaggtggccaccctggcgttctacctgttcatgttctacacattcaagccagccgagaagagccactacttctccctcgatgatgaagaagaggaggccgcagagatggtgcttcgggaagaggaattcgagctatgaagagatgcatcgattcacaagaatcggttgaacttagctgcgggttcggtcgcggtgccacgttcgtttgatcttctctccctgtgatcttgatcatactttacaaatgccaggacatagcccatagtggtgtatgtacttgcagggatgtgagattattttgttcctcttgtagatttcaggttttagttctttactgatgaaacgcagattacttaacttataccatgttcaatgagtcttcttgcttgcactgcaattatgcaaatcaatgagcaacaactactactgtttcggtgtagtttgaaatttgctgc

SEQ ID NO: 23951 - protein, 459 aa, Panicum virgatum
  misc_feature: Ceres CLONE 1831387
  misc_feature (147)..(436): Pfam Name: Lung_7-TM_R Pfam Description: Lung seven transmembrane receptor
MAARRLLLPLLAVAGSLAFPAAAEIKTESFREDPRASIMFEKFGFSKSGAVRIVVTGAAVSSPVARADLKQLGFFLLSDESLLYAIDEAQEGPSREKRAAATNGGGEDPDGGSGGAGAGCVLSSPYVKKLFTFHDMKGGHYNKSFPVTRPDEYTLFFANCAPEALVSMRVRTEMYNVNADGCKDYLPVGQAPVPAIYGFFALCYAAFLAAWGHLTLSRDRVNAHQIHHLMSGLLVARLLYCLSAAEDQHYIRVTGTPHGWDVAFYLFQLVKGVVLFAVIALVGTGWSFLKPVLQDREKKVLMAVIPLQVTANIAAAVIGETGPFLQSWVTWNQILLFVDVACCCAVLFPVVWSIRSLRETSKTDGKAARNLSKLTLFRQFYVVVIGYLYFTRIVVYALKTVASYKYRWVSILAEEVATLAFYLFMFYTFKPAEKSHYFSLDDEEEEAAEMVLREEEFEL

SEQ ID NO: 23952 - DNA, 1151 bp, Panicum virgatum
  misc_feature: Ceres CLONE 1831390
  misc_feature: Encodes the peptide sequence at SEQ ID NO. 23953
gccactcgccagccaccacaccacccctgaactccaccaccaccgcccacgccacagccgccgccgcggaaccggcaccagcgcgcagcccgcccgccatggcggtgagcaacaacatcacggcgtgcgtgacgctgctggcgctgatctgcgcggtgcccgtgatcgcgtcgggggtctggttcgcctccgcgcagggcgacgagtgcgcgcgcctggcgcgatggcgcgtcgccatcctcggcaggctgctcctcctcgccgccctggcgggattcgtcggcgcctactggaaccgccgccgcctcctcgccttctacctcttcgccatggccgcgctcatcgtgctcctcatcgcgctcctcgtcttcgccttcgccgtcacccggggctccggcgcctaccccgtcctcggccgcgcctacgacgactaccgcctcgacggcttctccatgtggctccgcggctacgtctccgacgaccccggccgctgggagaagatcagggcctgcctcgccgtctccgacacctgcaagaagctccagcgccaggccgccttcgtcaacgccgagcagttctaccagtcacacctctcgccgctccagtcgggctgctgcaagccgccgtcggtgtgcgggttcacctacgtgagcccgacggagtggacgggcccggcgcggccggcggcggacccggactgcgcgctgtggagcaaccaccccggccagctctgctacgactgcgagtcctgcaaggccggcctcctggaggcgctccgcgaccagtggcacaaggccaacatcgcgctcgtcgtcgccaccgtctgcctcgtcttcctctacctcgtcggctgcagcgcctacaagaacgcccaggccgcctccttcttccgccactacaagtaactgacccgtgacgatgagctcgccggccggtgcggcgtgctgccggccggtcgccggcgtggaccctgttgtgtattgtggttgatgtgctttcttcagagttcagagtatcagactcttcttgctttgtggtggtagcagtaggcgtgtaagatgtgtaacaatgtaaggtagtggagatgtaagattgatgaccgggttgatgttgagacttgagagtaattaattctgatgtgttttttcgtt

SEQ ID NO: 23953 - protein, 268 aa, Panicum virgatum
  misc_feature: Ceres CLONE 1831390
  misc_feature (3)..(244): Pfam Name: Tetraspannin Pfam Description: Tetraspanin family
MAVSNNITACVTLLALICAVPVIASGVWFASAQGDECARLARWRVAILGRLLLLAALAGFVGAYWNRRRLLAFYLFAMAALIVLLIALLVFAFAVTRGSGAYPVLGRAYDDYRLDGFSMWLRGYVSDDPGRWEKIRACLAVSDTCKKLQRQAAFVNAEQFYQSHLSPLQSGCCKPPSVCGFTYVSPTEWTGPARPAADPDCALWSNHPGQLCYDCESCKAGLLEALRDQWHKANIALVVATVCLVFLYLVGCSAYKNAQAASFFRHYK

SEQ ID NO: 23954 - DNA, 588 bp, Panicum virgatum
  misc_feature: Ceres CLONE 1831396
  misc_feature: Encodes the peptide sequence at SEQ ID NO. 23955
atgcagtccttgttttagccgttgtttcttgtctgggtcgtgatcgataacgatgcctccgacgacgcgacggtgatccgggtggacagcgtgaacagccacggcacgctgctcgccgtcgtccaggtcatcgccgacctcagcctcgtcatccgcaaggcctacttctcctccgacggcaactggttcatggacgtgttcaatgtcaccgaccgtgacggcaacaaggttgttgacgcctcaaccatctcctacatccagaagacgctggaggcggacgactggtactacccggaggcgcgcaacacggtgggcatcgtgccgtcggaggagtacacctccatcgagctgacgggcaccgaccggccgggcctgctctccgaggtgtgcgcggtgcttgtcgtcatgggttgcgcggtccagagcgccgagctgtggacgcacaacacgcgcgtcgccgccgtcgtgcacgtcaccgacgccgagtccggcggcgccatcgaggacgccggccgcatcgccgacatcagcgcgcgcctcggcaacctgctgcgcgggcaaagcgacgtgcgcgccggcggcggcgcg

SEQ ID NO: 23955 - protein, 132 aa, Panicum virgatum
  misc_feature: Ceres CLONE 1831396
  misc_feature (50)..(113): Pfam Name: ACT Pfam Description: ACT domain
  misc_feature: SWISSPROT Homolog: EC 2.7.7.59 [Protein-PII] uridylyltransferase
MDVFNVTDRDGNKVVDASTISYIQKTLEADDWYYPEARNTVGIVPSEEYTSIELTGTDRPGLLSEVCAVLVVMGCAVQSAELWTHNTRVAAVVHVTDAESGGAIEDAGRIADISARLGNLLRGQSDVRAGGG

SEQ ID NO: 23956 - DNA, 575 bp, Panicum virgatum
  misc_feature: Ceres CLONE 1831435
  misc_feature: Encodes the peptide sequence at SEQ ID NO. 23957
gggcgtaccggctgagcaacaacccttttggcgtccccaacttcgtcaccttcctgctctccgtcccgatcctgggcgccggcatctggctgggccacttttccgacggcacccagtgcgagcgctacctctccgcgcccgtcatcgccttcggggccttcctcctcgccgtctccctcgcgggcctcgtcggcgcctgctgccgcgtcacctggctgctctgggtctacctcctcgccatgttcgccctcatcgtcgccctcttctgcctcaccgtcttcgccttcgccgtcaccaaccgcggcgccggggaggccgtctcttttctcggctaccaggaataccgcctcggggactactccaactggctgcagaagctctttttttgcaccccgaactggaacaggatcaggagctgcctccaggactccaaggtctgcaagagcttgcaggacagcagggagacgttcgcggacttcatacgctccgacctctcacccatccagtccgggtgctgcaagccccccccgagctgcaacttcacctacgtgagcggcacggagaggaccaagacg

SEQ ID NO: 23957 - protein, 190 aa, Panicum virgatum
  misc_feature: Ceres CLONE 1831435
  misc_feature (4)..(187): Pfam Name: Tetraspannin Pfam Description: Tetraspanin family
AYRLSNNPFGVPNFVTFLLSVPILGAGIWLGHFSDGTQCERYLSAPVIAFGAFLLAVSLAGLVGACCRVTWLLWVYLLAMFALIVALFCLTVFAFAVTNRGAGEAVSFLGYQEYRLGDYSNWLQKLFFCTPNWNRIRSCLQDSKVCKSLQDSRETFADFIRSDLSPIQSGCCKPPPSCNFTYVSGTERTK

SEQ ID NO: 23958 - DNA, 662 bp, Panicum virgatum
  misc_feature: Ceres CLONE 1831442
  misc_feature: Encodes the peptide sequence at SEQ ID NO. 23959
atcaaatagccatccagctaattttggccatcaggatccagacaagcagaccctgacttccccgtgaacgggagatggtgcaacctgagccaatggtgaagcgcagcacggcatgtagccagggtgtagttggcgctgtggaccggcttagcgcgctgccgaatgagctcatccacaccgtgttgtcattcctcccagccccagaagttgtgcgaacatgtcttctgtcacggcagtggagaagcctttggcgctctgcgccccgcatcaacctcgatgatgaggactttgggatctccatgatgaccatccgtgatggtaccttggaggagaagtgggccaagtttgaggatttcgccaccaacctgctgctgttccatgataatacctcgtccttgggagaattccggctttcatcaagcatctataaccagcgtcatatggaccgatggattcgccgtggcatcgagtactgcccttctgtgctcaaaatccagataaaacctcgcttcaagttcccaccaataatgggctcaaatttttatcatcttaagacgctgcatcttcgaagtgtggattttggtaaccatttcgcgggcctgctctgtcctaactgccctgtcatggaagatttggagcttaccagctgcgagttttcttgc

SEQ ID NO: 23959 - protein, 195 aa, Panicum virgatum
  misc_feature: Ceres CLONE 1831442
  misc_feature (23)..(70): Pfam Name: F-box Pfam Description: F-box domain
MVQPEPMVKRSTACSQGVVGAVDRLSALPNELIHTVLSFLPAPEVVRTCLLSRQWRSLWRSAPRINLDDEDFGISMMTIRDGTLEEKWAKFEDFATNLLLFHDNTSSLGEFRLSSSIYNQRHMDRWIRRGIEYCPSVLKIQIKPRFKFPPIMGSNFYHLKTLHLRSVDFGNHFAGLLCPNCPVMEDLELTSCEFS

SEQ ID NO: 23960 - DNA, 1604 bp, Panicum virgatum
  misc_feature: Ceres CLONE 1831457
  misc_feature: Encodes the peptide sequence at SEQ ID NO. 23961
agagggcgcgcggtgaagaacccaaccgagccgagaccgacgaccggccggccgagactacgagcgttcctcgcggacgcgcggcatggcgagggcggcgtggggctcgctcttcggctgcttcggcggctcctccgcccacggcggcggcgccgggaagaagaagtgcgggaagaagaagaagaagaagggcaacaagaagcccaaggtggcggcggcgggcggcggcggcagcagcagcgggaagccgcggctgcagagccggctgtcgttcacggagctgagcgggatggtgtcgcccgaggacctgtcgctctcgctggtgggctccaacctccacgtcttcagcatcgccgagctgctcgccgtcacgcgggacttctccatgaccaacttcatcggcgagggcggcttcgggcccgtctacaagggctacgtcgacgacaagaccaagccaggcctgcgcgcgcagcccgtcgccgtcaagctgctcgacctcgagggcgcccagggacacaccgaatggctgaccgaagtcatcttcctggggcagctgcggcaccctcacctcgtgaagctgatcggctactgctacgaggacgagcaccggctgctcgtctacgagttcatgaccaggggcagcctggagaaacatctcttcaaaaaatacgcggcgtcgctgccatggtcaacacggctgaagatcgccattggcgctgccaaagggttgtccttcctccatgaagtcgagaggccggtcatctaccgggacttcaaaacctccaacatcctgctcgactcggatttcaaggccaagctgtccgatttcggtctcgccaaggacgggccggaagacgacgagacccacgtctcgacacgagtcatgggcacgcagggctacgccgcgccggagtacatcatgaccggtcacctgacggcgaagagcgacgtgtacggctacggcgtggtgctgctggagctgctgacgggtcgccggtcggtggacaagagccggccggcgcgggagcagaacctggtggagtgggcgcggccgtacctgacggacgcgcgccggctggaccgcgtcatggaccccaacctcgccggccattactcgggccgcgccgcgcagaaggccgcggcggtggcgcaccagtgcgtcagcctcaaccccaagtcccgcccgcacatgtccgccgtcgtcgaggcgctcgagccgctcctcgcgctcgacgactgcctcgtcgggcccttcgtctacgtcgcgccgccggaggaaaacagcaacgacggcgacgcggctgcgggcaaggggggctccggcgggcgaggccggaggaagtccagcgatggcgcggcggccgtcgtgcggccggagtagctagctagctagtatgggcttgcagtgcttgctcgccctgtctctggattgttgctgcctgtagcagctggctgagctgccgatcaagccagcgtttggcatgcctacaagaggttttgaagcgtgcacagtacataggagcatctcacacttactccaagaggatgcacacgtttagtttcttcagggtttggggagtggataatggagcttaaaaatagtt

SEQ ID NO: 23961 - protein, 431 aa, Panicum virgatum
  misc_feature: Ceres CLONE 1831457
  misc_feature (99)..(376): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MARAAWGSLFGCFGGSSAHGGGAGKKKCGKKKKKKGNKKPKVAAAGGGGSSSGKPRLQSRLSFTELSGMVSPEDLSLSLVGSNLHVFSIAELLAVTRDFSMTNFIGEGGFGPVYKGYVDDKTKPGLRAQPVAVKLLDLEGAQGHTEWLTEVIFLGQLRHPHLVKLIGYCYEDEHRLLVYEFMTRGSLEKHLFKKYAASLPWSTRLKIAIGAAKGLSFLHEVERPVIYRDFKTSNILLDSDFKAKLSDFGLAKDGPEDDETHVSTRVMGTQGYAAPEYIMTGHLTAKSDVYGYGVVLLELLTGRRSVDKSRPAREQNLVEWARPYLTDARRLDRVMDPNLAGHYSGRAAQKAAAVAHQCVSLNPKSRPHMSAVVEALEPLLALDDCLVGPFVYVAPPEENSNDGDAAAGKGGSGGRGRRKSSDGAAAVVRPE

SEQ ID NO: 23962 - DNA, 1600 bp, Panicum virgatum
  misc_feature: Ceres CLONE 1831466
  misc_feature: Encodes the peptide sequence at SEQ ID NO. 23963
ggtcctctccatttaagctccacacctacaacttctctctccctgtctctctcttgcctccattgggcaagctgccaggccgcgtggctagctagccccgtgctgtgcgccggtgagaggcatagagagatgatgtcgagggaacgcaagaagcaggcggcggccgctcttcaggagaagctcaagatcctccgctccatcactcactcccacgctctgagcgacgcatccataatcatggacgcttcggcgtacatcaaggagctgaagcagaaggtggtgaggttgaaccaggagatcgcctgcgcgcaggacgcgcggagacacggctcctcctacccgacggtatgtgctcgcatacactcgatccgtgccatgtcatctagtccatgtacttagagatagacgacgacgcgcgtgctggcatgcacagaactaactacagaagttatgatgaccccagacacatgatgctaatttgttccgtggcattaccgtagagaagtggctatagagaggtagcactgcaccagttcacatgctggccaatcgcccgggattattcagtcagtactactcatcagtatagtagggccgtatggttcacatgcgtcaaggcttgttgtttcttcttgaatcccatgcttgctgcattattattccgctgtgaggctgatgagctgagcagcgctgattgatcaatgatgaacgggtggaccggccggatagatacatttgatttgtatacggggtgcaggtgaccgtggaaaccctagtgggcgggcacggcgggttcctcatcaacgtcttctccgacaagagctgcccggggctgctcgtctccgtgctcgaggccttcgacgagctggggctcagcgtcctccaggccaccgcgtcctgcgccgacgactccttccgcctcgaggccgtgggtggggaggtacctgctagtaaaatcttcttcttcctctctgaacacaatccagctgcgacttatatatcatgccggccggcgatcgacatgctaacatttctgttcggtcctgatgcgatgctgcgcgcccgcagaacgtggcggggaacgtggacgagcacgtcgtgaagcaggccgtgctgcaggccatcaggagctgctccgagagcggcagcgagcacgacgaggagtaggcggggctagctagctagctagcgcgtaagcgcacgcgccgcgtcgtcgccctcccgtcctgatgatgagcgtctcaagaagccgggatctcttttgcccgctccgttttttcctcccccctacctgctgtattttttttttggcttcgatctacatttcctctctatcgctggcgaaacgagcagtagctcttccctatctactagtgctgacgatgatctcgatcggtgaataatccgtagcagcaagcagcaccatttccagtgtgatatatagtattattaattagcgctatatttatatatatgtctatgacgacaataagatgatcgatcaggcatgtaatgtaagaatgatgggaggttggaagcaaagctgaacggagctagcattcgactgcccttccacatatatgtatgattaatttgatgc

SEQ ID NO: 23963 - protein, 89 aa, Panicum virgatum
  misc_feature: Ceres CLONE 1831466
  misc_feature: Useful for making plants with modulated biomass
MMSRERKKQAAAALQEKLKILRSITHSHALSDASIIMDASAYIKELKQKVVRLNQEIACAQDARRHGSSYPTVCARIHSIRAMSSSPCT

SEQ ID NO: 23964 - DNA, 173 bp, Panicum virgatum
  misc_feature: Ceres CLONE 1831472
  misc_feature: Encodes the peptide sequence at SEQ ID NO. 23965
agccggcgccggcataccggcctgccaacgggacgccggacggcgagcactcggcgctggtcgcctacggctccaggcgctcgctcctctccctctgtccgcccttcagaatcctcctgaggtacacaatggagcacgcggactgatcgatggtgaagacctacgagcacctg

SEQ ID NO: 23965 - protein, 47 aa, Panicum virgatum
  misc_feature: Ceres CLONE 1831472
  misc_feature: SWISSPROT Homolog: EC 1.3.1.21 7-dehydrocholesterol reductase
PAPAYRPANGTPDGEHSALVAYGSRRSLLSLCPPFRILLRYTMEHAD

SEQ ID NO: 23966 - DNA, 656 bp, Panicum virgatum
  misc_feature: Ceres CLONE 1831475
  misc_feature: Encodes the peptide sequence at SEQ ID NO. 23967
  misc_feature (587)..(587): n is a, c, t, g, unknown, or other
aacccacccagcgtctctcccagtaccatctcgtcttctccactgccaccaccactcctggtgacgggacaagaaaccgcaaggaaccaaacgcctttccgctcagccgcaaactgcccaggcttgtgaaccgagggatcgatcgatcgatgggcgccgaggcggagtgcgaccggatcaggggcccctggagccccgaggaggacgacgcgctgcggcggctcgtggagcggcacggcgcgcgcaactggacggcgatcgggcgcgagatccccggccggtcggggaagtcgtgccgcctgcggtggtgcaaccagctgtcgccgcaggtggagcgccggcccttcacggcggaggaggacgccgccatcgtccgcgcacacgcgcggctcggcaaccgctgggccgccatcgcgcgcctgctccccggccgcaccgacaacgccgtcaagaaccactggaactgctccctcaagcgcaagctcgacgccgccgctgccgcctcctccggcgcgggcgctgacggcgccgagctcgaggcgcggccctgcaagcgcctgagcctgtcgccggacagtccgtcgtcnggctccggcacggtctccgaccgcagcgacctcagccacggcgccagctccggctccgggtcctggcag

SEQ ID NO: 23967 - protein, 168 aa, Panicum virgatum
  misc_feature: Ceres CLONE 1831475
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 2262 in the 10/374,780 US patent application
  misc_feature: The sequence is a functional homolog of SEQ ID NO 774 in the 10/225,066 US patent application
  misc_feature: The sequence is a functional homolog of SEQ ID NO 1942 in the 10/374,780 US patent application
  misc_feature: Useful for making plants with altered cell wall content and/or composition
MGAEAECDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLDAAAAASSGAGADGAELEARPCKRLSLSPDSPSSGSGTVSDRSDLSHGASSGSGSW

SEQ ID NO: 23968 - DNA, 668 bp, Panicum virgatum
  misc_feature: Ceres CLONE 1831503
  misc_feature: Encodes the peptide sequence at SEQ ID NO. 23969
cctgttcggttctattgttctgttctgttctcttctcccgagtgaagcccattcgattcttctcgtcttccacctcgagctcggtccgtggccgtcgccatgagtagcgccgcgcccctgtccctcgccttgctcctgctcctcctcgcggtgccgtccccggctcgcggctgcgaccgctgcgtgcgccgctccaaggccacctaccaggcctcctcgctcgccctcaacgccggttcttgcgggtacggctccctggccgcgtccttgaacggcggcctcctcgccgcggcgggccccgagctctaccggggcggcgtcggctgcggcgcctgcttccaggtgcggtgcggggacagcgagctgtgcagtgccgccggcgccaaggtggtggtgacggaccaggcgcggacctcgaaccgcaccggccagctgctcagcggcgcggcgtacgcggccatggcccgcgccggcagggccgcgcggctcatggcgcggcgcgtcgtcgacgtcgagtacaagaggatcccgtgcgagtacacgaatcgcaacctgtcgatccgcgtggaggagaagagccggccgccgagcgagctgttcatccggttcctctaccagggcggccagaccgacatcgtcgccctcgacgtcgccacggtggggtcgtc

SEQ ID NO: 23969 - protein, 189 aa, Panicum virgatum
  misc_feature: Ceres CLONE 1831503
  misc_feature (62)..(140): Pfam Name: DPBB_1 Pfam Description: Rare lipoprotein A (RlpA)-like double-psi beta-barrel
  misc_feature: Useful for making plants with altered carbohydrate content
  misc_feature: Useful for making plants with altered cell wall content and/or composition
MSSAAPLSLALLLLLLAVPSPARGCDRCVRRSKATYQASSLALNAGSCGYGSLAASLNGGLLAAAGPELYRGGVGCGACFQVRCGDSELCSAAGAKVVVTDQARTSNRTGQLLSGAAYAAMARAGRAARLMARRVVDVEYKRIPCEYTNRNLSIRVEEKSRPPSELFIRFLYQGGQTDIVALDVATVGS

SEQ ID NO: 23970 - DNA, 646 bp, Panicum virgatum
  misc_feature: Ceres CLONE 1831515
  misc_feature: Encodes the peptide sequence at SEQ ID NO. 23971
gaaccgtagccctccatcgatcaatccatcaatcagcctgccgatcgactgatccaggagagcgccctgcacgtctgctgcggcctgcgggggagggggagacatggcctccggcgcccgcgcggaggaggagtaccactccctgttcaaggtggtgctgatcggggaccgccgcccccgccactccaacctgctgtcgcgcctcgccagggacgagttccgcctcgagaccaggtcccccatcggcgtcgagttcgcccccaagaccgtccccgccgacgaccagctcgtccaggcgcacatctcggacacccccggccacgagaggtaccgcgccatccccagcgcctactaccgcggcgcggtgggcgccctggtcgtgtacgacctgacccgccgcgtgacgttcgagaacgccgagcggtggctccgggagctgccggaccacacggacgccaacatcgtggtcctgctggtgggcaacaaggcggacctgcgccacctccgcgccgcctcgcccgaggacgccgcggccttcccggagcggcacgggaccttctccatggagacgtccgcgctggacgccaccaacgtggagcgcgccttccccgacgtgctccgccagatctaccacgtcgtgagccgg

SEQ ID NO: 23971 - protein, 180 aa, Panicum virgatum
  misc_feature: Ceres CLONE 1831515
  misc_feature (16)..(177): Pfam Name: Ras Pfam Description: Ras family
  misc_feature: Useful for making plants with altered lignin content
  misc_feature: Useful for making plants with altered terpenoid content
  misc_feature: Useful for making plants with altered alkaloid content
MASGARAEEEYHSLFKVVLIGDRRPRHSNLLSRLARDEFRLETRSPIGVEFAPKTVPADDQLVQAHISDTPGHERYRAIPSAYYRGAVGALVVYDLTRRVTFENAERWLRELPDHTDANIVVLLVGNKADLRHLRAASPEDAAAFPERHGTFSMETSALDATNVERAFPDVLRQIYHVVS

SEQ ID NO: 23972 - DNA, 334 bp, Panicum virgatum
  misc_feature: Ceres CLONE 1831518
  misc_feature: Encodes the peptide sequence at SEQ ID NO. 23973
gtgagtggtatcgagtcggggagttcgaggcgctcctgccgcggggcatggagatacagcagctcggccaccactcgcccgccaagcttgccagccttgctctagcgcccactaaagggcggacggagttcaaggagggcaggtggagcgccccggagaagccggtcgaggactggcgtgccagcagctcgaggacgaacaccgagtggtggtactccgccttccgcaatgtcaccgccatggtcggcgcccgggtgcttatgcttcccttcgccatgcccgagctcggctgggaggttggcatcaccgtgctggtcctgtcatggatcctcac

SEQ ID NO: 23973 - protein, 95 aa, Panicum virgatum
  misc_feature: Ceres CLONE 1831518
  misc_feature: Useful for making plants with altered oil content
MEIQQLGHHSPAKLASLALAPTKGRTEFKEGRWSAPEKPVEDWRASSSRTNTEWWYSAFRNVTAMVGARVLMLPFAMPELGWEVGITVLVLSWIL

SEQ ID NO: 23974 - DNA, 403 bp, Panicum virgatum
  misc_feature: Ceres CLONE 1831532
  misc_feature: Encodes the peptide sequence at SEQ ID NO. 23975
ctccccgcccctgccccctccgtccctcccccccccgcacgcgcagcaccctcgccctcggacggaccccccccggctccccctttccggcggccccccctccctgtcgccggcgaccagctgccccctgtcggcaaggaggagcccccgctgccatctcccgctttgatggttgctccccaaggatgagatggccctcccgtccaagctgtctggtattcagaagcaggtcttggcgctgtacaggggattccttcggacagcacgcctaaaagccccggaagagcggcgcaggatcgagtctgttgtctcggcagagttccgtgacaatgcaaggaatgttgatcataggaactttgtatacatagagtacttgctgaggagagggaagaggcagcttgag

SEQ ID NO: 23975 - protein, 70 aa, Panicum virgatum
  misc_feature: Ceres CLONE 1831532
  misc_feature (9)..(70): Pfam Name: Complex1_LYR Pfam Description: Complex 1 protein (LYR family)
MALPSKLSGIQKQVLALYRGFLRTARLKAPEERRRIESVVSAEFRDNARNVDHRNFVYIEYLLRRGKRQL

SEQ ID NO: 23976 - DNA, 422 bp, Panicum virgatum
  misc_feature: Ceres CLONE 1831534
  misc_feature: Encodes the peptide sequence at SEQ ID NO. 23977
atgtccatgccacccatccacccagggaagccaatgcccctggcccgccgctcccgcccccgctccccccggcgcgcccccccgaccgcgctgctccccccccccgcccgcctcctcctcctggcgccccccctggcacccgggtcctcctcccctgagccgcagccgcagaatgcccacccgctcctggggctgccggggccgccccacggtgtggcgttcgacatgtacggcggctacgtcaccgtcgacgagcaggcccgccccgcgctctactactggttccaggaggccgacccgccggaggcagcgccgctcctcctgtggctgaacggcgggcccgggtgctcctccatcggtggcggcgcgctggaggagctcggcgcctttcgcgtccacaccgacggccagacgctcctgct

SEQ ID NO: 23977 - protein, 129 aa, Panicum virgatum
  misc_feature: Ceres CLONE 1831534
  misc_feature: SWISSPROT Homolog: EC 3.4.16.6 Carboxypeptidase D
MPLARRSRPRSPRRAPPTALLPPPARLLLLAPPLAPGSSSPEPQPQNAHPLLGLPGPPHGVAFDMYGGYVTVDEQARPALYYWFQEADPPEAAPLLLWLNGGPGCSSIGGGALEELGAFRVHTDGQTLL

SEQ ID NO: 23978 - DNA, 1258 bp, Panicum virgatum
  misc_feature: Ceres CLONE 1831545
  misc_feature: Encodes the peptide sequence at SEQ ID NO. 23979
agaaatttccattcgaagcgcagcctcgatttgattcccaattcccaattccccaccatcaccaccgtctcccttcccgtgtgatcgctccacaagcccccatggccggctacccgccgcccgcctccggctacccctacggccccggcgccgggggtgccggaggctacggcgccccgccgccctacggctcctccccggccccctccgccccgccctacggcgacaagccccccaaggaaggcaagacctcctcctcctcctcctcctccgcgccgcccaactacggcgccccgccctcctcccagccctacggcggcggcggcggaggctacggcgcgccctacggcgccccgccgccctcgtccgcccctccctacggcgccccgccgccctcgtccgccgctccctacggcgcgccgccgcacgcgcccgcgccctacggggccccgccgccggcgtacgggggcggttacggcgggagccccttcgcgtcgcttgtgccgtccgcgttcccgcccgggaccgaccccaacgtggtggcctgcttccaggcggcagaccgcgacggcagcgggatgatcgacgacaaggagctgcagtccgcgctctccggttacaaccagagcttcagcctccgcaccgtccacctccttatgtacctattcaccaacaccaacgtccgcaagatcgggcccaaggaatttacttctgtgttttacagtcttcagaattggagagcaatatttgaaagatttgaccgtgatcggagtggtaagattgactcatcagaactgcgtgatgctcttctcagtctgggatattccgtctctccaactgtgctagacctgcttgtgtctaaatttgacaagactgggggcaagagcagagcaattgaatatgataacttcattgaatgttgcctcactgttaagggactgactgagaagttcaaggagaaggacaccgcatactccgggtctgcggcgtttacttatgaggctttcatgctgaccgtgctccctttcctcatcgcctagtagcacagttcagagccaaagctaagcatgccatgccagttgtgtaaaagtggagagagttgttttgagctgagttaaaattcttggatttgattggtgttcctggtgttgcttgtcataaagttgatgggtgggtatgtttagctcagaaaatgctacaacctatatatagcactggatctgtttgttcaacaataaccatctagtcattttccgtc

SEQ ID NO: 23979 - protein, 312 aa, Panicum virgatum
  misc_feature: Ceres CLONE 1831545
  misc_feature (211)..(239): Pfam Name: efhand Pfam Description: EF hand
  misc_feature: SWISSPROT Homolog: EC 3.4.22.52 Calpain-1
MAGYPPPASGYPYGPGAGGAGGYGAPPPYGSSPAPSAPPYGDKPPKEGKTSSSSSSSAPPNYGAPPSSQPYGGGGGGYGAPYGAPPPSSAPPYGAPPPSSAAPYGAPPHAPAPYGAPPPAYGGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFIECCLTVKGLTEKFKEKDTAYSGSAAFTYEAFMLTVLPFLIA

SEQ ID NO: 23980 - DNA, 719 bp, Panicum virgatum
  misc_feature: Ceres CLONE 1831573
  misc_feature: Encodes the peptide sequence at SEQ ID NO. 23981
atatgttcaaggcaaggcacgcactctgcctgcacacaagcgtctgctgctccgtcgtcttcctcgcctcttctccaaccgttcgaccccgcaagcttcctggtgatgaatcgttagacactaagctgcggccatcactcagtgctgaaaaaacaaggtgccagaagtgatcgactgcaggtatgggcaacttgtgctgctgtgttcaagttgatcagtcaaccgtggccatcagggagcagtttggcaagtttgacagcgtgcttgagccaggatgccactgcttgccttggttcatcggcaagcgtgtagctggtcatctcacactcaggctgcagcaactggatgtgcgctgtgagaccaagactaaggacaatgtctttgtgaacgtcgtggcatctattcagtaccgtgctctggctggcaaagcaagtgatgcgttctacaaactgagcaacacaaggtcccagatccaagcatacgtctttgatgttatccgagcaagcgttcccaagctcattttagatgacgctttcgagcagaaggatgagatcgcaaaggcagtggaggaggaactcgagaaggccatgtcagcttacggctttgagatcgtgcaaactctgattgtggacattgagccagatgagcacgtgaagcgcgcaatgaatgagatcaacgcagcggcgaggctgagggtggctgcgaacgagaagggcgag

SEQ ID NO: 23981 - protein, 178 aa, Panicum virgatum
  misc_feature: Ceres CLONE 1831573
  misc_feature (8)..(177): Pfam Name: Band_7 Pfam Description: SPFH domain / Band 7 family
MGNLCCCVQVDQSTVAIREQFGKFDSVLEPGCHCLPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKG

SEQ ID NO: 23982 - DNA, 216 bp, Panicum virgatum
  misc_feature: Ceres CLONE 1831576
  misc_feature: Encodes the peptide sequence at SEQ ID NO. 23983
atctaccgcgccactcgctgctgaccccacgcccctgtctccggtcccaaatcgcgtctcgatccctccgatctctcctctctcgggagagcagggaggaggaggatggaacgccctcccgtcccccttttcgacagcgtcgagggtggccaaccattcttcctgctagctgggaccgatgtgattgaatctgaggagcctgccatgaagatgggc

SEQ ID NO: 23983 - protein, 36 aa, Panicum virgatum
  misc_feature: Ceres CLONE 1831576
  misc_feature: SWISSPROT Homolog: EC 2.5.1.55 3-deoxy-8-phosphooctulonate synthase
MERPPVPLFDSVEGGQPFFLLAGTDVIESEEPAMKM

SEQ ID NO: 23984 - DNA, 420 bp, Panicum virgatum
  misc_feature: Ceres CLONE 1831580
  misc_feature: Encodes the peptide sequence at SEQ ID NO. 23985
cgatcccgtcccccatccgtccagaaattcctccccagccctccaaatccaagccaagccgcccccccccatcccctccagatgccgatctttgttaagaccctccccggccagaccctccctttggaggttgagtcctccgaccccattgaccatgtgaaggcccagatccaggaccaggagggcctccctcccgacccgcagcgtctgatcttcgctggcaagcagcttgaggatggccgccccctagccgactacaacatccagaaggagtccaccctccacctggtgctccccctgcgtggtggtatgcagatctttgtgaagaccctcactggcaagaccatcaccttggaggtggagtcttcccacaccatcgacaatgtgaaggcgaagatccaggacaaggagggcatcccc

SEQ ID NO: 23985 - protein, 112 aa, Panicum virgatum
  misc_feature: Ceres CLONE 1831580
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MPIFVKTLPGQTLPLEVESSDPIDHVKAQIQDQEGLPPDPQRLIFAGKQLEDGRPLADYNIQKESTLHLVLPLRGGMQIFVKTLTGKTITLEVESSHTIDNVKAKIQDKEGI

SEQ ID NO: 23986 - DNA, 1327 bp, Panicum virgatum
  misc_feature: Ceres CLONE 1831596
  misc_feature: Encodes the peptide sequence at SEQ ID NO. 23987
gctccttccgctccgccagcctcgcgtccgccgctcgcgcgcgcacgacgcgtgcccctcccaggccccggcgcccccaatccggctgccgccgcagcagcagcagcagcggggcgccccatcccggccggcgccatggcggtggaccgcgtggtggagggcgaggaggcgttcgaggaggtggacccgacggggcggttcgggcggtacgccgacgtgctggggctgggctccgtcaagaaggtgtaccgcggcttcgaccaggaggaagggatcgaggtggcgtggaaccgcgtccggctgcgcgcgctggcggaccgcgaccccggcatggtggaccgcctccacgccgaggtgcgcctgctgcgctccctccaccacgaccacatcatcggcttccacaaggtgtggctcgaccgcgacgccggcgtgctcaacttcatcaccgaggtctgcacctccgggagcctccgcgagtatcgccagcgccaccgccacgtctccgtcaaggcgctcaagaagtgggcgcgccagatcctcgagggcctcaaccacctccacacccacgacccctgcatcatccaccgcgacctcaactgcagcaacgtcttcatcaatggcaacaacggccaggtgaagatcggcgacctcgggctggcggcgatcgtggacaagacgcacgtggcgcacacgatcctgggcacgccggagttcatggcgccggagctctacacggaggcgtacacggagtcggtggacatctactcgtacgggatgtgcgtgctggagatggtcacgcgggaggtgccctactcggagtgcggcagcgtcgtgcagatcttccacaacgtcacccggggcgtcccgcccgcggcgctcaagcggctcaaggaccccgagctgcgcggcttcatcgagcgctgcatcggccagccgcggaaccgcccctcggccgccgagctcctggaggaccccttcttcgacggcgtctgcagcggggacgacgacgcgctggctgacgcggccaccgtcgtcgccggaacgcccgtgccgcgccccaggagctacgtcgacgacctcgccgggctccggctggactgaccgaccatcagtgccaggattatattccgctcgttgtgttttagaatgcagaggaagagaggctgctggtcttacttagcgaattcctggccggccggcgagcgattgcaagtgtgtatactagattacttacgtctccctggcgatcggttgagtagttttcgctgtatctgtaccaataattgttgctgccttttgggcgaggtgaagcgctgtatttgactcg

SEQ ID NO: 23987 - protein, 321 aa, Panicum virgatum
  misc_feature: Ceres CLONE 1831596
  misc_feature (23)..(282): Pfam Name: Pkinase Pfam Description: Protein kinase domain
  misc_feature: SWISSPROT Homolog: EC 2.7.11.1 Non-specific serine/threonine protein kinase
MAVDRVVEGEEAFEEVDPTGRFGRYADVLGLGSVKKVYRGFDQEEGIEVAWNRVRLRALADRDPGMVDRLHAEVRLLRSLHHDHIIGFHKVWLDRDAGVLNFITEVCTSGSLREYRQRHRHVSVKALKKWARQILEGLNHLHTHDPCIIHRDLNCSNVFINGNNGQVKIGDLGLAAIVDKTHVAHTILGTPEFMAPELYTEAYTESVDIYSYGMCVLEMVTREVPYSECGSVVQIFHNVTRGVPPAALKRLKDPELRGFIERCIGQPRNRPSAAELLEDPFFDGVCSGDDDALADAATVVAGTPVPRPRSYVDDLAGLRLD

SEQ ID NO: 23988 - DNA, 1435 bp, Panicum virgatum
  misc_feature: Ceres CLONE 1831601
  misc_feature: Encodes the peptide sequence at SEQ ID NO. 23989
gtctagggttttgtttgcaaaccccgatccggtccaccccaccgccgccgccgccggcgaagcgcgccgccgggcgcgggtgccgaagggatggcgaaccgcacggaccccctcgcgaagagcatccacgggacgaacccgcagaacctggtggagaagattgtgcgctccaagatctatcagagcacctactggaaggagcagtgcttcggcctcaccgccgagacgctggtcgacaaggccatggagctcgaccacaccggcgggacctacggcgggaaccgcaagcccaccccgttcctctgcctcgcgctcaagatgctgcagatccagcccgacaaggacatcgtcgtcgagttcatcaagaacgaggactataaatatgttcgcgttcttggggccttctacctgcgcctcaccggcaccgtcgccgatgtctaccagtatctggagccgctctacaatgactaccgcaagatcaggcacaagctcagcgatggacagttcacacttacccatgttgatgagttcatcgatgagttgctgaccaaggactactcctgtgatacagccctgccccgtatccagaaaagatgggttcttgaagcatctggaactctagaaccaagaagaagtgcacttgaggatgattttgaggaagaagaggaagacaaggaggaagaacaacctatggaaatcgatgagcctaacggccgtgaaaaggataatcatcgtcgaaggagccctgcaagggaacgggatagggatcgggaccgagaccgggacaggaaacatgaaaggcaccacagggaccgagattatgatagagaccgggactatgatagagactatgggagaggacgggaaagagaccgagatagagatcgtgaaagggacagaaacagggatagggatcgtgatcgtcaccgcctgcgagatgatgattacggccgagacagggaccgagaccgtgagagggatggtagggaaagggaacgccgagacagagaccgtggtaggcacaggagccgctcaaggagcagggatcgacgagacagagaccgtgaagatggagagtaccgcaggaggcgtggtcgtggcagtgctagtcctcgagggcgtggtgaggatggcgtcacaagagaggaaccgaagaggaagaaggaaaagaaagagaagaagggtgaagggaatgctccggatccgaatgatcctgagatcatagaaatgaacaagctccgggcctctctagggttgaaaccgcttaagtagatttcttgttgtagtgtatttttgaagcttgttagctccggtagtttgaaccggaaatgttgagctggatatgcatccaacattttttgctggctttctcaccttcatgtaattaccttgtattgtcacgttgatgtaatgatgccatctcatctgattggtt

SEQ ID NO: 23989 - protein, 393 aa, Panicum virgatum
  misc_feature: Ceres CLONE 1831601
  misc_feature (1)..(177): Pfam Name: PRP38 Pfam Description: PRP38 family
MANRTDPLAKSIHGTNPQNLVEKIVRSKIYQSTYWKEQCFGLTAETLVDKAMELDHTGGTYGGNRKPTPFLCLALKMLQIQPDKDIVVEFIKNEDYKYVRVLGAFYLRLTGTVADVYQYLEPLYNDYRKIRHKLSDGQFTLTHVDEFIDELLTKDYSCDTALPRIQKRWVLEASGTLEPRRSALEDDFEEEEEDKEEEQPMEIDEPNGREKDNHRRRSPARERDRDRDRDRDRKHERHHRDRDYDRDRDYDRDYGRGRERDRDRDRERDRNRDRDRDRHRLRDDDYGRDRDRDRERDGRERERRDRDRGRHRSRSRSRDRRDRDREDGEYRRRRGRGSASPRGRGEDGVTREEPKRKKEKKEKKGEGNAPDPNDPEIIEMNKLRASLGLKPLK

SEQ ID NO: 23990 - DNA, 626 bp, Panicum virgatum
  misc_feature: Ceres CLONE 1831612
  misc_feature: Encodes the peptide sequence at SEQ ID NO. 23991
gtctgccgcctccgctccttccccattgctgaaggctcagtggcatccatcgtcgacgtcgaggcgctcctgccggcggccatggagatacagcagctcgacgactactctccggccaagcttgccagccttgctctagcgcccagcaaagggcgtacggactccaaggagggcagctggagcgcgccggagaagccggtcgaggactggcgtgccatcaactcgaggaggaacgccaagtggtggtacgccgccttccacaatgtcaccgccatggtcggcgccggcgtgcttagccttcccttcgccatgtccgagctcggctggggggttggcatcacggtgctggtcctgtcatggatcctcacggtgtacaccctgtggcagatggtggagatgcacgagatcgtgccggggaagcggttcgaccggtaccacgagctggggcagcacgcgttcggcgagaagctgggcctctggatcgtcgtgccgcagcagctggtggtggaggtcggcctgaacatcgtctacatggtcaccggcggccagtccctgcagaagttccacgacttggtctgccacggcagccgtcatgtcagtcagttactcgacgattgcatgggctg

SEQ ID NO: 23991 - protein, 181 aa, Panicum virgatum
  misc_feature: Ceres CLONE 1831612
  misc_feature: Useful for making plants with altered oil content
MEIQQLDDYSPAKLASLALAPSKGRTDSKEGSWSAPEKPVEDWRAINSRRNAKWWYAAFHNVTAMVGAGVLSLPFAMSELGWGVGITVLVLSWILTVYTLWQMVEMHEIVPGKRFDRYHELGQHAFGEKLGLWIVVPQQLVVEVGLNIVYMVTGGQSLQKFHDLVCHGSRHVSQLLDDCMG

SEQ ID NO: 23992 - DNA, 492 bp, Panicum virgatum
  misc_feature: Ceres CLONE 1831616
  misc_feature: Encodes the peptide sequence at SEQ ID NO. 23993
attcatcctctgctctccgccgataaatcctcctcctctgctccctcctgctctctcctcgccgccaccttactccgaattcgatggacctgcatgcggagctgcggcgcccggcggcgccccacgaggcggcgctgagggccgtgcagaagccgcccgccaagccctggcgcgggggagccggagccgccgccaccgcggccccgcccccgccgcccaaggtgtaccgcgtcgagccccgggagttccgggacctcgtgcagaggctcaccggcgcgccgcccgcggccacggccaagggcggcgtggcgccgcggccgcaccatacccatcacctggcgaccgcggtgcggccccagcacccggcggccgctcgcgcttcaggggaccaccggaagaacctgtgcagctcgcactgggtctggtccgcgctggacggggtggacggcgtcaacgccggcggactcctgtagtcacctgcctctgcctgct

SEQ ID NO: 23993 - protein, 129 aa, Panicum virgatum
  misc_feature: Ceres CLONE 1831616
  misc_feature (41)..(71): Pfam Name: VQ Pfam Description: VQ motif
MDLHAELRRPAAPHEAALRAVQKPPAKPWRGGAGAAATAAPPPPPKVYRVEPREFRDLVQRLTGAPPAATAKGGVAPRPHHTHHLATAVRPQHPAAARASGDHRKNLCSSHWVWSALDGVDGVNAGGLL

SEQ ID NO: 23994 - DNA, 1235 bp, Panicum virgatum
  misc_feature: Ceres CLONE 1831629
  misc_feature: Encodes the peptide sequence at SEQ ID NO. 23995
acgggcatcgcccatcgctgtgctgagcttgcattgagccggcgcaatggccaccacctccgctgcctccgttctcgtccttctgatgatgttcgccgcggtcgtcctgcccgggacgctggcgtcgagcaactgccccccgccggcgcctggcggcggtggcgggcacggcccccggcgcccgtggtacccggcgcccggcagtggcggcggctccggctcaaggccttaccccggctccggctccggcggcggccacggcaagccaccccaccacggcaagccgccaaagcaccacggcaagcctccctccagctgcccgccctgcaacccgccgtacactcctccgacgcctcggccgtcgccgccttacgtgccgccgtacaccccgccaacgccgcggccgtctccgccctacgtgccgccgtacacccctccgacgccgcgtccgtctccgccgtacgtgccgccgacgccgccctacgtcccgccgtacgtgccgccgtcgccgccgtacgtgccgccgacgccgccgtacgtgccgccgtcgccgccgtacgtgccgccgtcgccaccgtacgtgccgccgtcgccgccgtacgtgccgccgtcgccgccgtacgtgccgccgacgccgccctacgtcccgccgtacgtgccgccgtcgccgccctacgtcccgccgtacgtgccgccatcgccgccgtacgtgcctccgacgccgacgccgacgccgccggcggggcgaacgtgcccgatcgacgcgctgaagttgaacgcgtgcgtggacgtgctgagcgggctgatccacctggtgatcgggcgggaggccaagtccaagtgctgcccgctggtgcagggggtcgcggacctggacgcggcgctctgcctctgcaccaccatccgcgcgcgcctgctcaacatcaacatctacctccccgtcgcgctcgagctgctcatcacctgcggcaagcacgcgccgccggggttcaagtgcccgccgctctacgactgatcgatgagctgcctgtagggagatcacctacatcgcgccatgcatggcggtgcttcctacgggcatgtgatgatgggcactactgaggatgggatcatgcgcaagctagcagcatgtctacaacttgtgtcgtcgtgatttcttttggtgttcttgagtagtatgttctttcattcccgtcaggactcaggactgggaatcgaaaacttttcgatctcag

SEQ ID NO: 23995 - protein, 322 aa, Panicum virgatum
  misc_feature: Ceres CLONE 1831629
  misc_feature (236)..(317): Pfam Name: Tryp_alpha_amyl Pfam Description: Protease inhibitor/seed storage/LTP family
  misc_feature: Useful for making plants with modulated salt sensitivity
  misc_feature: Useful for making plants with altered cell wall content and/or composition
MATTSAASVLVLLMMFAAVVLPGTLASSNCPPPAPGGGGGHGPRRPWYPAPGSGGGSGSRPYPGSGSGGGHGKPPHHGKPPKHHGKPPSSCPPCNPPYTPPTPRPSPPYVPPYTPPTPRPSPPYVPPYTPPTPRPSPPYVPPTPPYVPPYVPPSPPYVPPTPPYVPPSPPYVPPSPPYVPPSPPYVPPSPPYVPPTPPYVPPYVPPSPPYVPPYVPPSPPYVPPTPTPTPPAGRTCPIDALKLNACVDVLSGLIHLVIGREAKSKCCPLVQGVADLDAALCLCTTIRARLLNINIYLPVALELLITCGKHAPPGFKCPPLYD

SEQ ID NO: 23996 - DNA, 1773 bp, Panicum virgatum
  misc_feature: Ceres CLONE 1831637
  misc_feature: Encodes the peptide sequence at SEQ ID NO. 23997
cccttgcagtgtcgccctctctcgattctctctccagtccagccggggcagtcccccttccatcaggtattcaggtgttgcctcctgcagatccaaattggaatttgggccttcgtctccacatcaccaatctggtaaatacgggcaataaacagctccccccccggatcctgacgcagtttcttgctttttctctcgcaaattattatgggaagcgaaagattatattcttcttccctttttgctttgttgagcccaaaaggctgaagcttttgcgttcttccccacaaatatctggagccatgccttttgttttgtttggccatggggtgaaatagtatgtgggatggccaacaattggcatgcggccctttttttcatccctgcgactgcaagaggccttctttttagatctgtgccttcctcttcctggctgccttctttgggtttgctcgcagcaaacacaagccattttactgcttggaggctgccacttttagtagctctggctcttgagtgatctccaaggggagggagggggaggggagtgatgggggagtgcgaggactcggaggagtacaggtgctgggaggagcttctgccggacgcgctgggcctcatcttccgcaacctgccgctccaggaggtgctcaccgtcctgccgcgggtgtgcaagtcctggggccgggtggtcgccggcccctactgctggcaggagatcgacatcgaggagtggagccagcagcagagcaagccggagcagatcggccgcatggtcgagctgctcgtcggccgcagcggcggctcgtgccgccgcatcagcgtctccgggctgccctgcgacccgctcctctcgttcataggagaccacgctcgagctcttcgcgccctggagattccacggagcgagatcagcgactccatcgtggaaactgtggctccccggctatccaacgtcaccttcctggacatcagcagctgcaccaagatcggggctcgcgccctggacgctttcggcaagcactgcaagtccctggtggggctccggcgggtgatgcacccgatcgacctggcggacaaggagtgccagcacgacgaggcccacgccatcgcgtgcagcatgcccaagctccggcacctggagatggggtacatgctgatcacgacggaggcggtggcggagatcctggggcagtgccgcgagctcaagttcctggacctgcgcggctgctgggccgtggacgacaagctcctgcgggagcgccacccggggctgcgcgtgctgggcccgcgcgtcgaggactgctacgagaacagcttctgggaggagtgctccgactactcggacgacgacgacgactccatctactcgtgggagttcatggacgacggcgacggctactacgccggcgtcggcagcgacgacgaggccatctgggacgacggccagggcctcgagaacctcgaggtcaggttctacggcggcggcttcagcgagagcttcgccggcttcgactggccgccgtcgccgtgatcgtgagatcaccgcagcagttaattagttgttcctgcttgctttctttctttctactctgtgcgcgtgcgcgtgtgttgttcgttcctgagctgagcttgcagatatgtcgctgcaccaccgagtctgcgacatcgctacttcatctcctcctccctctccatctagcttgcagatatgttaagtggactgctaatagtagtacaatctagatgtaaactctggtgtttacatgaagc

SEQ ID NO: 23997 - protein, 327 aa, Panicum virgatum
  misc_feature: Ceres CLONE 1831637
  misc_feature (11)..(59): Pfam Name: F-box Pfam Description: F-box domain
MGECEDSEEYRCWEELLPDALGLIFRNLPLQEVLTVLPRVCKSWGRVVAGPYCWQEIDIEEWSQQQSKPEQIGRMVELLVGRSGGSCRRISVSGLPCDPLLSFIGDHARALRALEIPRSEISDSIVETVAPRLSNVTFLDISSCTKIGARALDAFGKHCKSLVGLRRVMHPIDLADKECQHDEAHAIACSMPKLRHLEMGYMLITTEAVAEILGQCRELKFLDLRGCWAVDDKLLRERHPGLRVLGPRVEDCYENSFWEECSDYSDDDDDSIYSWEFMDDGDGYYAGVGSDDEAIWDDGQGLENLEVRFYGGGFSESFAGFDWPPSP

SEQ ID NO: 23998 - DNA, 656 bp, Panicum virgatum
  misc_feature: Ceres CLONE 1831652
  misc_feature: Encodes the peptide sequence at SEQ ID NO. 23999
gcacacgcactcacactcacactcgctggcctcagctagctctccggcgagccaccgcgccccctctccccctccgtccaatggcggcagccgcgggcctcctgctgctcctggccctcggcggcgcggcggcgcaggtgttcccgccgtggaacgggacgttccccgggttcggggacgggagcggcgcccggggcgcgggcgcggcggcgggggcggcgacgggcgtgccggcgatgttcgtgttcggggactcgctgacggacaacggcaacaacaacgacctgcagtcgcttgccaaggccaactacccgccctacggcatcgacttcgccggcgggcccaccggccgcttctccaacggctacaccatggtcgacgagatcgctcaactcctgggcctgccgctgctgccgtcgcacccggacgcctcgtcggcggacgcggccctccgcggcgtgaacttcgcctccgcggcggcggggatcctggacaacacgggccagaacttcgtggggcgcatcccgttcaaccaacagatcaagaacttcgagcagacgctggaccagctgagccgcaagctgggcggcgcgcccaggctggcgccgacgctggcgtggagcatcttctacgtcgggatggggagcaacgactac

SEQ ID NO: 23999 - protein, 191 aa, Panicum virgatum
  misc_feature: Ceres CLONE 1831652
  misc_feature: SWISSPROT Homolog: EC 3.2.1.51 Alpha-L-fucosidase
  misc_feature: Useful for making plants with modulated phosphate use efficiency
MAAAAGLLLLLALGGAAAQVFPPWNGTFPGFGDGSGARGAGAAAGAATGVPAMFVFGDSLTDNGNNNDLQSLAKANYPPYGIDFAGGPTGRFSNGYTMVDEIAQLLGLPLLPSHPDASSADAALRGVNFASAAAGILDNTGQNFVGRIPFNQQIKNFEQTLDQLSRKLGGAPRLAPTLAWSIFYVGMGSND

SEQ ID NO: 24000 - DNA, 706 bp, Panicum virgatum
  misc_feature: Ceres CLONE 1831667
  misc_feature: Encodes the peptide sequence at SEQ ID NO. 24001
attcccaggcctttctcctcgctccgaggaggaaacgcgcgccgcctgccctgcagcccgcgctctttcctgttgccgtttttagctcgccctcggatctcgctcccgtcgcgtgcgcctgctgtgttcctgtcggcgctgctggaaaggcgggccctttcggccggccggcctctcgtgtgagccgtgatctttccttctcatccttggacccggaggaggtgccgccgccatgaacgcgctcgccgccaccagccgcaacttccggcgcgccgcgaggctgctcaacctcgaccccaagctcgagaagagcctgctcatcccatttcgcgagatcaaggtggaatgcaccatccccatggacgacggcaagttggcgtccttcgtggggttccgcgtgcagcatgacaacggccgtgggccgatgaaaggcggtatccgctatcaccctgaggttgatccagatgaagtaaacgcacttgcacaactgatgacatggaagacagcagttgcagcagtaccttatggtggcgcaaagggagggattgggtgcaatcccggtgaactaagtagaagtgagttggagcggttgacacgcgtatttacacagaaaatccatgatcttatcgggactcatacagatgtcccagctcctgacatggggaccaatgcacagaccatggcatggatgttagatgagtactcg

SEQ ID NO: 24001 - protein, 157 aa, Panicum virgatum
  misc_feature: Ceres CLONE 1831667
  misc_feature (31)..(157): Pfam Name: ELFV_dehydrog_N Pfam Description: Glu/Leu/Phe/Val dehydrogenase, dimerisation domain
  misc_feature: SWISSPROT Homolog: EC 1.4.1.3 Glutamate dehydrogenase (NAD(P)(+))
MNALAATSRNFRRAARLLNLDPKLEKSLLIPFREIKVECTIPMDDGKLASFVGFRVQHDNGRGPMKGGIRYHPEVDPDEVNALAQLMTWKTAVAAVPYGGAKGGIGCNPGELSRSELERLTRVFTQKIHDLIGTHTDVPAPDMGTNAQTMAWMLDEY

SEQ ID NO: 24002 - DNA, 580 bp, Panicum virgatum
  misc_feature: Ceres CLONE 1831673
  misc_feature: Encodes the peptide sequence at SEQ ID NO. 24003
gtgccagcatctttcctctgcatctgccctttcaccattctgttcctgcgccagagccaactcctcgacctgcagacggatagggagcccggacgtcgcctgcactccagccaccctgctggcacagtgctacaaaaagaggacggcagcaaagcccgagtgccagagacccaccagccttgtgctcgctgaaagcgcatgtagtacatggatcaggcgcgcgctaccggcgccggtgagcagcctgcggcagctgccggcgatgaacccgcgaagaggatcgtcggcggcggggacgcgccggccgccggggtggcgacggctgggggtggctgcttcgactgcaacatctgcctcgagtgcgccgcggagccggtggtcacgctctgcggccacctctactgctggccctgcatctacgagtggctgcgcctcggcgccgacgcgggcgccgggagctccgcgaggcggcggtgccccgtgtgcaaggccgcggtgtcccctgacgcgctcgtgccgctctacggccgcggcgggagcacccgcgccaagaagccgccgcgcggcctggccggcagca

SEQ ID NO: 24003 - protein, 124 aa, Panicum virgatum
  misc_feature: Ceres CLONE 1831673
  misc_feature (46)..(93): Pfam Name: zf-C3HC4 Pfam Description: Zinc finger, C3HC4 type (RING finger)
MDQARATGAGEQPAAAAGDEPAKRIVGGGDAPAAGVATAGGGCFDCNICLECAAEPVVTLCGHLYCWPCIYEWLRLGADAGAGSSARRRCPVCKAAVSPDALVPLYGRGGSTRAKKPPRGLAGS

SEQ ID NO: 24004 - DNA, 964 bp, Panicum virgatum
  misc_feature: Ceres CLONE 1831679
  misc_feature: Encodes the peptide sequence at SEQ ID NO. 24005
atcgagttcatggaacagaaaccctaggtagaacttagcttagttgtagacttggccgtctccctggcggtcctctgtatcagggtactctgagcttatccctcgatcagttactacagctgctagttctatcatctctgtgttcgtgaattcctctcttctccgaatttttcccttatttgttgctgttttgccaaattccgttgctcggtattgctagatcctgacacaagatggggcacatggacaacaccggcagaagcttcatgtgcgaccccgagatgccctccaccgtcagttacctgccgaggttgtcttcttccaagttcttgcccttctccctcaccggagggggacaagagggcggcggcgtgccctccctgttccgcctcggccgccgctccaagtctccgccgtcgcagcagcggcagcaagcccaggccgccgggtccccaccgcggacggcggaggaggagagggcgcgggtgttccgcaagttcgacgccaacggcgacgaccggatctcgcggtccgagctcgcggccctgttcgagagcctaggccccgccgcctccgacgacgagctggcgcgcatgatggccgagccggacatcgacggcgacggcgtcatcagcctcgacgagttcgccgccctcaacgccaccgtcgtgggtgacgccgccgtcgtcgaggaggacctgcgccacgccttccgcgtcttcgacgccgacggcaacggcaccatctccgccgccgagctcgcgcgcgtgcttcgggggctcggcgagtccgcctccgtcgcccagtgcggtgggagaggtgggatgccgaggggatgacaggtggggctcaattgtcagctaaaaaaaatggaagctcaatttacttagcctcctgtagtggagacgtatatttagatgagtaaaatttaaaaatagatttctaaatagacatttgatcatct

SEQ ID NO: 24005 - protein, 201 aa, Panicum virgatum
  misc_feature: Ceres CLONE 1831679
  misc_feature (155)..(183): Pfam Name: efhand Pfam Description: EF hand
  misc_feature (81)..(109): Pfam Name: efhand Pfam Description: EF hand
  misc_feature: SWISSPROT Homolog: EC 2.7.11.1 Non-specific serine/threonine protein kinase
MGHMDNTGRSFMCDPEMPSTVSYLPRLSSSKFLPFSLTGGGQEGGGVPSLFRLGRRSKSPPSQQRQQAQAAGSPPRTAEEERARVFRKFDANGDDRISRSELAALFESLGPAASDDELARMMAEPDIDGDGVISLDEFAALNATVVGDAAVVEEDLRHAFRVFDADGNGTISAAELARVLRGLGESASVAQCGGRGGMPRG

SEQ ID NO: 24006 - DNA, 1482 bp, Panicum virgatum
  misc_feature: Ceres CLONE 1831701
  misc_feature: Encodes the peptide sequence at SEQ ID NO. 24007
acggagtcgttagtacttagcagtttgcaatttcaatctctaatcgttcaaatcttttgtgttcttgaaaaaaaatctcagtttagcatttgcatgacgattagtatttgtacacaacaggatgacatctcgagccccattgcggcgcacatcctggacttctgcgacgatggcagcggcggggacctcttcgcggccgtgaacgcggcgtcggacatgttcacggcgtcctccgaggacgcctcgtcgtcgtccgtgacgacgcctcccgcgccctgcagccacggcgacaacgtgtcgtcgggcgcctcggcggccttctcccccatgcagtccctggactccaccctgtcggcgctcctcgaggaagacgatccaccagttcccgacaccgaactcctccccatcgattaccagttcgcggcagcggtggccggggatgagccaccccagccggagcagcagtttggccaggttccggtggcgctcccaatggcctccgcggcggagcaatcggcggctctgcagacgcagatgagcagcacggcgtcggagctcatgcacctcacctcctccgggtacagcgacgagtgcttcgcggcggcgatggccggcggagggtacgtgggcctggaagaggctttgtgccagcagcagcagcagccgccgccgcagcccggcgcgttgctccccgccggcgtcatggaaaccgccgcgcaggggtgcttcttcggcaaggacgcggcggcgcaaggtggcttcttcgggactggctgcaccggcatggggacgtccatgatggggatggaggagatcggcgagtaccagcggatgatggagaccgcgagcgccgcgctggccgccacgcgcagccccgacgcggactccgccgccgcggcgcagatggcgttcgctggcaacgccggggaaatgcagatgggcggcggcatgagcccggggcggctgccggcagccgcggcggcgacggaggcgtcgagcctggaggacgcgagcttcaagaccgcaaaaatcagcgttgaggagagacgggagaagatccacaggtacatcaagaagcggaacgagcgcaacttcagcaagaagatcaagtacgcctgcaggaagaccctggcggacagcaggcctcgcgtgcgcggcagattcgccaagaacgacgactacggcgagccgtcgagggcgcttcagaaccacgacgagtatgaccagattgcggggttgaaggagaaagacatgctcgacaccgacgccctgcaggcgcacctcagcgggatgaattcctacatgtacaaccacacggtcgagtcctggatgtagtgcaggtgcaagcgagacatggctaacgtttcccgtttctgtttccaaattttgtgcagatttcaacagtatttttgttatttggtcccatggaataatttatactgtataggtttataaagtgcagtgcgaagcttgagttgctac

SEQ ID NO: 24007 - protein, 413 aa, Panicum virgatum
  misc_feature: Ceres CLONE 1831701
  misc_feature (318)..(362): Pfam Name: CCT Pfam Description: CCT motif
MTISICTQQDDISSPIAAHILDFCDDGSGGDLFAAVNAASDMFTASSEDASSSSVTTPPAPCSHGDNVSSGASAAFSPMQSLDSTLSALLEEDDPPVPDTELLPIDYQFAAAVAGDEPPQPEQQFGQVPVALPMASAAEQSAALQTQMSSTASELMHLTSSGYSDECFAAAMAGGGYVGLEEALCQQQQQPPPQPGALLPAGVMETAAQGCFFGKDAAAQGGFFGTGCTGMGTSMMGMEEIGEYQRMMETASAALAATRSPDADSAAAAQMAFAGNAGEMQMGGGMSPGRLPAAAAATEASSLEDASFKTAKISVEERREKIHRYIKKRNERNFSKKIKYACRKTLADSRPRVRGRFAKNDDYGEPSRALQNHDEYDQIAGLKEKDMLDTDALQAHLSGMNSYMYNHTVESWM

SEQ ID NO: 24008 - DNA, 917 bp, Panicum virgatum
  misc_feature: Ceres CLONE 1831706
  misc_feature: Encodes the peptide sequence at SEQ ID NO. 24009
acccatcctcccacccaatccaagcgaacagagctgctagcaagcaaggggaagcagcagcgtgggcaatggcggcaacgctccagccattgctgccctgcttcctgctcctgctgcttctcactcccggcgccgcgggggcggggcgccacaccggcggccggacgctggtcttcatcctggcggggcagtccaacatgagcggccgcggcggcgccaccagcggcacctgggacggcgtcgtgccgcccgagtgcgcgccgtcgccgcgcatcctccgcctctcccccgcgctccgctgggaggtggcgcgcgagccgctgcacgccggcatcgacgtcggcaacgtcctcggcgtcgggcccggcatgcccttcgcccacgccgtcctcgccgcctgcggcaacgccgtcccggcggtggggctcgtcccctgcgcgcagggcggcacgccgctcgccaactggacgcggggcacggagctgtacgaccggatggtgacgcgcgccagggcggccatgggcgggggcggcgagctggccgctgtgctgtggtaccagggggagaccgacgccatgagcaaagaggacgccgagctctaccaggggcgcatggaggcgttcgtgcgcgacgtccggcgcgacctcggccgcgccgacctcctcgtcgtccaggtcgggatcgcgacagcgcagtatggcggcaagttcctcgaccgcgtcagggaagcccagaaagccgtcacgctctcgctcccgaatgtcaagtacgtcgacgccatggggctgcccatcgcgagtgacaagacgcatcttaccaccgaggctcaggtccagctcggcaacatgctagccaagtcctacttagaaactctgtaaactctaattggttaatcgaatcaacacatagtttctacc

SEQ ID NO: 24009 - protein, 269 aa, Panicum virgatum
  misc_feature: Ceres CLONE 1831706
  misc_feature: Useful for making plants with altered cell wall content and/or composition
MAATLQPLLPCFLLLLLLTPGAAGAGRHTGGRTLVFILAGQSNMSGRGGATSGTWDGVVPPECAPSPRILRLSPALRWEVAREPLHAGIDVGNVLGVGPGMPFAHAVLAACGNAVPAVGLVPCAQGGTPLANWTRGTELYDRMVTRARAAMGGGGELAAVLWYQGETDAMSKEDAELYQGRMEAFVRDVRRDLGRADLLVVQVGIATAQYGGKFLDRVREAQKAVTLSLPNVKYVDAMGLPIASDKTHLTTEAQVQLGNMLAKSYLETL

SEQ ID NO: 24010 - DNA, 647 bp, Panicum virgatum
  misc_feature: Ceres CLONE 1831712
  misc_feature: Encodes the peptide sequence at SEQ ID NO. 24011
catggaaagagtttgaagcaactcaggattctaaaaatgctgaaagtctacaaaatggccctactcttgaaattcggatacctgcagaatttgttacttctactaatcgtcaagtaaagggtgctcagctttggggaacagatatatacacaaatgattcagatctcgtggctgttctaatgcatactggttactgctcgcctacatcctcccctccaccatctgccatccaagaactccgtgcaactgttcgagttctaccaccacaagagagttatacttcaacattgaggaacaatgtacgttcacgtgcttggggtgctgggattggttgtagctttcgcatagaacgctgctgcattgttaaggtggtggtaccattgatcttgagccacgccttagccacacgtcagctgtggaacctacacttgctccagttgctgttgagcgtacaatgacgacaagagctgcagcttctaatgcattgcgtcaacaaagatttgttcgtgaagtgacaatacagtacaatctctgcaatgagccatggttaaaatatagtataagcattgtggcagacaagggattgaaaaaatctctttatacttctgccagactgaagaaaggggaagttatatatttggaaacac

SEQ ID NO: 24011 - protein, 151 aa, Panicum virgatum
  misc_feature: Ceres CLONE 1831712
  misc_feature (22)..(106): Pfam Name: Rxt3 Pfam Description: Histone deacetylation protein Rxt3
WKEFEATQDSKNAESLQNGPTLEIRIPAEFVTSTNRQVKGAQLWGTDIYTNDSDLVAVLMHTGYCSPTSSPPPSAIQELRATVRVLPPQESYTSTLRNNVRSRAWGAGIGCSFRIERCCIVKVVVPLILSHALATRQLWNLHLLQLLLSVQ

SEQ ID NO: 24012 - DNA, 1325 bp, Panicum virgatum
  misc_feature: Ceres CLONE 1831713
  misc_feature: Encodes the peptide sequence at SEQ ID NO. 24013
agaagcatcatcaagcaggaaacagagcaagcgaagcaagcagagcccaagagcagagagagccagcgagcagccgcggcgttccagtcttccagaccgaagcatctccggcacgccggcgaccgtggccgatcaggcaggcaagatggtgcaccaagaagccgccaaggaggtggtcccgctgatgactccgtacaagatgggccagttccagctctcgcaccgggtggtgctcgcgccgctcacgcgctgccgctcctacggcaacgtgccgcagccgcacgccgcgttgtactacgcgcagcgcgccaccaggggcggcctcctcatcgccgaggccacgggggtctccgccaccgcgcaggggtacccggagacccccggcatctggacgccggagcaggtcgaggcgtggaagcccatcgtcgacgccgtccaccgcaagggcggcatcttcttctgccagatctggcacgtcggcagggtctccaccaacgagctccagcctgacgggcaggcgcccatctcgagcacggacaggcagatttcccctgaccccgagtcctggacggtgtactcgaagccgcgccggctggggaccgaggagatccggggggtcgtcgacgacttcaggcgtgccgcgcggaacgccatcgaggcgggcttcgacggcgtggagatccacggcgcgcacgggtacctcctcgagcagttcatgaaggacagctccaacgaccgcaccgacgagtacggcggcagcctcgagaaccggtgccgcttcgccgtcgaggtcatcgacgccgtcgtcggcgaggtgggcgcgcaccgcgtgggcatcaggctgtcgccgttcgtcgactacatggattgcgtcgactccgacccggtggcgctcggcaactacatgatccaacagctcaacaggcacgagggcttcgtctactgccacatggtggagcctcggatggccatcgtcgacggtcgctggcagattccacaccggctgttgccgttcaggaaggcgttcaacggcacgttcatcgccgccggcggatacgacagggaggaaggcaacaaggtcgtggcagaaggctatgctgaccttgtcgcgtatggaaggctcttcctggccaacccagacctgcccaggaggtttgagctgggtgcgccactgaacaagtacgaccgatccaccttctacatacaggatcccgtcgttggctacacggactacccttttcttgaagacgatagcaacagcaaagaatccggtacccaagcttgagcccgcggggtttatcgatttcatcaggggctattaatgg

SEQ ID NO: 24013 - protein, 379 aa, Panicum virgatum
  misc_feature: Ceres CLONE 1831713
  misc_feature (12)..(344): Pfam Name: Oxidored_FMN Pfam Description: NADH:flavin oxidoreductase / NADH oxidase family
  misc_feature: SWISSPROT Homolog: EC 1.3.1.42 12-oxophytodienoate reductase
  misc_feature: Useful for making plants with modulated water use efficiency
MVHQEAAKEVVPLMTPYKMGQFQLSHRVVLAPLTRCRSYGNVPQPHAALYYAQRATRGGLLIAEATGVSATAQGYPETPGIWTPEQVEAWKPIVDAVHRKGGIFFCQIWHVGRVSTNELQPDGQAPISSTDRQISPDPESWTVYSKPRRLGTEEIRGVVDDFRRAARNAIEAGFDGVEIHGAHGYLLEQFMKDSSNDRTDEYGGSLENRCRFAVEVIDAVVGEVGAHRVGIRLSPFVDYMDCVDSDPVALGNYMIQQLNRHEGFVYCHMVEPRMAIVDGRWQIPHRLLPFRKAFNGTFIAAGGYDREEGNKVVAEGYADLVAYGRLFLANPDLPRRFELGAPLNKYDRSTFYIQDPVVGYTDYPFLEDDSNSKESGTQA

SEQ ID NO: 24014 - DNA, 665 bp, Panicum virgatum
  misc_feature: Ceres CLONE 1831714
  misc_feature: Encodes the peptide sequence at SEQ ID NO. 24015
agccaccttccccttcccctcttctcctcggaagccggcgccggcccacccccccccaagcacggaaaggaaggaagcgggaataagaatgttgtcaaaggcttgttcaatcttggcctcttcctttcccccttgttcctcctcctcccccccccccacaataagggggcacccttccttgttgcccacctggcgaaaccattggttcggaaaccccctgttgtacgaaatcggttccttgttggtcttgcccttaagaaccctgcacgaattagggcttgtgtttggcccaggaaggttcttctgcaacttaaccaccttctcttcttcccttcaaattaaccttgtcccttgccttcaaaataattttgcttttttcctgcacaactttaatcctgaaacagttgaattgttgaacccttctaaggttttgcttattttaattgctttgaaaaaaaaaaatcaaaatttgacttatatactgattccccttcttcactataaccttactgggggaaacttgaaactaaaggcaaattatgttgcaaaggtttttgtttctaaaaagaaccggaataaatttcttggctttgacttcgttcttaaggaggttaacacttgattgtttgctgttcttcaagttctggtattgaaaattcctggct

SEQ ID NO: 24015 - protein, 177 aa, Panicum virgatum
  misc_feature: Ceres CLONE 1831714
  misc_feature: SWISSPROT Homolog: EC 3.1.2.6 Hydroxyacylglutathione hydrolase
MLSKACSILASSFPPCSSSSPPPTIRGHPSLLPTWRNHWFGNPLLYEIGSLLVLPLRTLHELGLVFGPGRFFCNLTTFSSSLQINLVPCLQNNFAFFLHNFNPETVELLNPSKVLLILIALKKKNQNLTYILIPLLHYNLTGGNLKLKANYVAKVFVSKKNRNKFLGFDFVLKEVNT

SEQ ID NO: 24016 - DNA, 605 bp, Panicum virgatum
  misc_feature: Ceres CLONE 1831721
  misc_feature: Encodes the peptide sequence at SEQ ID NO. 24017
cccccaggctcgaatgcatatggagcttccaccacgatggatgctaatgaatacggcgctcgacaaggcctgaaagtgtgtggaacggcaaccaagacggatgctaacgactatggtgatcaccgaggcttccaagtctgtggaatgatgaccacccagccagatgcccatgatcattgcagtcaccaaggtccgatcaagccagctgacagattagatcaccttctcaaccaaccagcaaacagatgttgtgctgactgtggtgctccagatccaaaatgggtatcaatgactttttttgttttcatttgcatcaagtgttcaggagctcatagaagtcttggagtacacatatccaaggtggtttcagtgaagctagatgagtggacagacgaacaagttgatcttttggcagattcaggtgggaatgctgcagtaaacatgagatacgaggcatttatgcctgaaaacttcacgaagccaaggcaagattgttcagcagaggagcgcagcgattttattaggtctacattagcctatcaacttttcattcctttgatgtcttattatgcgacacctttgcccggactacatgatctttcgcc

SEQ ID NO: 24017 - protein, 189 aa, Panicum virgatum
  misc_feature: Ceres CLONE 1831721
  misc_feature (57)..(179): Pfam Name: ArfGap Pfam Description: Putative GTPase activating protein for Arf
MDANEYGARQGLKVCGTATKTDANDYGDHRGFQVCGMMTTQPDAHDHCSHQGPIKPADRLDHLLNQPANRCCADCGAPDPKWVSMTFFVFICIKCSGAHRSLGVHISKVVSVKLDEWTDEQVDLLADSGGNAAVNMRYEAFMPENFTKPRQDCSAEERSDFIRSTLAYQLFIPLMSYYATPLPGLHDLS

SEQ ID NO: 24018 - DNA, 705 bp, Panicum virgatum
  misc_feature: Ceres CLONE 1831741
  misc_feature: Encodes the peptide sequence at SEQ ID NO. 24019
acggatcggggttcggggcacagagagattccgcacggatccatcggggcacagagactacggcgccggtggcggcctggccactggtggtctcgccgcgcatcctccgcgtgagtgaaagcagctgcgggatatattcgtttcgtccccgatcgagcctccccgctgcgcagtctcctcgtcgacagggaagaagggggaacgcctgtgtgaaagaggggaagcttccattgcgggatctgcgaacggttcaaagatggcagagacggtgttcactccatccttggaagggatgaagcatgtcaaggcagaaaatggagtcattctcaccaagcctttccttgaagtctgcaagcaaatattgcctgtcctggataaatttggagctgctatggcaatcgtaaagagtgacatcggtggcaatatcacaagactggaaaacaagtattcttcagacccatcaaaatatgagcacttgtacagcatggttcaggaagaagttcaaaaccagactgcaaaaggttcctcgagctgcacaaatgggcttctatggctcacaagggccatggatttccttgttgagttattctgtaacctgcttgagcatccagactggactatgagtcaagcttgcactgattcgtacaccaaaactctgaagaaatttcatggctggcttgccagttctagctttacggtggccat

SEQ ID NO: 24019 - protein, 149 aa, Panicum virgatum
  misc_feature: Ceres CLONE 1831741
  misc_feature (10)..(149): Pfam Name: GLTP Pfam Description: Glycolipid transfer protein (GLTP)
  misc_feature: Useful for making plants with modulated oxidative stress sensitivity
MAETVFTPSLEGMKHVKAENGVILTKPFLEVCKQILPVLDKFGAAMAIVKSDIGGNITRLENKYSSDPSKYEHLYSMVQEEVQNQTAKGSSSCTNGLLWLTRAMDFLVELFCNLLEHPDWTMSQACTDSYTKTLKKFHGWLASSSFTVA

SEQ ID NO: 24020 - DNA, 638 bp, Panicum virgatum
  misc_feature: Ceres CLONE 1831753
  misc_feature: Encodes the peptide sequence at SEQ ID NO. 24021
atcctctagccaagtagccatcggcgacaggaccccggccccctcctccccgatccacagctcgatcagccagatcgggaggaaactagactgagctaaaccggcagccagcatggcggcggggcggtggtggctggcggcggcgtggtgcgcggtggccgcggtggctgctgcggcgcagtcgtcgtcgccgccggcggcggacccgctgcaggccaagtgctcggcggacttcgggaagctgacggactgcatggactacgcgacggggcacgaggggcagccctcgtcgacgtgctgctccgatgccgccgacacgcagaaggcgcggccgcagtgcctctgctacatcatccagcaggtgcacagcggccggaacgaggtgcagtcgctgggcctccgcttcgaccgcctcatggcgctccccgccgcctgcaagctcgccaacgccaacgtcacgctctgcatcagtgagtaaccggcttctctcttgccagtttggttgctgctcaaaatatgtttgtattgtttttgagatgcaatcagggacatacttctaccaaggcaaacaattttttttactaatttgcatatgcccactgtccttcaagtggtcaagcctgagatcagggagggtc

SEQ ID NO: 24021 - protein, 121 aa, Panicum virgatum
  misc_feature: Ceres CLONE 1831753
  misc_feature (37)..(118): Pfam Name: Tryp_alpha_amyl Pfam Description: Protease inhibitor/seed storage/LTP family
MAAGRWWLAAAWCAVAAVAAAAQSSSPPAADPLQAKCSADFGKLTDCMDYATGHEGQPSSTCCSDAADTQKARPQCLCYIIQQVHSGRNEVQSLGLRFDRLMALPAACKLANANVTLCISE

SEQ ID NO: 24022 - DNA, 1237 bp, Panicum virgatum
  misc_feature: Ceres CLONE 1831777
  misc_feature: Encodes the peptide sequence at SEQ ID NO. 24023
agcgaggttactgttttggggctccaaaaatttgcgaatcactccgcgcaaaatggcgagcaccccaatccgccacctccatcccctcttcctcttcgtcctcgtggcgtcgctgcgatgtggagcggcggctggagacggagacggtggcgaggacttctgctcggcagagccgtcgagcgagtgctcagggggccagccgctctactggaaggtcacccaccccacccttgcgcccgcgcacctccaagatttacctggcttcacacgtagcgttttcaaaagggaccatgctttaataacaccagaaagtcatgtattcagtcctttgccggattggatcaatacattaggtgcatatttgatcagtccagccattggtgcgcacttcaccatgtacctggcaaacatgcaagacggctcaaaatcagccccaccaccgaaagatgttgaaaggctcatttttgtactacaagggagtatctcattatctgtggggactggaaccacccattctctgtcggtggattcctatgcgtatcttcctgcaaacataaaacattctatgatctcagatgaatcaaccactcttgtaatatttgagagaaggtacgccgctaccgaggattccccccctaatctaattgtcggttcaacagataagcaaccccttcttgaaaccccaggagaggtatttcaactgaggaagctgctaccaacttctctgctttatgactttaatatccatataatggactttcaaccaggcgaatatctcaatgtgaaggaggttcattacaatcaacatggacttctgcttctagaggggcaaggaatatacagattgggggacagctggtaccctgtgcaagcaggcgataccatttggatggcaccgtttgttcctcagtggtatgctgcccttggtaaaaccaggaccagatacttgctgtacaaagatgttaataggaacccattgatatgatcaaagaaatcattctcgttggataccaaaataaagcaataacacaaaatgtggagctgtgccagctatgaagttctctggagatggttacgggaaggagacaaaaaaaaaggatctgattgtacactgagaaatcacagaaccaaacgacgtgggaattcaaatgtgcacttgtgatgtttatgactactgatattgggtcactggtgatacattttgaaatgtgaaaacttcctgtactgtgttatggac

SEQ ID NO: 24023 - protein, 310 aa, Panicum virgatum
  misc_feature: Ceres CLONE 1831777
  misc_feature (232)..(302): Pfam Name: Cupin_2 Pfam Description: Cupin domain
MASTPIRHLHPLFLFVLVASLRCGAAAGDGDGGEDFCSAEPSSECSGGQPLYWKVTHPTLAPAHLQDLPGFTRSVFKRDHALITPESHVFSPLPDWINTLGAYLISPAIGAHFTMYLANMQDGSKSAPPPKDVERLIFVLQGSISLSVGTGTTHSLSVDSYAYLPANIKHSMISDESTTLVIFERRYAATEDSPPNLIVGSTDKQPLLETPGEVFQLRKLLPTSLLYDFNIHIMDFQPGEYLNVKEVHYNQHGLLLLEGQGIYRLGDSWYPVQAGDTIWMAPFVPQWYAALGKTRTRYLLYKDVNRNPLI

SEQ ID NO: 24024 - DNA, 595 bp, Panicum virgatum
  misc_feature: Ceres CLONE 1831795
  misc_feature: Encodes the peptide sequence at SEQ ID NO. 24025
cgaccccgctgcttgaagaaaccccccaggcccagcgcgccagggagagagggagagagagagaggcccaggagaagagatggagggccaggaggaggaccttcccctgggcccccaccagttcccggagccggcgcccctcgggacggcggccccgggcgccggggatgacaaggactacaaggagcccccgccggcgccgctgttcgagcccggggagctcaagtcctggtcgttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtccctgactagggccgtcttctacataatcatgcaatgcctcggtgctatctgtggagctggagtggtgaagggcttccagcagggactttacatgggcaacggtggtggtgccaacgctgtcgcc

SEQ ID NO: 24025 - protein, 171 aa, Panicum virgatum
  misc_feature: Ceres CLONE 1831795
  misc_feature (47)..(170): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGQEEDLPLGPHQFPEPAPLGTAAPGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAVFYIIMQCLGAICGAGVVKGFQQGLYMGNGGGANAV

SEQ ID NO: 24026 - DNA, 250 bp, Panicum virgatum
  misc_feature: Ceres CLONE 1831860
  misc_feature: Encodes the peptide sequence at SEQ ID NO. 24027
catcgccgcgaggccccatcggtcgcgttcccgtcggcgagagcgagcgcagcatccgcaccgcgccagcagcatggccgcgccgccgctgctccggcattggacccgcctcgctgtgatcggcgccgtcctcgcgctccacctcgccgccgccgccgcgcagtcgccagcgacccccgccgcgcccacgaccccggcgggccccacaacgccggccgaccagaggaagcgtgcttcgccgacgagacca

SEQ ID NO: 24027 - protein, 58 aa, Panicum virgatum
  misc_feature: Ceres CLONE 1831860
  misc_feature: Useful for making plants with altered carbohydrate content
MAAPPLLRHWTRLAVIGAVLALHLAAAAAQSPATPAAPTTPAGPTTPADQRKRASPTR

SEQ ID NO: 24028 - DNA, 443 bp, Panicum virgatum
  misc_feature: Ceres CLONE 1831862
  misc_feature: Encodes the peptide sequence at SEQ ID NO. 24029
agagaaggaaacgcgctataaaatgcggccccccccctccgcctcccacctctctcgcgttcgaggcgaagcccacgaccagctccgcagcccccgctagccccttcctcgagagtaggtgtaaattagagtaaaacctagtgatgtggcgtcgctgggtttgctgccattgccaagttgatgagtctgataagtgtgaaaatgggcatatcaaggccacaaccaacaatgtcgatgggatgacaaaggggccaaaagattctgctactggaaaagtcgagccacaaaatgctgctccccctatcaatattcctgttctatccttggatgaactgatagaaaaaactgatgactttgggtcaacggctttgataggtgaaggttcttatggaagagtgtactatgctgtccttgataatggaacaaaaatggcagtgaaaaaa

SEQ ID NO: 24029 - protein, 99 aa, Panicum virgatum
  misc_feature: Ceres CLONE 1831862
  misc_feature: SWISSPROT Homolog: EC 2.7.11.1 Non-specific serine/threonine protein kinase
MWRRWVCCHCQVDESDKCENGHIKATTNNVDGMTKGPKDSATGKVEPQNAAPPINIPVLSLDELIEKTDDFGSTALIGEGSYGRVYYAVLDNGTKMAVK

SEQ ID NO: 24030 - DNA, 1959 bp, Panicum virgatum
  misc_feature: Ceres CLONE 1844178
  misc_feature: Encodes the peptide sequence at SEQ ID NO. 24031
gtcccctcctcctcctcccaccttcctctcctcttctcccctcacacctttctcctccgcccccgactcctgccggagctcgagatcccggagcgagcctcccacgggcgcctccgctcccctcgccgcaccaacccgccgtgttatcgccagaaaccccggccagaactactcagccagaccaaccccgatccgcctcgcgcgcggctcccaggccgggccagatctgcgagatccgcgccgacaccgacacgccttccccgaggtgcatgcgcccgtgatctctccggggccgcgggcactgagcggcatctcggcgggcgtgggccgcgtagctggtggccagcggagatgcagcggaatggggtggtggaatgcagcgtctgccgcaaccggctggtggtgccgagcccgcggagcgtgtccagggcctacgacaagcaccgcagcaagatgtcgtccaagttccgcgcgctcaacgtcttcctagttgtcggcgactgcatccttgtcggcctccagcccatcctagtgttcatgtcaaaggttgatgggaagtttcagttcagtcccatcagtgttaactttctgacggaggttatgaaagttatctttgctatcgtgatgctcataattcagtctagaaagcaaaaggttggagaaaagccacttttggcacgttcgaccttcatacaggcagcccgtaataatgtacttctagctgttcctgctcttttatatgctatcaacaattacctaaaatttatcatgcagctgtacttcaatcctgcaactgtgaaaatgctaagtaatttaaaggtgctggtcatagctgtccttctgaaatttataatgaggaggagattctcggtaattcagtgggaagctcttgctttattgcttattggaatcagcatcaatcaacttcggactgtacctgcaggcaataccgcatttggtcttcctgtcactgcaattgcgtacatatatacactggtttttgtaactgttccttcgatggcttctgtctacaatgaatatgccttgaagagccaatatgacactagcatttatctccagaacttgtttctgtatggatatggagcaatattcaacttccttggcattcttgggactgccttgttccaagggccagagagttttaatatccttagaggacattcaagggccacaatgtttctcatatgtaacaatgctgcacaaggcattctatcttcattcttcttcaagtatgcagacacaattttgaagaagtattcgtcaactgttgccacaatatttactggcctagcttctgctgcatttttgggtcataccttgaccattaattttctcctgggcatatcagtggtgtttatttcaatgcaccagttcttctctccacttgctaaagtcaaagatgacaaacctgctgacttattagagttggaagatacacaaaaccatcggtcatctgaatcttcttttgtaaatatgactgctggtgcggctgatgatgcgagccatcggattggcactgatgagaggcaaccactattgcctacatgagcttgttttttgaggtaggatagaagatgctcgtttttaccgtgtgagcagcagaactgttatgtagcattgtgagttgaataaactattgtacactgtaaaggcaaaagagaaagaagcaccaatgtgttccccaatttcttctttcattttttgggacgaggcgggtggccggccaccagtgggtttgtgggagtggcagaccagcataccatacattttgatagacatataattggatagggattctcagatacgatacttgtaaccaaaaattttcctggagctgtatacagaacagtggcaacccgataattctttttgtaagaattcttttttggatgttgatgaaaatgttatccgttgttatctgattctccaatcgtgttc

SEQ ID NO: 24031 - protein, 405 aa, Panicum virgatum
  misc_feature: Ceres CLONE 1844178
  misc_feature (105)..(341): Pfam Name: Nuc_sug_transp Pfam Description: Nucleotide-sugar transporter
MQRNGVVECSVCRNRLVVPSPRSVSRAYDKHRSKMSSKFRALNVFLVVGDCILVGLQPILVFMSKVDGKFQFSPISVNFLTEVMKVIFAIVMLIIQSRKQKVGEKPLLARSTFIQAARNNVLLAVPALLYAINNYLKFIMQLYFNPATVKMLSNLKVLVIAVLLKFIMRRRFSVIQWEALALLLIGISINQLRTVPAGNTAFGLPVTAIAYIYTLVFVTVPSMASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKVKDDKPADLLELEDTQNHRSSESSFVNMTAGAADDASHRIGTDERQPLLPT

SEQ ID NO: 24032 - DNA, 2151 bp, Panicum virgatum
  misc_feature: Ceres CLONE 1844185
  misc_feature: Encodes the peptide sequence at SEQ ID NO. 24033
gattccagtaaacgccaccaccgcctcccgctccttcctgccctcctccctctccgccgccgccgccgccgccgccaatttctcccatgccgcccaagcgcaagcgcggcggaggccgcgggtggccaaggccaaggaaggacgctgccgcgactgccagctccgaccccgccgcggctgccatctccgaccccgcagccgcagccaccaaggaaaatggtgaaaccaaggccgaggagaacatgcctcaacaccaggattctgctacgcaaaccagcaaggaaaacatcaaggaggagataccgccggcttctcctgaggagaatggcacagaggggatagctgaagtctcaaaaactgtgagaaaacgcaggagggatcctgttgcagacccctcttcacttgggcctaggaccttgcgcctaaggaaaaagcaggctgtccccacggtagagaagcccaagaaggtaaaacagatggatggaaattcaaccatgtgccatcaatgccagaggaatgacaatggaagagttgtacggtgccagagttgcattgtagcaaacaggagatacagatactgcgtgaagtgcattacacgctggtatccacatttatcagaggatgattttgagaaaaactgcccagtttgtcgcaacaattgcaattgtaaggcctgtctgcggggagacacaacgagaagcaaaaagagtatggggggagacacaaccagaagcaaaaagagtaagaagagtatggggggagacacaaccagaggcaaaaagagtaagaagtcttctacaatagaggctgatgaatggagtgtatctgaagaagataaaattaaatactctgtgcgtgctgttcactttttgctcccttggctgaaagctcttcaccaagagcagacgctagagagaagtgttgaggcctcaattgaagggatcgatttgtgcaaagtggaggttcctctagttacctgtaaaagcaatgagcggatatactgcaacaactgcaggacatctattgttgatttccacagaagctgtaacacatgcttatatgatctctgcctcagctgctgccgagagcttcgtcagggtcatcctcgaggtggaggtgtgactgtggacgaggttactagtctacctgatgttggaggcagggagaatttgcaacagagaattagtcatgataattgtacaagtcaagagccctctgatggacacaacaatgttttgatagatagtgtacttccttctgaggatcggactcctagtttgagacgatggagggcaaatagcaatggaagcataccttgcccaccgaaagaacttggtggttgtgggcattctcttcttgaacttaagtgcttgtctgaggagaagtttattccaaacttactagaaaaagccaattcagtgatcaacaatggagtcgtgttggaactgggagatacaaaatgttcctgcttcactgagtccagtgaaatgaatgatgagacatcacgcaaagcagcttctagagaaaactccaatgataactacatatattgtccgactgctaaagatgttcaaaatggacctttggaccattttcaggaccactggttgaagggtcagcctgttatcgtccgtgatacgcttgcgttgacttctggattgagctgggaaccaatggttatgtggcgggccttacgagaaaagagggatagtcaagatcggctctcagttattgctcttgaatgtatgacgtggtgtgaggttgatatcaatattcatatgttttttgacgggtattcccgtggagctgttggtttagaggatttgcctgtgttacttaagctgaaagattggccacaacatagttcctttgagcagagactgccacggcataatgctgagttcatgtctgccttgccatttcgtgaatatacagaccctaaatctgggcctctcaatctggcggtgaagctgccaaaagatgttataaagccagaccttggtccaaagacttatattgcttatggcgtcagccaagagttgggaattggtgattctgttaccaagattcattgcgacatgtctgatgccgtcaatatcctcacacatactgatgaaatacagctcaaagcccaaaggattacagcaatag

SEQ ID NO: 24033 - protein, 688 aa, Panicum virgatum
  misc_feature: Ceres CLONE 1844185
  misc_feature: The sequence is a functional homolog of SEQ ID NO 959 in the 10/666,642 US patent application
  misc_feature: The sequence is a functional homolog of SEQ ID NO 956 in the 10/666,642 US patent application
MPPKRKRGGGRGWPRPRKDAAATASSDPAAAAISDPAAAATKENGETKAEENMPQHQDSATQTSKENIKEEIPPASPEENGTEGIAEVSKTVRKRRRDPVADPSSLGPRTLRLRKKQAVPTVEKPKKVKQMDGNSTMCHQCQRNDNGRVVRCQSCIVANRRYRYCVKCITRWYPHLSEDDFEKNCPVCRNNCNCKACLRGDTTRSKKSMGGDTTRSKKSKKSMGGDTTRGKKSKKSSTIEADEWSVSEEDKIKYSVRAVHFLLPWLKALHQEQTLERSVEASIEGIDLCKVEVPLVTCKSNERIYCNNCRTSIVDFHRSCNTCLYDLCLSCCRELRQGHPRGGGVTVDEVTSLPDVGGRENLQQRISHDNCTSQEPSDGHNNVLIDSVLPSEDRTPSLRRWRANSNGSIPCPPKELGGCGHSLLELKCLSEEKFIPNLLEKANSVINNGVVLELGDTKCSCFTESSEMNDETSRKAASRENSNDNYIYCPTAKDVQNGPLDHFQDHWLKGQPVIVRDTLALTSGLSWEPMVMWRALREKRDSQDRLSVIALECMTWCEVDINIHMFFDGYSRGAVGLEDLPVLLKLKDWPQHSSFEQRLPRHNAEFMSALPFREYTDPKSGPLNLAVKLPKDVIKPDLGPKTYIAYGVSQELGIGDSVTKIHCDMSDAVNILTHTDEIQLKAQRITAI

SEQ ID NO: 24034 - DNA, 687 bp, Panicum virgatum
  misc_feature: Ceres CLONE 1844198
  misc_feature: Encodes the peptide sequence at SEQ ID NO. 24035
acaaacaacaagcagaaaccactctagcttgcactacgactgccactgaaccacgatcacctcccactaccaagcaccagctagtcctcgcctatttcaccctgagaaatcagaaatggcatcgcctcgtggtagcactcgcgttcggcacggcacgagccacgtcgcgctcgtgctgatcgccgtgctgcttctgacctcggcacgtctcaccctgggcgccagcaggaggcttctggagctgtacaagccgccggccagcgcgctgctcacctaccacaacggcgccgtgctgcagggccgcatcccggtgtccatcctctggtacggcccagcggcgacgtcggcgtggacggcatggtgatcaacatcgccagcatggtcgcgggcacggtgaccaacccgttccgggacgggttctaccagggcgacaaggacgcgccgctggaggctgccaccgcctgcactggggtctacggcagcggcgcgtaccccggtttcgccggcaacctggcggtggatcgcgcgacgggggcgagttacaacgccaatggcgcgcgtgggaggaagtacctgcttcccgcgctgttcgaccctgaaacgtccacgtgttcaactttggtgtaacggctatggaaacaatcctgacagaaatgtgtagtaacactgtatatatatgagtgactg

SEQ ID NO: 24035 - protein, 89 aa, Panicum virgatum
  misc_feature: Ceres CLONE 1844198
  misc_feature (1)..(89): Pfam Name: Phi_1 Pfam Description: Phosphate-induced protein 1 conserved region
MVINIASMVAGTVTNPFRDGFYQGDKDAPLEAATACTGVYGSGAYPGFAGNLAVDRATGASYNANGARGRKYLLPALFDPETSTCSTLV

SEQ ID NO: 24036 - DNA, 1041 bp, Panicum virgatum
  misc_feature: Ceres CLONE 1844243
  misc_feature: Encodes the peptide sequence at SEQ ID NO. 24037
accctaagcatcgtcatcagtgccctcctccctactcgctgggaaaaccctcgcctcgccgctcccccacccccccacgccgctcgcgcgcggcgaagccccgcccgccatggcgagcgacggcgacgacgacgaggagtacggctacttctacgacgacgacgacgcggaggaggacgccgccgccggcctggagcaggccgccgcgccgccgccggagcgccgcgcggactactgggccattacacaggagtcccttcccactgcacagaaacaagatctttctacagtcatgaactttctcaacataaaacaacatcaagcacgagctctcctcatccaccaccggtggaagatggatggcatctatgatcacttagataagggtcgagagcgcatgctcagagatgcaggtattgtgctgcaggagaataatattatggcagcatctggctcaacaaagccatggagaattatgcactgcaatgtgtgttttgacgacatccccatgggtgtagtcttgaccatggactgtgggcattgcttctgcaatgattgttggacgcagcatttctatgccgctgtagaaagcggtaagaatcatattaggtgcctggaggtgaagtgcccacccttctgtgatgatgatcatgtacagtatctccttggccggaaataccccgaaatggccactctcttcaatcgattcctgctcgagtcctaccttgaggacaactactctgtcaagtggtgccccagcacaccaaactgtggacgtgcaatccgtgtgggcactggtgagcggtactgtgaagtggagtgcccctgcagcttaagcttctgctttatctgcatggcacatgcacattcaccgtgcccgtgcaccatgtggcagaaatggaactccgagtgtacggacggagagaacatccagcgtatccttgctcactccaagagctgtcccaaatgctttaagcgccatcgagaagaatggcggctgcaaccttgtccactgcacctgccgcctagtgtatgtgttga

SEQ ID NO: 24037 - protein, 310 aa, Panicum virgatum
  misc_feature: Ceres CLONE 1844243
  misc_feature (195)..(258): Pfam Name: IBR Pfam Description: IBR domain
MASDGDDDEEYGYFYDDDDAEEDAAAGLEQAAAPPPERRADYWAITQESLPTAQKQDLSTVMNFLNIKQHQARALLIHHRWKMDGIYDHLDKGRERMLRDAGIVLQENNIMAASGSTKPWRIMHCNVCFDDIPMGVVLTMDCGHCFCNDCWTQHFYAAVESGKNHIRCLEVKCPPFCDDDHVQYLLGRKYPEMATLFNRFLLESYLEDNYSVKWCPSTPNCGRAIRVGTGERYCEVECPCSLSFCFICMAHAHSPCPCTMWQKWNSECTDGENIQRILAHSKSCPKCFKRHREEWRLQPCPLHLPPSVCV

SEQ ID NO: 24038 - DNA, 2406 bp, Panicum virgatum
  misc_feature: Ceres CLONE 1844248
  misc_feature: Encodes the peptide sequence at SEQ ID NO. 24039
gtctctctctgcctctgccttctttcctagcggcgacgacaggggggagtggcgccgcccttgccaattcttcgtcaggcgcttcgccggccgaccaggcgtggcagctatggaacaccctataatccagcaagtcatggagcatcccgaagagcatgatgatgatgagctctcacctgccttgacaaatgggaaggttcagaccgcagaatacaacagcaagcttctcaggtctagtagctctggtaacaattcacctatagtccggcccattcaagtggtgccggcacatcaacctctcccatcaccagactttccaagcttgaagaaacagagggcctcatttatgaccacaactagtgacataggcacaaggaaggttgacccagaaatagcttatgaagatctagccagaatgatagctttgcatggttatcctttatcaattgtagagcatgaagaaatgagaagatttgtaaaggacctcaaccctatggttaatgcagtatctcataatgatatggaagggcattgctgtgctctatttctgaaggaaaaggcaatcctgaaacataaactggctctttcctcccagcgtgtctctctttcagcaagtatctggactcctgatggagctgagccagaagtaaattacctttgtctgacagcacattttattgataaagattggaaagttcacagaatgataatcaaatttggcatgtttcggtcctcacctaccaatgtggaaaggatgatacattgtaaggaggcttgtgtcccagagtctgaaagtggagcatacaacgtcatatgggatgctgttagagattggaatctttatcagaagcttttgagcttgacttctgtttgtgaggttagggatgatgcaagtacctcaaagctaaaggaaacacttgtagagaagaagtaccttcctatcagaggcaagctatacaatattgtttgtgtggatgatatcattaatagtattgtttccgaagtgcaacaaaatatcattcaccttattggtgacatggtaacggaattttttggggcacgtacatcttcatcattgaatcaacagcagctattggaagtcatttcgcagatgagtttgaagtgtccaaaggaagatgccaagtggtggcacaaattttatttcaggcttgaagttcttttgcattacaagaaattattcccttttgaagaagtgatgtctccagaagatatcagtgttgctgagtctatttgcaagattttgaggacattttatcgtgttattgaagttatttctagtcctagttctccaacggcaaatatgtacttcaatgagatatggaaagtgcgaacagttttgcaagaggaagcatcaaatgagcatggagaacttgctacaatggtttcagagatgcaggaaatgttcaatcaatattggcaaaattcatacttgtggttatgtatacctgttattctagatcctagattcaaaatcagtttcattgagttccgtctgaaacgagcttttggattaaaatcagcaagctacttatctgacatacatgaaacactcaaggaactcttccatgaatactgtggttatgtggatcatccgaatggaggtgctacaaaagctgaagccttcgatgcagatgataatgactcattcgaggattgggatcagcatctcaatgagcaagcaagtagccagaaatcgacggaacttgacaactatcttgaggatgggttagttccaaggaaggatgatttcgatattctgaactggtggatgtgccatgccatgaagtatccaacgcttgctgctattgcgcaggatatcctggcgatgccagcatctgctgttcaatctgaagcagcattcaccagaaatggtccagtgattcccaagcaccacagtacgttaagcatcaagacgatcgaggcacttgtttgtactcgagattggatgagataaatcaggtgtgcgccgtgctgcagtcagtgactgtgaagtggagacaaccaggatgcggtgcagttatgttgagggggagatccaaactgaacatgtctcggtggcgccttcaaccaaaggtaaccctgccactgccagggttggtgatgttgctgacagatggggagaaaaagatgcaagagtgataaatagagagggggagaaggtggggaaaaaggaaaaaaaaaaaggttagccactgacagatgggcctatatgtcaggagagattggaagggcactgcaaagctcttccctaataacctgaaattgtgaaagggggattcccctataaccagaagaaaagggagaggggaaagaggatctgttggagttgctcttagttttgacgtagatgtatatatagatcagccatttgcttgatgtagcttc

SEQ ID NO: 24039 - protein, 612 aa, Panicum virgatum
  misc_feature: Ceres CLONE 1844248
  misc_feature (529)..(611): Pfam Name: hATC Pfam Description: hAT family dimerisation domain
MEHPEEHDDDELSPALTNGKVQTAEYNSKLLRSSSSGNNSPIVRPIQVVPAHQPLPSPDFPSLKKQRASFMTTTSDIGTRKVDPEIAYEDLARMIALHGYPLSIVEHEEMRRFVKDLNPMVNAVSHNDMEGHCCALFLKEKAILKHKLALSSQRVSLSASIWTPDGAEPEVNYLCLTAHFIDKDWKVHRMIIKFGMFRSSPTNVERMIHCKEACVPESESGAYNVIWDAVRDWNLYQKLLSLTSVCEVRDDASTSKLKETLVEKKYLPIRGKLYNIVCVDDIINSIVSEVQQNIIHLIGDMVTEFFGARTSSSLNQQQLLEVISQMSLKCPKEDAKWWHKFYFRLEVLLHYKKLFPFEEVMSPEDISVAESICKILRTFYRVIEVISSPSSPTANMYFNEIWKVRTVLQEEASNEHGELATMVSEMQEMFNQYWQNSYLWLCIPVILDPRFKISFIEFRLKRAFGLKSASYLSDIHETLKELFHEYCGYVDHPNGGATKAEAFDADDNDSFEDWDQHLNEQASSQKSTELDNYLEDGLVPRKDDFDILNWWMCHAMKYPTLAAIAQDILAMPASAVQSEAAFTRNGPVIPKHHSTLSIKTIEALVCTRDWMR

SEQ ID NO: 24040 - DNA, 1147 bp, Panicum virgatum
  misc_feature: Ceres CLONE 1844252
  misc_feature: Encodes the peptide sequence at SEQ ID NO. 24041
gcacgtctcccgcctgccgcagccaatcaagctagccctctccatcctctcgtcgctcggcatgacttgctcacgatcgagctagctcgatcatctgatggtgagcgggtggacgaagaagaagatgacgacgatgtcgctccataaatggagggcggcggttctggcggtcgccttcgtcgtcgccggctgcgcggcggcggaggctggtggtccgcggcggatcctggtggacacggacacggacaccgacgacctgctggcgctgctctacatcctcaagcagaaccgctccgagttcgacctcaaggcagtaaccatcaatgcgaatgcgtggagcgatgctggacatgctgtgaatcatatgtatgatatgctctatatgatgggccgtgatgacattccggttggagtcggtggtgatggtggaatatcaaattctgacaccatacatccaaatgtcggtggttatttaccattgattgatcagggcatgtcaagaataggaggctgccggtacaggcaagctattccactagaaggtggtggacggttggatgtaaacacaaactttggaatcagaaggggtttccttccacagggtcacagaagatacacaccacttcaccaacctacagcacaacaagtaatgataggcacaatatctgctggccctacagctgttattctcataggagcacatacgaactttgccatttttctcatgacacatccacacctgaaaagaaatgtggagcacatatacattatgggtggtggagtgagatcgaagaatcctacaggttgctgtccaaaaaatgctaccacatcatgtatgccagagcagtgtggtgaccatggtaacttgtttactagttactctactaatccaaatgcagaattcaacatattcggagatccttttgccgcataccaggtgtttcattctggcattccaatcacactggttcctcttgatgcgaccaatacaattccaatcaatgaagaattcttcaatgaattccaacgtcaccaaagtacctatgaggcacaatactgtttcaaatctttaaagatggctcaagacacttggttcaatgatcaattctacacaagctattttatgtgggactcctttacttctggt

SEQ ID NO: 24041 - protein, 349 aa, Panicum virgatum
  misc_feature: Ceres CLONE 1844252
  misc_feature (40)..(345): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MVSGWTKKKMTTMSLHKWRAAVLAVAFVVAGCAAAEAGGPRRILVDTDTDTDDLLALLYILKQNRSEFDLKAVTINANAWSDAGHAVNHMYDMLYMMGRDDIPVGVGGDGGISNSDTIHPNVGGYLPLIDQGMSRIGGCRYRQAIPLEGGGRLDVNTNFGIRRGFLPQGHRRYTPLHQPTAQQVMIGTISAGPTAVILIGAHTNFAIFLMTHPHLKRNVEHIYIMGGGVRSKNPTGCCPKNATTSCMPEQCGDHGNLFTSYSTNPNAEFNIFGDPFAAYQVFHSGIPITLVPLDATNTIPINEEFFNEFQRHQSTYEAQYCFKSLKMAQDTWFNDQFYTSYFMWDSFTS

SEQ ID NO: 24042 - DNA, 336 bp, Panicum virgatum
  misc_feature: Ceres CLONE 1844252-R
acccgacccaacgaacagggggcccgccagcacaccagggaggaaggggcagagcagggcggccacgccgcggagaaggagagaggaaggaggagccggaggaaggcccgagggaggagacagacggcccaccagcgcgccgggcacccagggccagcaaaccgcgggggaagaagggcagggcagacagccgcggggagcaggccaccacggaaggaacgaaaccgcacagccggcgcccacaagcgaaagcgaagcacggacacacaggagggaggccagggggcggcaaaacgcgcaggggaccccagccagcccggaaaggccagacaacga

SEQ ID NO: 24043 - DNA, 1308 bp, Panicum virgatum
  misc_feature: Ceres CLONE 1844268
  misc_feature: Encodes the peptide sequence at SEQ ID NO. 24044
agtcttgacggtacacgctagcaggtagcaagactgtaagcaagagacaattccccagaagccgcccaaacgcttcctgcaatcctgctgctttggcgttgaactcccttgattactcgcatcagctgccaaagatctctctttattgttttttttttggttcagaaggggagcagaggcgaaattaattcctccggcgagattcgtgtggagatgagttcggtgccaggaccactcataaattctgcctgttctttcagatctgctccgtgatgtgctgtgctttcagttcaggacagcgcgctccctccctctcggcttcttccagttccaggcttggggctcctcggttccaatctctctagcgcctagtcactcatgcgtcgtcgccggagtccaatctcgcagccgcccagagtttcttgatttggtttgttcggaatttccactttcccgggagaaaatctgttccttccaaaagttgaatcttttggaagcgttggaagcagacatcagtcgccgctttgttcttgaatcccctacccggtagcagcgttggaagcagaaatcagttgctgctttaaaatcctcccttttctcttagtttctgagcagcgcagcttcccatactcgttccgattctcgatttcgtcgtgatttcaggtcggctcttgctcgcctttgccgatttgtaagctcccgagagccaggctataagaatccccactacacctttccctcttccactccacgcgctgctgctttctcgtggtggtttcttctcccaatgggcaacgcgttcgcgtgcatgccgcgcaaggagcaccggggcgcggccgcggtgtcgcgcagcaagcggatggggagcgcgcggtcggcgcgcggcgggcccaagctgacgccggcggaggaggagctcctgcaccgccaggcgctggccatggccatccaccagcacctcgactccggcggctccatgtcgcgccgcatcgacgccggggcctccctgtcccgccgcatggcccccggctccaccagctctcgacgccgcggcgacctgccggactccgtcacgaatgccaagcccgcccaaatcgttctggagaatttagaaacaaagaaaattgtccttgttcatggagaaggatttggtgcttggtgttggtacaagaccatctcgcacttggaggaagctggtcttgagcctgttgccttagacctcacaggttctggcatagatcataccgatacaaacagcataactacactagcagaatactccaagccatttattggattaccttgata

SEQ ID NO: 24044 - protein, 172 aa, Panicum virgatum
  misc_feature: Ceres CLONE 1844268
  misc_feature: SWISSPROT Homolog: EC 3.1.1.78 Polyneuridine-aldehyde esterase
  misc_feature: Useful for making plants with modulated salt sensitivity
MGNAFACMPRKEHRGAAAVSRSKRMGSARSARGGPKLTPAEEELLHRQALAMAIHQHLDSGGSMSRRIDAGASLSRRMAPGSTSSRRRGDLPDSVTNAKPAQIVLENLETKKIVLVHGEGFGAWCWYKTISHLEEAGLEPVALDLTGSGIDHTDTNSITTLAEYSKPFIGLP

SEQ ID NO: 24045 - DNA, 2416 bp, Panicum virgatum
  misc_feature: Ceres CLONE 1844294
  misc_feature: Encodes the peptide sequence at SEQ ID NO. 24046
acagtcaaccacgcgctcctcacatcgcttcgccgccatgtccaccttataacaaacggaggcggggtggtcaccagaccaagaagctaggaaaagtaacctgttcggccatggatctcttgctagctcgccgccggctgccgcttctcctcctcgccgtcttggtcgccgcctcccatggcgtcccttccagcggggacggcgacggcggccgctacgacccctccatgtgcttgcggcagaattacacttgcggcggcttcagcatcagctacccgttctacatcaggacgggggatctgctggggaacaccagctcgtactgcggctaccccggcctggagatccagtgcgaggaagaccaggcgtttctggagctcgagagcggcaagtacaccgtcacgcacatcgactacgactacgacaacgacaacctcacagtccagctcgtcgatcccgaggtcctcgactggaggaacggctgccccagaaccgaccacaacgtgacgctccggagcttcgaatggctcttctatcctaacaccacggtcgacctcctcttcttcttcaactgcaacttcctctccgacttgccgtctcagccgtcagaatcgaacgccaccacctgcagattcgatgtcgggcagccgtcgatcgggctgtccttcgtgttcttggagcaagacgtgccgttccggaacacgaattggtggcagaagtgcggattagtaatcgaagtgcccttgctcaaatctgttctccctcctgatccactaaatgattctgcatggaagaacggtgggtatggcaggagccttagtgaaggattccagttggcattgaatcagagtgggaagacccaggcgtgtgcgcagtgcgagaaatcgaaggggcggtgcggctacaaccagaccgggggattcatggcctgcttgtgctccggcggccatgtcagcgctgctaacaattgcaccgccgattcttccggaaggtcaaataggaaacacggagtgattattggcgtctcggctgctgctggtctcgccgtgcttgctgctgccgcaattttgttcatcgtgcgcaagaggaagaagaagaacgtgatcaactcgtcctcgaagctcctcaagtacagcggctctggcgggaccccgcattcccgggtcggcgacatggagtccggcagcatcgaggacccgccgacgcacctcttcacctacgaggagctcgaggaggccaccagttccttcgatgagcaccgagagctcggtgatggcggcttcggcaccgtctacaaagggtacctcaaggacgggcgcgtggtggcggtgaagcggctgtacaacaacagctaccggcgcgtggagcagttccagaacgaggcggtcatcctgtccgggctgcgccacccgaacctggtcatgttctacggctgcacgcccagcacgagccgcgagctcctcctggtgtacgagttcgtggccaacggcacggtcgccgaccacctgcacgggcaccgcgccccggagcgcgcgctctcgtggccgctccgcctcagcgtcgccatcgaggccgccgcggcgctcaactacctccacgccatcgagccccccgtcgtgcaccgcgacgtcaagaccaccaacatcctcctcgacgccgacttccacgtcaaggtcgccgacttcggcctctcccgcctcttccccctcgacgtcacgcacgtctccaccgcgccccagggcacgccagggtacgtggatccagagtaccaccagtgctaccagctgacggacaagagcgacgtgtacagcttcggggtggtgctggtggagctcatctcgtccaagcccgccgtggacatcacccggcaccgcaacgagatcaacctggccggcatggccatcagcaagatccagaactgccacctcgagcagctggtggacctcgacctgggctacgaggccgacccagcgacgaagaagatgatgaccatggtcgccgagctggccttccgctgcctgcagcagaacggcgagatgcgcccgccgatgaaggaggtgctcgaggtgctcaggagcatccagggcgagtgccgggcggcggagaaggacggggacaagcccaaggacggggccttctcccccaccacggttcacgctccgtgggacagccgggccacgacgcccaacaccagcagggattagattagtgctcgagatttatctgtgtttgttgccgctgctgcatagagatgcgcttgatgtgtggcatgccagattacctgtccctttggctttcagggctcgtagttcctggtgttgtagatatttgttttgttggcaccgtcagaacagagggaatgtacatatataaaagagtggtgaatggcacttataaagtactggacatatatcat

SEQ ID NO: 24046 - protein, 697 aa, Panicum virgatum
  misc_feature: Ceres CLONE 1844294
  misc_feature (380)..(654): Pfam Name: Pkinase Pfam Description: Protein kinase domain
  misc_feature: SWISSPROT Homolog: EC 2.7.11.1 Non-specific serine/threonine protein kinase
MDLLLARRRLPLLLLAVLVAASHGVPSSGDGDGGRYDPSMCLRQNYTCGGFSISYPFYIRTGDLLGNTSSYCGYPGLEIQCEEDQAFLELESGKYTVTHIDYDYDNDNLTVQLVDPEVLDWRNGCPRTDHNVTLRSFEWLFYPNTTVDLLFFFNCNFLSDLPSQPSESNATTCRFDVGQPSIGLSFVFLEQDVPFRNTNWWQKCGLVIEVPLLKSVLPPDPLNDSAWKNGGYGRSLSEGFQLALNQSGKTQACAQCEKSKGRCGYNQTGGFMACLCSGGHVSAANNCTADSSGRSNRKHGVIIGVSAAAGLAVLAAAAILFIVRKRKKKNVINSSSKLLKYSGSGGTPHSRVGDMESGSIEDPPTHLFTYEELEEATSSFDEHRELGDGGFGTVYKGYLKDGRVVAVKRLYNNSYRRVEQFQNEAVILSGLRHPNLVMFYGCTPSTSRELLLVYEFVANGTVADHLHGHRAPERALSWPLRLSVAIEAAAALNYLHAIEPPVVHRDVKTTNILLDADFHVKVADFGLSRLFPLDVTHVSTAPQGTPGYVDPEYHQCYQLTDKSDVYSFGVVLVELISSKPAVDITRHRNEINLAGMAISKIQNCHLEQLVDLDLGYEADPATKKMMTMVAELAFRCLQQNGEMRPPMKEVLEVLRSIQGECRAAEKDGDKPKDGAFSPTTVHAPWDSRATTPNTSRD

SEQ ID NO: 24047 - DNA, 636 bp, Panicum virgatum
  misc_feature: Ceres CLONE 1844299
  misc_feature: Encodes the peptide sequence at SEQ ID NO. 24048
tgatggcagggtttcagtgagcgggccgggggacgacgacggagacctgtatagatcgaggagctaacagcagtagcaggctcgtctcggagatgaagcggctgctgatcgccggccgggtcggggtggcgcccctctacgccacctgccacgatatcatgccagtcctgctgccgatgttccacagatgggtcgctcactatgggaaaacatttctgttctggatcggtcccattcccgccttcttctccactgatcttcatctggttaagcaagtgctcgcggacaggacgggcctgtaccagaaggacttcctgatccccgtgctcaacttcctcttcggcaacggggtcgtgttcatcaatggagacgactggaaacgccaccggaaggtggttcttccggcgttcacccatgacaagatcaagagcatgtcggcggtgacggcggaggtcacgaagcagatgatgcagcaatggcgcgagcaggcccaccagagcggcggcaagggcgcggccgagatagacatgatcgtcgccttcaacgacctgacctccaggatcaacggccgcgtcgccttcggcacgagccaccaggacgtcgaggaggtcgtcgccttcatgcgggagatgcaaa

SEQ ID NO: 24048 - protein, 181 aa, Panicum virgatum
  misc_feature: Ceres CLONE 1844299
  misc_feature: SWISSPROT Homolog: EC 1.3.3.9 Secologanin synthase
MKRLLIAGRVGVAPLYATCHDIMPVLLPMFHRWVAHYGKTFLFWIGPIPAFFSTDLHLVKQVLADRTGLYQKDFLIPVLNFLFGNGVVFINGDDWKRHRKVVLPAFTHDKIKSMSAVTAEVTKQMMQQWREQAHQSGGKGAAEIDMIVAFNDLTSRINGRVAFGTSHQDVEEVVAFMREMQ

SEQ ID NO: 24049 - DNA, 1844 bp, Panicum virgatum
  misc_feature: Ceres CLONE 1844303
  misc_feature: Encodes the peptide sequence at SEQ ID NO. 24050
acgggccaggaaaccactgctcgatcctactctcctgctagctagtcgtccgcccttggccttgggactttgggatcgtgggggaggtatggaggggtcgttgctgagcgggctcaactccggcgtggtgctgagcctgatcgccgtgctgtggacggtggtgtggcagaacctgcagcacctccagctgcagcagttcttcgggcgccacctgagccgccacgcgcggcggctggcggcgatggtggacccctacctgtcggtcaccatcgccgagtacgagggcggccggatgaagcgcagcgacgcgtacgaggaggtcaaggcgtacctcagcgatgcctgctcccgcggcgtgcgccacctgcgggccgagggcgccaaggacgccgacaagctcgtgctcagcatggtcgacggcgaggaggtggccgaccagttcgagggcgccaccgtatggtggtgggccaactccaagtcgccgccgcgcaacgacgccgccgccgcgtggtggggcggcggcgccgcgcaggaggagcgccgcttctacaggctcttcttcctcgagcgccaccgcgagctcgtgctcgacacctacctcccgcgcgtccggcagcagggccgcgccgtcatggtcaagaaccgccagcggaagctcttcaccaacatctccacgcaagggtggagcgacggcgggttcatgaggtcggcgtggagccacgtggtgttcgagcaccccaagacgttcgacacgctcgccatggacccggccaagaagaaggagatcaaggacgacctcgacatgttcaagaacggcaaggactactacgcgcgcgtcggcaaggcgtggaagcgcgggtacctcctgtacggcccgccggggacgggcaagtcggccatgatcgccgccatggccaactacctcgactacgacatctacgacatcgagctcacgtcggtacactccaacaccgacctccgcaagctcttcatcgagacgacgagcaagtccatcatcgtcatcgaggacatcgactgctcgctcgacctcaccggcgcgcgcaagaagaagaaagccgcggcggaggacgacaaggacaagaaggacgccgcggcggccgccaaggctgccgccggcgccgacaagaaggacaccagcagcaaggtgacgctgtcgggcctgctcaacttcatcgacgggctgtggtcggcgtgcggcggcgagcggatcatcgtgttcaccaccaaccacgtgcagaagctggacccggcgctcatccggaggggccgcatggacaagcacatcgagatgtcctactgcggcttcgaggccttcaagttcctggccaagacgtacctcgacgtcgacgcgcacgcgctgttcggcgccgtcggcgacctgctgcgggaggtggagatgacgccggctgacgtcgccgagaatctgacgcccaagagcctggaggacaacccggacacctgcctcgcggccttggtcaaggcattggaggaggccaaggagaagaaggccagtggaggaaatgaccctgacgaacaagaagatgaggaggagcagcagtagtttcagctgacggttaccaatctagcaatctgtcgtccgtagttgtgatgatttctcgtggttcttcaatcttcagggttctagtagccactgatcatatcatatagcccgtagtaggaataaaataggggtttgctttagagaacaaacactcgccttcagttacgagaactcctgtagacagtggtagactcgatcgaactttttcctttttctattctactatttatcctatccggtacaatagtatgctttcatgact

SEQ ID NO: 24050 - protein, 497 aa, Panicum virgatum
  misc_feature: Ceres CLONE 1844303
  misc_feature (257)..(463): Pfam Name: AAA Pfam Description: ATPase family associated with various cellular activities (AAA)
MEGSLLSGLNSGVVLSLIAVLWTVVWQNLQHLQLQQFFGRHLSRHARRLAAMVDPYLSVTIAEYEGGRMKRSDAYEEVKAYLSDACSRGVRHLRAEGAKDADKLVLSMVDGEEVADQFEGATVWWWANSKSPPRNDAAAAWWGGGAAQEERRFYRLFFLERHRELVLDTYLPRVRQQGRAVMVKNRQRKLFTNISTQGWSDGGFMRSAWSHVVFEHPKTFDTLAMDPAKKKEIKDDLDMFKNGKDYYARVGKAWKRGYLLYGPPGTGKSAMIAAMANYLDYDIYDIELTSVHSNTDLRKLFIETTSKSIIVIEDIDCSLDLTGARKKKKAAAEDDKDKKDAAAAAKAAAGADKKDTSSKVTLSGLLNFIDGLWSACGGERIIVFTTNHVQKLDPALIRRGRMDKHIEMSYCGFEAFKFLAKTYLDVDAHALFGAVGDLLREVEMTPADVAENLTPKSLEDNPDTCLAALVKALEEAKEKKASGGNDPDEQEDEEEQQ

SEQ ID NO: 24051 - DNA, 2064 bp, Panicum virgatum
  misc_feature: Ceres CLONE 1844319
  misc_feature: Encodes the peptide sequence at SEQ ID NO. 24052
tgccctccctccccataatccttgcctcgctccttccaccaccgccgaccgccatggccgccgccgaggtggaccccgcccccaaccctacctctgacctccccaacggatcggccgctcagaaccggaagaagtcccgcgagagcgaccgccgccgccgacgtcgtaagcagaagaagaacaaggcggcttctaacgccgcagatgcgggcggggatgcggagcccgatgaagaggcggcgcccgacggcgccaaggagaacgccgatcagaaaccccaggttgaggtggaggtggagtacgtgccagagaaggcagagcttgacgacgccctcctcgccgactttaaggacatctttgacaaattcacctttaaggattcccccgccgacaccgaggatggtgagaagaagaatgaggctggcactgatgcagcgaaggagggggatggatccgactcggacgaagatgctcaggacgcccagcagaagaaggaagggggtgtctccaataagcagaagaaattgcaacggaggatgaaaattgcagagttgaaacagatatgtgccaggccagatgtggttgaggtatgggatgcgactgcatcagatcccaagttacttgtctatatgaagtcctacaggaacacagtacccgttccaaggcactggtgtcaaaagaggaagttcttgcaggggaagagaggtattgagaaacaacctttccaactccctgacttcattgcagctactggaatagaaaaaataagacaggcatatattgagaaggaggacagcaaaaagctaaagcagaaacagcgagagcgtatgcagcccaagatgggaaagatggatattgattatcaggttttacatgacgctttcttcaaatatcaaacaaagccaaaattgactagtcatggtgacctgtattatgaaggaaaggagtttgaggtcaaacttagggaaatgaagcccggtgttctatctcgagaacttaaagaagctcttggtatgcctgatggtgcgccgcctccatggcttataaacatgcagagatatggccccccaccctcctatcctcaactgaagattcctggtctcaatgctccaattcctcctggtgcaagttttggatatcgacccggagaatggggaaaacctcctgttgacgaacatgggcgccccttatacggagatgtttttggagtcctacagcaggatgaacctaactatgatgaggagcctgttgatcgtagcaagcactggggagacttagaggaggaagaggaggaggaagaagaggaggaagaggaagaggaagagccaatggaagacgaagacatggatgagggcatgcaatctgttgacaccatttcaagcactcccactggtgtggaaacacctgatgttatcgatcttcggaagctacagaggaaagagcctgaaagacaaacagagaagcagctataccaggttcttgagcagaaagaggaaagaatcgcccctgggacactctacggatcaagccacacgtatgtgctcggggcacaagacaaagctgctcccaaaagggttgatcttctaaaaaaccagaagtctgataaggtgaatgtcaccatacaacctgaggaattggaggttatggacgatgtgttggcggccaagtacgaagaagcacgagaggaggagaagctgcggaatcagaaggaagacttcagcgacatggtggctgagaacgcaagcaagaggaagaggaagcagcaggagaaggatgggaaatcgaaaaagaaggaattcaagttctaggaggattactatttccatttccaagagtttgagccaagtcattgctagacgagacaagacgaggggatgcttgtttgcctgtctgcctttaaaaagagaatgcaaaggaaataagtttaccgtgtacgcattagatgtttttttttttatatgtaagcttgtttcgcgagatggtttcgagttgatgactatgttgtatattgtatacctgcctactgaagagaggatggatgatactagctagtagtttgtttcc

SEQ ID NO: 24052 - protein, 584 aa, Panicum virgatum
  misc_feature: Ceres CLONE 1844319
  misc_feature (307)..(354): Pfam Name: PSP Pfam Description: PSP
MAAAEVDPAPNPTSDLPNGSAAQNRKKSRESDRRRRRRKQKKNKAASNAADAGGDAEPDEEAAPDGAKENADQKPQVEVEVEYVPEKAELDDALLADFKDIFDKFTFKDSPADTEDGEKKNEAGTDAAKEGDGSDSDEDAQDAQQKKEGGVSNKQKKLQRRMKIAELKQICARPDVVEVWDATASDPKLLVYMKSYRNTVPVPRHWCQKRKFLQGKRGIEKQPFQLPDFIAATGIEKIRQAYIEKEDSKKLKQKQRERMQPKMGKMDIDYQVLHDAFFKYQTKPKLTSHGDLYYEGKEFEVKLREMKPGVLSRELKEALGMPDGAPPPWLINMQRYGPPPSYPQLKIPGLNAPIPPGASFGYRPGEWGKPPVDEHGRPLYGDVFGVLQQDEPNYDEEPVDRSKHWGDLEEEEEEEEEEEEEEEEPMEDEDMDEGMQSVDTISSTPTGVETPDVIDLRKLQRKEPERQTEKQLYQVLEQKEERIAPGTLYGSSHTYVLGAQDKAAPKRVDLLKNQKSDKVNVTIQPEELEVMDDVLAAKYEEAREEEKLRNQKEDFSDMVAENASKRKRKQQEKDGKSKKKEFKF

SEQ ID NO: 24053 - DNA, 1061 bp, Panicum virgatum
  misc_feature: Ceres CLONE 1844327
  misc_feature: Encodes the peptide sequence at SEQ ID NO. 24054
gtcatcgatcaccattccaggagcataaagcaagcatctagtaggagaaggagaggaggagcaaagcatcaagcaagcattccatggggtcccgctacgaggtggaggtcaccgtgggttctgccaccaacctcaagaacgtcaactggcgcaacggcgacctccatccctacgccgtgctctggatcgacgacggccccaagtgctccacccgcgtcgacctcgacaacggtgaggaccccgtctgggacgacaagctcctcgtccccgtccctccgtccgtgacccgcctcgaggacgccgtcctctgcatcgacgtcgtccacgccgacgccgccgagggcgtcaagcctctcgtcggctccgcgcgcctcccgctccgcgacgtcctcgacgacgccggcatcgggggcaaggtctcgcgcagcctcaggctcaagcgcccctcgggcaggccgcagggccgcctcgaggtccgcgtcgccgtccgagaggccgcgccgcgatactacgagccggctccggcggcctacggcgcgcgcgacccatactacgccgcgccgccggcgggctacccggcggcctacggcggttacggagcagccgccgccgccgctcctccagttccagcaccaccggtggcctacggggcgggtagtggtgatccttgtgctgcggcggcgtacggttctgctgctcctgcaacgaagagcaagatggggatggggacggggcttgcggtgggcgcggcggcggggctgctgggcgggctggcgctggcggaaggggcaagctacctggaggacaagttcgaggaccacgtggcggagaaggtggaggaggacctgtacgccgacgacgacggtggctacgacgacgactcctagctaggatcactgtctgtcactggtgaatcatgcatgagagccggtcaggttgaaataacaagtgcccgcacgcaacgcaattactttgtgtgtttgatcgtcgagtcagactccatgttttaatttggttgtacttgttcgatcaatatccaagctgcctgctttggttttgcc

SEQ ID NO: 24054 - protein, 267 aa, Panicum virgatum
  misc_feature: Ceres CLONE 1844327
  misc_feature (7)..(96): Pfam Name: C2 Pfam Description: C2 domain
MGSRYEVEVTVGSATNLKNVNWRNGDLHPYAVLWIDDGPKCSTRVDLDNGEDPVWDDKLLVPVPPSVTRLEDAVLCIDVVHADAAEGVKPLVGSARLPLRDVLDDAGIGGKVSRSLRLKRPSGRPQGRLEVRVAVREAAPRYYEPAPAAYGARDPYYAAPPAGYPAAYGGYGAAAAAAPPVPAPPVAYGAGSGDPCAAAAYGSAAPATKSKMGMGTGLAVGAAAGLLGGLALAEGASYLEDKFEDHVAEKVEEDLYADDDGGYDDDS

SEQ ID NO: 24055 - DNA, 1292 bp, Panicum virgatum
  misc_feature: Ceres CLONE 1844343
  misc_feature: Encodes the peptide sequence at SEQ ID NO. 24056
acctcgaaaattctcttcttacttaccgtttcatgtgcccactccccttctccgacggttaccagcttcaccagcaatgccgccgccaacgccaccaacgggcgaaccgaagcgtcgccgcctgctggcgctcccggccgtgtgcccgtgcgagggcatcgcgccggcgcctctactcgcctccctcctctccctcgccgccgatttaacgagccgcggggccggagacgccggcgccttccccgtgctccgccgcggcgtgcggcaggcagtaaggatcgcaggcatcctcctcgcgttcctcgaggagatccaggaggcgatggaggcgctggcgctagtgctgccggcgccggcggtgccggcgctcacggagctgcacgtggccatgcagaagctgcggttcctcctcacggactgcgcgcggcggggcgcgcgcctgtgggtgctcgtcaacgccgggctggccgcgtccgagctccgggcggtgctcgggtccgtcgcggcggccttggacgcgctgccgaagggcgtcgtggatgcgtcagtggaggccggggagctcgcgcggctggtgtcggagcaggcgtggcgagtgccggtgcgtccggacaccggggacgagcgtgcggcgaggaccgtgcggtcgatactggagcagttcaagagcggcgtctcgccggacgccgaggacgcccggcgggtgctcgagcacatcggtgttcgcacctggtcggagtgctccgaggagattgccttcctggaggatgagctgcgcacgcggatggacggcgccggcgatgacagctgcagcgacgcggtactcatcaacagcttaattgcgttcctggtctactgccgcgtcgtgctgttcgatcagatcgacgtgaatccaaaagcggacgcggcggcgcggccggccaggtgcccggactggatcagaccggacgcgctgcagtgccccgtcacgctggacctcatgacggacccggtgaccgtgtccaccggccagacgtacgaccgtgcgtccattactcgatggatcaaggccgggtgccggacgtgcccggtcaccggtgagcggctccacaccgccgacatggtcccgaacgccgcgctccgcgggatcatcgagcggatgctgctcagcaacggcgtctcgcttccggacgctagcagctcagggcaccgtcacggcgcgctcggcaacgcacccgcgccgttcggaccggccgccgccagtgccgcccggctcgccgtcacctacatccttcgcccagttctcgacgggg

SEQ ID NO: 24056 - protein, 405 aa, Panicum virgatum
  misc_feature: Ceres CLONE 1844343
  misc_feature (290)..(362): Pfam Name: U-box Pfam Description: U-box domain
MPPPTPPTGEPKRRRLLALPAVCPCEGIAPAPLLASLLSLAADLTSRGAGDAGAFPVLRRGVRQAVRIAGILLAFLEEIQEAMEALALVLPAPAVPALTELHVAMQKLRFLLTDCARRGARLWVLVNAGLAASELRAVLGSVAAALDALPKGVVDASVEAGELARLVSEQAWRVPVRPDTGDERAARTVRSILEQFKSGVSPDAEDARRVLEHIGVRTWSECSEEIAFLEDELRTRMDGAGDDSCSDAVLINSLIAFLVYCRVVLFDQIDVNPKADAAARPARCPDWIRPDALQCPVTLDLMTDPVTVSTGQTYDRASITRWIKAGCRTCPVTGERLHTADMVPNAALRGIIERMLLSNGVSLPDASSSGHRHGALGNAPAPFGPAAASAARLAVTYILRPVLDG

SEQ ID NO: 24057 - DNA, 790 bp, Panicum virgatum
  misc_feature: Ceres CLONE 1844343-R
aggcgcggcagaacgcggcggccgtcctgttctacctctcgtcgggcccggagcaggccgaggagatcgggcgcatcccggagtccatcccgacgctggtgcagctcatccgcgacggcgcgcaccgcgggcgcaagaacgccatggtgagcctctacggcctgctccagtgcgcgagcaaccacggcaaggccgtcgcagccggcgccgtggtcgccctcgcagctgtgctggccgtggaccctgacgacctcgccggcgacgccgtggccctgctggcgaggctcgcggagcacccggtgggcgcgcaggccgtgctggcgcgcccgggcctcgtcgcccgcgtcgtggaggccctcgcgacgtcggcgtcccggtccgggaaggaccactgcgtggcgctgctggtctcgctgtgccggcacggcggggagaaggtggtggcgctgctggggcggatgccggggctgatggcgtcgctgtacacgctggtggccgacggcagcccgcagacgtgcaagcgggcgagggcgctgctgaacatgatccaccggcattacgagatgggcgacgcgccgccggcggcgtccgcaccggaggccggcgagcgcgtcgttcgcgtgctatagccgcaggaccgagacaagacgtgccgtaagtacaggatgtaggagggtagatcttactgtcagcgagtgatcgttgtgagaacatttttgcgaactctcagctcatgttttagaagagctaggaacggattttgctgcttccttttttgatgttttgttac

SEQ ID NO: 24058 - DNA, 2190 bp, Panicum virgatum
  misc_feature: Ceres CLONE 1844350
  misc_feature: Encodes the peptide sequence at SEQ ID NO. 24059
acacaaaaacacgcccacactgcccagtgcttaagctaaagcaccaaatcacacgcctcgtgtcgaccagcgaacaccagggcaggcacgaactgcgctagctagcacgccgtacgcactgcagtgccatgccggaagcgccgtcccccaagacaaccccgccggcctgcggcttcgccccgggggctcaccgcgaggcgctcgagttcatcgagcatgtcacggcgaacgccgggcaggtgcagcggcgcgtcctcgccgagatactggcgcagaacgcgccggccgagtacctgcgccggcacggcgtctccggggccgcggacgacaccgtcgaagccttccgccgcctcgtcccgctcgtcacctacgagggcctccagccggacatcctccgcattgccaacggcgatacctcgccgatcctctccggcaagcccatctccgagttcctcacaagctctggcacgtccggaggggagaggaagctgatgccgaccatcgccgacgagctggacaggaggtcgctgttgtatagcctgcagatgccggtgatgagccagtcggtgcccgggctcgacaagggcaagaccatgtacctgctgttcgtgaaggcggagtcgtgcacgccgggcgggctcgtggcgcggccggtgccgactagctactaccggagccggcagtttctggagcggccgcatgacccctacaccgactacacgagccccaacgaggcgatcctgtgcgtggactcgtaccagagcatgtacgcgcagctgctgtgcggcctcgtccaccgcgccgacgtgctgcgcgtcggcgccgtgttcgcctcgggcttcctccgcgccatccgcttcctcgagaagcactggccgcgcctgtgccgcgacatccgcacgggcgccctcgacccggagatcaccgaccgcgccgtgcgcgacgccgtcgggagggtgctgcgcgccgacccggcgctcgccgacgaggtcgaagacgagtgcgggagggcgtcgtgggagggcatcatccggcgcctgtggccccgcaccaagtacatcgacgtgatcgtgaccggcgccatgtcgcagtacatcccgacgctggagttctacggcggcggcctgccgctcgcgtgcaccatgtacgcctcctccgagtgctacttcgggctcaacctgaagcccatgtgcaagccgagcgacgtggcctacacgctcatccccaccatgtgctacttcgagttccttcctctccgctgcagcaacgccaagcagcaggccgacccgagtcaccgcgacctggtcgacctcgtcgatgtgaagcttggacacgagtacgagctcgtggtcaccacttactccggtttgtgtcggtatcgcgtgggtgatgtgctgcgggtggcggggttcaagaacgatgcgcctatgttcagcttcgtccggcggcagaacgtggcgctgagcatcgactccgacaagaccgacgagacggagctgcacgcggcggtgagcggcgcggtgcagcacctggcgccgttcggcgcgtcgctggtggagtacacgagctacgcggacgcggcgaccatcccgggccactacgtgctgttctgggagctgcgcgccggcagcacggccgtgccggcgtccgtgttcgaggactgctgcctgtcggtggaggaggccctgaacagcgtgtaccggcagtgccgggcctgcgacaggtccatcggccccctcgagatacgcgtcgtctccgagggcaccttcgacaagctcatggactacgccatcagccgcggcgcgtccatcaaccagtacaaggcgccgcggtgcgtgcgcgccggcccggtggtggagctgctcgacgcgagggtgcagggcaagtacttcagccccaagtgccccaagtggagccccgggaacaagctatggagcaacgccagggaggtgacctccaacggggacgcctgctgaatcctgatggtcgtggtaccatctgaatgttcagaggcagcgagaggattagctatatggaatgatgatgacttagggtatctgctaagatcatttgatttttggttccttttctctccatctttgtaatatgtctcgtgtagtcgtgttccttcagctcgtgtattttgctatgcactttgtgcatgtcaattacatatactaaattattatg

SEQ ID NO: 24059 - protein, 615 aa, Panicum virgatum
  misc_feature: Ceres CLONE 1844350
  misc_feature (23)..(578): Pfam Name: GH3 Pfam Description: GH3 auxin-responsive promoter
  misc_feature: Useful for making plants with modulated biomass
  misc_feature: Useful for making plants with modulated light quality response
  misc_feature: Useful for making plants with modulated low light sensitivity
MPEAPSPKTTPPACGFAPGAHREALEFIEHVTANAGQVQRRVLAEILAQNAPAEYLRRHGVSGAADDTVEAFRRLVPLVTYEGLQPDILRIANGDTSPILSGKPISEFLTSSGTSGGERKLMPTIADELDRRSLLYSLQMPVMSQSVPGLDKGKTMYLLFVKAESCTPGGLVARPVPTSYYRSRQFLERPHDPYTDYTSPNEAILCVDSYQSMYAQLLCGLVHRADVLRVGAVFASGFLRAIRFLEKHWPRLCRDIRTGALDPEITDRAVRDAVGRVLRADPALADEVEDECGRASWEGIIRRLWPRTKYIDVIVTGAMSQYIPTLEFYGGGLPLACTMYASSECYFGLNLKPMCKPSDVAYTLIPTMCYFEFLPLRCSNAKQQADPSHRDLVDLVDVKLGHEYELVVTTYSGLCRYRVGDVLRVAGFKNDAPMFSFVRRQNVALSIDSDKTDETELHAAVSGAVQHLAPFGASLVEYTSYADAATIPGHYVLFWELRAGSTAVPASVFEDCCLSVEEALNSVYRQCRACDRSIGPLEIRVVSEGTFDKLMDYAISRGASINQYKAPRCVRAGPVVELLDARVQGKYFSPKCPKWSPGNKLWSNAREVTSNGDAC

SEQ ID NO: 24060 - DNA, 1806 bp, Panicum virgatum
  misc_feature: Ceres CLONE 1844367
  misc_feature: Encodes the peptide sequence at SEQ ID NO. 24061
acgcacggcatcacacggccaaggatggcaggccaccacaaccaccagcgcacacgccgggcaaactgaagtgaacgcacgcgcggccggcggcggcggcgggaaacccagcggaaccagagcgccccccaaaagacacgcccagaccatggcacccggccgcgccctgcccctggcgctcgtcttggcgctggcgtgcctcctcccgcgccacgccgcggcgcagcaggccgacgaggcgcggctgctgctccggatcaagcgggcgtggggcgacccggcggcgctcgcgtcgtggggcgccgcggccgcggcctcgcactgcaactggacctacgtgtcctgcgacgcggcgggtcgcgtcgcgtcgctggcgctccccaacgtgacgctgccggcgggcgccgcgctgcccgacgacatcggcgggctcgcggccctcacggcgctcgacctctccaacaccagcgtcggcggcggcttcccggcgttcctctacgacctcaccgccctcgtgcgcgtcgacctctccagcaaccgcctcgccggggtgctcccggccgacatcggccggctcggggccagcctcacctacctcgccctggacctcaactccttcaccggcgcgatcccggcggcggtgtccaagctcaccaacctgacgtacctcggcctcagcggaaaccagctcaccggcacgatcccaccggagctcggtttgctggttaacctcgagacgatcaagctcgagaataatctgttcgccgccggcacgctgccggagtcgttcaagaacctgacgaagctgaccaccgtctggctggccaactgcagcctcggcggcgaattcccgagctacgtcacgcagatgacggagatggagtggctcgacctgtccagaaacgggttcaccggcagcataccgcccgggatttggaacctccggaagctgcagcacctgtacctgtactccaacaacctcaccggcgagatcaccattagcggcccgatcggagcagcaagtttggtggaggttgacctgtcgatgaaccagctgatcggaaccatcccagaaagtttagggagcttgctgcaactacggttcttgaacttgcaacagaataatctcaccggcgggataccgccgagcattgcccggctgccgtccttggtattcctgtggctgtgggacaaccacctcagcggggagctcccggcggagctcgggaaggagacgccgctgttaagagacatccagatcgacggcaacgactttttcgggccgataccggaggggatctgcagccaccaacagttgtgggtgctcaccgcctccggtaaccgcctgaacggctcgatcccgaccggtctcgccagctgctctgctctcatatggctccagctccaagataacgagttgtccggcgaggtgccggccgctctgtggacggtgccgaagcttctgaccttgtacctgcaggacaaccggcagctgagaggaagcctgccggagaagctgtactggaacacgacgaggatttacattgacaacaaccggttcaccggacggattccgacatcggccactcgtctccagaggttccacgccagcaacaactcgttctccggcgacataccggcggagcttgtcactgggatgccacagctgaaggagctgaacctggcggggaacatgttgtccggggtaatcccttgactgttctggttaaatcttagtattgtacatcgtgcgtgtataacacaagctgtgtgttctgtttttccaaagccattttacgactcccg

SEQ ID NO: 24061 - protein, 522 aa, Panicum virgatum
  misc_feature: Ceres CLONE 1844367
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPGRALPLALVLALACLLPRHAAAQQADEARLLLRIKRAWGDPAALASWGAAAAASHCNWTYVSCDAAGRVASLALPNVTLPAGAALPDDIGGLAALTALDLSNTSVGGGFPAFLYDLTALVRVDLSSNRLAGVLPADIGRLGASLTYLALDLNSFTGAIPAAVSKLTNLTYLGLSGNQLTGTIPPELGLLVNLETIKLENNLFAAGTLPESFKNLTKLTTVWLANCSLGGEFPSYVTQMTEMEWLDLSRNGFTGSIPPGIWNLRKLQHLYLYSNNLTGEITISGPIGAASLVEVDLSMNQLIGTIPESLGSLLQLRFLNLQQNNLTGGIPPSIARLPSLVFLWLWDNHLSGELPAELGKETPLLRDIQIDGNDFFGPIPEGICSHQQLWVLTASGNRLNGSIPTGLASCSALIWLQLQDNELSGEVPAALWTVPKLLTLYLQDNRQLRGSLPEKLYWNTTRIYIDNNRFTGRIPTSATRLQRFHASNNSFSGDIPAELVTGMPQLKELNLAGNMLSGVIP

SEQ ID NO: 24062 - DNA, 651 bp, Panicum virgatum
  misc_feature: Ceres CLONE 1844369
  misc_feature: Encodes the peptide sequence at SEQ ID NO. 24063
gagaaattcggcctcgctgcgagatctttagctccgggccccgagcccccgtgtggattagtcgctgtcacgttcgacgacgggcgccaattgcgatggccaccacctccaaattccaatccactccccgcggtcgccgcgccgagctgttcttgctctgtcctcctaacgtcctcccacaggccgaggtacggtacacgccaccggcgatgaaccctccggtagtcccacctgtagttatcccaccaaagcccacatcagacacaattcttggcaagccgtatgaggatgtgcgcacagtctactccctcgggaaggagcttggccgcggccagttcggggtgacgtacctctgcacagagattgctactggtaggcagtacgcctgcaagtccatctctaagcgcaagctcaccagcaaggcagacagggaggacattcgcagggagatccagatcatgcagcacttgtctgggcagccaaacattgtcgaattccggggagcgtacgaggataagagcaatgtgcatgtggtgatggagctctgcgctggtggtgagctatttgatcggatcattgctaaggggcactacacagaacgggcagctgctacaatctgcagagcagttgtgaatgttgtgaacttttgcc

SEQ ID NO: 24063 - protein, 185 aa, Panicum virgatum
  misc_feature: Ceres CLONE 1844369
  misc_feature (70)..(184): Pfam Name: Pkinase Pfam Description: Protein kinase domain
  misc_feature: SWISSPROT Homolog: EC 2.7.11.1 Non-specific serine/threonine protein kinase
MATTSKFQSTPRGRRAELFLLCPPNVLPQAEVRYTPPAMNPPVVPPVVIPPKPTSDTILGKPYEDVRTVYSLGKELGRGQFGVTYLCTEIATGRQYACKSISKRKLTSKADREDIRREIQIMQHLSGQPNIVEFRGAYEDKSNVHVVMELCAGGELFDRIIAKGHYTERAAATICRAVVNVVNFC

SEQ ID NO: 24064 - DNA, 810 bp, Panicum virgatum
  misc_feature: Ceres CLONE 1844370-R
  misc_feature: Encodes the peptide sequence at SEQ ID NO. 24065
gggattgtccttactcagcagcagtcagagattgtggctgcgaatggcgattgcttggtgcgtccgaataggttccctccgaggtggttagattggggtgatatatctgatgtgaatcctgagtatgtggcaccagactatcctgctcttcctgagttaaactttgcgattgatgtgtcgagggcaaggaatgtggcatgttatttcagccacagttgcagtccaaacgtgtttgtccagtttgtgctgtttgatcattacaatgcgtcttacccccacctcatgatctttgccatggagaacattccaccattgagggagctaagcatcgactatggaatggttgatgaatgggtcggaaagttaaccatgtagctggagtacctatgtagaaggtcatgccctcttttgtttctgtttctttgaagttttcatagtacttcacttggggatcaagccaaccattgactgaaattcctcatctgtccaataatggaggtttccatctggaacaatgttcctcttccagcgacagagggggggctaacgtagggaggggccaagctacaactcattgtcatcaactgtacatcagccgtgcattgtatatgttgtgtgataacctaggtggcttggccaattttcaagaagcactcacctccgaaagtatgactgtaggaggcttgtttggcgtagcaggcgctgagtttcagttttaacctcattttgtctcatggctactggtactgaacactttatgtacatatatctgtacattatctagctgaaagtcttcctatttctgttggt

SEQ ID NO: 24065 - protein, 124 aa, Panicum virgatum
  misc_feature: Ceres CLONE 1844370-R
  misc_feature (1)..(119): Pfam Name: SET Pfam Description: SET domain
  misc_feature: SWISSPROT Homolog: EC 2.1.1.43 Histone-lysine N-methyltransferase
GIVLTQQQSEIVAANGDCLVRPNRFPPRWLDWGDISDVNPEYVAPDYPALPELNFAIDVSRARNVACYFSHSCSPNVFVQFVLFDHYNASYPHLMIFAMENIPPLRELSIDYGMVDEWVGKLTM

SEQ ID NO: 24066 - DNA, 672 bp, Panicum virgatum
  misc_feature: Ceres CLONE 1844370
agtcatcagttggtgaaatccccccactccacccccaccctaaccgccctcgcccgcatccccaatccaccacgcctgctccgccgcgcgggtttggggggaatttcggggcggaggaggcggcgaggaaggcgggcagggggtttttttttgttgcgggaatggaggtggacgaatcctcgccgtcgtcgtcgtcgtcgccgctgtcgtctccgggagggtcgtccgactccatcgacctcaacttcctgccgttcctcaaccccaagagggagcccaaatcggagccggcgtcgccggagcgcgggcccctgccactgcctgcgcccccggcccagacgccacagcagcagcatccggcggcggcggctccgccgccggcaacgcccgacatgtcgtccgcgccggtgatgacgccgctgcaggcgctgccgccgaaccccgacgaggacgcgctcctccgggagtactaccgcctcgcgaccctctacctctcgtcggcggggaccggggcgatcgtcgcggcgccggcgccgggggctgccgcacccgcggtggtggagcccgggaccgggtccgtcgtgaagaagcgccggccgcggtcgtcggagctcgtgcgggtctcctcgctcggcgtgcgggaccagatctatttccgcgacctcgtaaggc

SEQ ID NO: 24067 - DNA, 692 bp, Panicum virgatum
  misc_feature: Ceres CLONE 1844391
  misc_feature: Encodes the peptide sequence at SEQ ID NO. 24068
acttgtaaaacctaccccccgggccgtgctcagacgccaccgccgcgtcccgtccccgtcccgtcccgtcccgtccccggaggaggagaagatccgagcagcccaccatggcgacccgctcccccgcggcctggatcccgctgctgctcgcgctcgcgctcgcgctgtcggcgcgggcggaggaggcgcccgcggcggcggcggcggagggggaggccgtgctcaccctcgacgtcgacaccttcgacgaggccgtcgccaagcaccccttcatggtcgtcgagttctacgccccctggtgtggacactgcaaggcactcgccccagagtatgagaaggcggcacagtcgctcagcaagcacgacccaccgattgttctcgctaaggtcgatgcgaatgaggacaagaacaggccgcttgctaccaagtacgaggtccaagggttcccgaccctcaagatcttcaggaaccagggcaagaatattcaggagtacaagggacctagggaggctgagggcatcgttgagtacctgaagaagcaggtcggccctgcttccaaggagatcaagtcaccggaagatgcggcatccctcttcgatgacaagaagatctacattgttggtgtcttcacagaattcagtggcactgagtttacaaacttcatggaggttgctgagaagctgaggtctgac

SEQ ID NO: 24068 - protein, 194 aa, Panicum virgatum
  misc_feature: Ceres CLONE 1844391
  misc_feature (37)..(145): Pfam Name: Thioredoxin Pfam Description: Thioredoxin
  misc_feature: SWISSPROT Homolog: EC 5.3.4.1 Protein disulfide-isomerase
MATRSPAAWIPLLLALALALSARAEEAPAAAAAEGEAVLTLDVDTFDEAVAKHPFMVVEFYAPWCGHCKALAPEYEKAAQSLSKHDPPIVLAKVDANEDKNRPLATKYEVQGFPTLKIFRNQGKNIQEYKGPREAEGIVEYLKKQVGPASKEIKSPEDAASLFDDKKIYIVGVFTEFSGTEFTNFMEVAEKLRS

SEQ ID NO: 24069 - DNA, 2432 bp, Panicum virgatum
  misc_feature: Ceres CLONE 1844393
  misc_feature: Encodes the peptide sequence at SEQ ID NO. 24070
gctgacacagaaagaagaagagaagccgaacaaaaagaaaaggacggctccttccaagggtcaaacgccgaagcggggtggtgagttgctgccccgtcttcgattcgaccctcgcgcaagatcgagcgtcctcggcctggggcttgcggtaccctggatccgttcgcttcgcgtccatcgggtctcgagcagctgatcacagcaggaaacatttgacttggaagagcatcgttgtgtaactgagcaccacaaagtattatcggtctgttttgagttatcctatcaagttcctgttagagtgctggcagcatactggtacaatattttccccaatgttttgggccacagaaggttagagatcttctatcttgtaaggcagtaagacacaatcttcttgatcatagtctgtgcccatttacccttacctacaaataggacgttctaaaagcaggacagtgggctttgtacactctggttgtttctctctcacgatatatagactgatataatggacgagaggaggaatattttgatggaccgttatgaaattgggaggcagttaggacaagggaactttgctaaggtatattatgctcgaaatctaactagcgggcaggctgttgcaataaagataattgataaggacaggatcacgagggttgggctaatagtgcagataaagagggagatttcaataatgagattggtaaggcatccaaatgttctgcaactttttgaggtaatggctagcaagagcaagatatactttgttttggagtatgctaaaggtggcgagctgttcaacaaaatatccaagggaaagtttagtgaggatgttgcaaggaggtatttccaccaactgatctgtgcggtggactactgccacagccgaggtgattaccatcgtgatctgaagccagaaaacctactcctagatgataatgagaacttaaaagtctcggattttggcctaagtgctctagctgaatccaagagacatgatggcctcctccataccacctgtggaactccagcttatgttgctcctgaagtgcttagcaggagaggctatgatggctccaaggctgacatatggtcttgtggagtaattctttttgtgcttgtggctggttaccttccgttccatgacccaaatcttatagcgatgtataggaagatttccaaagcagagtacagatgccctcgttccttctctactgaactgaaggacctgctttttagaatgcttgatccagatccaagaactagaatttctatttcaaggataaagagaagcacttggtacaggaaaccctttgagttaaatgctacaaagatgaagcacgaatcagcaaggcacaaggtgtgtaatggtgaagccacaacctctaacttaatagaatgcggtaatttggaggaaaatcaagggccatcaagcctccctaacctgaatgcatttgacatcatttccctttcaactggatttgacctgtccaatttatttgaggaaagatatggccggagggaagagagattcaccactaggcagccagcagggacagtttttggtaagctaaaggaactggctgagaggttaaagctcaaaattgagaagaatgaaaatggagttttgaaactggctgcaccaaatgaaggaataaagggatttcttgagctcgatgcagagatttttgagcttgctccttctttccttttggttgaattgaagaagaccaatggggacaccatagagtatcaaaagctcgtgaaagatgaaataaggcctgcactcaaggatatggtctgggcatggcaaagcgatcggcacaggcagcatgagcaaattatgcaagaagagcagcagcagcagcagcagcagcagcaggcacctttgccaccacagcagtagtcacctttgccatcgcagtagccgcacccacatgactgattgtggagatccttgatagcacaaaatccagagaacaagctgcaacgatcgttgcagtcacgaggtgaaatgtgctatcggaccattgttgctgccacatgaaccgcacaaccacttgaaactaagcatcatcaggttaccaccacatcagctgcaggactacctccaactgccggagtcacgattcatagacatacatgtgattggatgttcaggtctaggatctactacgttgccaaccatttggcttttttcccttttatatagctccctttgaatccctgtatttcttgtaaatcagtatatcccattttttcgttacaaatgtaggatcactatacttggcttcagtttcgaaaatttgtttgttctacagaattttgtactcaggtgtaagtataaaagttgattaatcacaaattgatcttggcatgtaacactgtcatatttaccataagaaattgcatgttggactgtggaaatc

SEQ ID NO: 24070 - protein, 466 aa, Panicum virgatum
  misc_feature: Ceres CLONE 1844393
  misc_feature (12)..(266): Pfam Name: Pkinase Pfam Description: Protein kinase domain
  misc_feature (310)..(369): Pfam Name: NAF Pfam Description: NAF domain
  misc_feature: SWISSPROT Homolog: EC 2.7.11.1 Non-specific serine/threonine protein kinase
  misc_feature: Useful for making plants with modulated biomass
MDERRNILMDRYEIGRQLGQGNFAKVYYARNLTSGQAVAIKIIDKDRITRVGLIVQIKREISIMRLVRHPNVLQLFEVMASKSKIYFVLEYAKGGELFNKISKGKFSEDVARRYFHQLICAVDYCHSRGDYHRDLKPENLLLDDNENLKVSDFGLSALAESKRHDGLLHTTCGTPAYVAPEVLSRRGYDGSKADIWSCGVILFVLVAGYLPFHDPNLIAMYRKISKAEYRCPRSFSTELKDLLFRMLDPDPRTRISISRIKRSTWYRKPFELNATKMKHESARHKVCNGEATTSNLIECGNLEENQGPSSLPNLNAFDIISLSTGFDLSNLFEERYGRREERFTTRQPAGTVFGKLKELAERLKLKIEKNENGVLKLAAPNEGIKGFLELDAEIFELAPSFLLVELKKTNGDTIEYQKLVKDEIRPALKDMVWAWQSDRHRQHEQIMQEEQQQQQQQQQAPLPPQQ

SEQ ID NO: 24071 - DNA, 1889 bp, Panicum virgatum
  misc_feature: Ceres CLONE 1844416
  misc_feature: Encodes the peptide sequence at SEQ ID NO. 24072
attcgttggctgatcgatcggccgatccgccgccgccggcctcccaatccgccgctgccgccatgttcaacaagatcatcaagcgggggaaccgcaagagcgcgcgcggggacagcgcggagccaggggcgcgccccgccgcgccctcgtcgtcctccgggggaggcggtggcggcgcggggggagccgcgcccgtcaccgttaaccacgcctcccgggcctctgccgcgacgccgtcctcgccgacctcgccgcacgttgcgccgtccgcgctcgcgaccaaccccgcggctggggctgcgtcgccgccgctcctcgagccgctcccgctcctccgcgatgtcgccgccgccgaccgaccggggcttctcctccgcaagctccgcctcgtcgccgctatcttcgacctctcggactcgctcaagcacccgcgggagaaggaggccaagcgtcaggcgctcctcgagctcgtcgattacgtgcaggcccccgcgcaggccgcgggcgccaacgcgcccgcgcgcctcccggaccacgtccaggaggcgctcgtcgccgccatctccgccaacatcttccgcccactgccgcccgcgctgcacgagtccgctgcagcgatcgaccctggtgccacgccggatgacgaggaggagccctacctcgaccccgcctggccgcacctccagctcgtctatgagctactgctccggtatgtcgtgtctcccgacaccgacaccaaggttgccaagcggtacgtggaccatgccttcgtgctccgcctcctcgacctctttgactccgaggatccccgtgagcgtgagtacctcaagactgtgctccaccgcatctatggcaagttcatggtacaccgcccattcatccgcaaggccatcaacaatgtgttctaccggttcatctttgagacgcagcgacacaatggcataggggagctccttgagatccttggaagcatcattaatggctttgccttgccaatgaaggaggagcacaagctgttccttgcccgtgctctcatccccctgcacaagcccaagtctgttgcgatctaccatcagcagctatcctattgtattgttcagttcgttgagaaggactacaaactagcagatactgtgatcaggggactgctcaaatactggccagtcacaaattgccagaaggaggtgttgtttctgggagagctagaagaagtgcttgaggccacacagcctgcagagttccagcgttgcatggtgccactgtttaaacagattggccggtgccttaacagttctcatttccaggttgctgagcgtgcgttgttcttgtggaacaatgatcacattgtaagcttgatagcccaaaatcgtggtgctatatttccaatcatatttgaagcacttgagaggaatatacagagccactggaatcaagccgttcatggtctcactgcaaatgtgcgcaagatgtttttggatatggacagtgagctatttgaagagtgccaacagcagtacatggagaaacaagcaaaagctaaagagatccaagagcaacgagaatctgcatggagacaattggaagctgtggctgccaaggctgctggagatgacatggttttggtcaactaggtaatataaccttcctgcttcatttatttgttagtgcttgtgttcgtaagttgtttttaatcttgtaacctgaaactgtattactctgtttatgtccttttcttgatgttctccctttgttttaggatttctgagagatgcattgccactttttgtactgctcaccttttgttttgacttggtcatggcagttgacaaaaagatggaatatatctgtattgaactttcagttgattatggacatttattttttttagc

SEQ ID NO: 24072 - protein, 522 aa, Panicum virgatum
  misc_feature: Ceres CLONE 1844416
  misc_feature (87)..(511): Pfam Name: B56 Pfam Description: Protein phosphatase 2A regulatory B subunit (B56 family)
MFNKIIKRGNRKSARGDSAEPGARPAAPSSSSGGGGGGAGGAAPVTVNHASRASAATPSSPTSPHVAPSALATNPAAGAASPPLLEPLPLLRDVAAADRPGLLLRKLRLVAAIFDLSDSLKHPREKEAKRQALLELVDYVQAPAQAAGANAPARLPDHVQEALVAAISANIFRPLPPALHESAAAIDPGATPDDEEEPYLDPAWPHLQLVYELLLRYVVSPDTDTKVAKRYVDHAFVLRLLDLFDSEDPREREYLKTVLHRIYGKFMVHRPFIRKAINNVFYRFIFETQRHNGIGELLEILGSIINGFALPMKEEHKLFLARALIPLHKPKSVAIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRGAIFPIIFEALERNIQSHWNQAVHGLTANVRKMFLDMDSELFEECQQQYMEKQAKAKEIQEQRESAWRQLEAVAAKAAGDDMVLVN

SEQ ID NO: 24073 - DNA, 2042 bp, Panicum virgatum
  misc_feature: Ceres CLONE 1844422
  misc_feature: Encodes the peptide sequence at SEQ ID NO. 24074
gaaaatccagcatgcaccaagcagcagcatcgatcgagcagcagcggcggcgacaacgaccctccgcgcagcacgaggcagcaagcgtcgtaagcccaggaatcccgggcccaccgcgcacccccgtcgtcccccgcttccccgcgccacccccgattcttctccccggcgttctctcctctagattctagaacctcttcctccgcccccagcccttgaccgcaccgcgcccgcgcgagaccaggggggtccggcgccaccgccgggggttcaggacggcgatggagctgggcctgagcctggcctcggcctcgccgccggcgggcgggctggcgcctccgccgcccctagcgcctccagggaaggagcagcaggtggctggcgtggggatcctgctgcagatctccatgctcgtgctctccttcgtgctcgggcacgtcctgcgccgccaccgcttctactacctgcccaaggccagcgcctcgctcctcatcggtctagttgttggtggccttgctaacatttcaaatacagagaccaacactaggacatggttcaacttccatgaagaattcttcttcctgttcttattacctccgataatatttcaatcaggattcagcttatctccgaaaccattctttgcaaactttggggctatcgtaactttcgccattcttgggacgttgattgcttcagttgtaacaggggttcttgtctatcttggcggactgacatttctaatgtataaacttccactggttgagtgccttatgttcggtgcccttatatctgcaaccgatcctgtcacagtgctatcgatattccaggaactgggttctgatgttaacttgtatgctttggtgtttggagaatctgttttgaatgatgcaatggcaatttctctttacaggacaatgtcatcagtcagaagtcatgcagcagtcggcgagaacttttttatgatgattctccagttccttgaaacctttgttggttcaatgtcatcaggtgtaggagttggatttatctctgctcttcttttcaaatatgctggattggatgttgacaatctgcaaaatttggagtgctgcctttttgttctctttccatatttctcgtatatgttagccgaaggacttgggttgtcagggattgtttctatattattcacgggaatggttatgaagcattacacatactccaatctttcagacaattcacagcgctttgtttctgcctttttccacttactgtcatctttggctgaaacatttgtgttcatttatatgggcttcgatattgccatggaagagcatagctggtcacatgttggcttcatcttcttttcaattatatttatagttgttgcaagggctgtaaatgtcttttcttgtgcatacttggttaacatgtctaggccagaacatcgccgtattcctctaaagcatcagaaagcactttggtttagcgggcttagaggggccatggcttttgcacttgctctccaatctgtgcatgaacttcctgaaggacatggaaaaacaatattcaccaccactacagccattgttgtgttgacggtacttcttattggagggtcgacgggaactatgcttgaagctttggatgttgttggagatgaaaacccatcaatagaaacttatgaagacaacaatggtttcatgcctccaacttatgaagaaggtacatcatctgggggaggattgagaatgaaactcaaacagtttcacaaaagcacgacgtcattcactgcccttgacaaaaactacctgactccatttttcaccagccagactgacgatgacgacgacgatgacttcagttagtgaattattttgcttatcaaatgtaaagtaaacgagatcgaacccaggctatataaatcaataatttgtgtgcaacttgttacttgtacggcattatcatcttcggaatctggtgtctgctacatcttctcagtttagttagcatttcatgatgtgcatttattctatcaataaacattgattcacccatct

SEQ ID NO: 24074 - protein, 522 aa, Panicum virgatum
  misc_feature: Ceres CLONE 1844422
  misc_feature (41)..(448): Pfam Name: Na_H_Exchanger Pfam Description: Sodium/hydrogen exchanger family
MELGLSLASASPPAGGLAPPPPLAPPGKEQQVAGVGILLQISMLVLSFVLGHVLRRHRFYYLPKASASLLIGLVVGGLANISNTETNTRTWFNFHEEFFFLFLLPPIIFQSGFSLSPKPFFANFGAIVTFAILGTLIASVVTGVLVYLGGLTFLMYKLPLVECLMFGALISATDPVTVLSIFQELGSDVNLYALVFGESVLNDAMAISLYRTMSSVRSHAAVGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELPEGHGKTIFTTTTAIVVLTVLLIGGSTGTMLEALDVVGDENPSIETYEDNNGFMPPTYEEGTSSGGGLRMKLKQFHKSTTSFTALDKNYLTPFFTSQTDDDDDDDFS

SEQ ID NO: 24075 - DNA, 1072 bp, Panicum virgatum
  misc_feature: Ceres CLONE 1844426
  misc_feature: Encodes the peptide sequence at SEQ ID NO. 24076
acacacagcctgctgtgctggtcaaccccccgccgctccacctccacgcattgctcctgccccggctccgccgctgccgctgccggagatggccaagggcaccaccgccatggaggtgcgcgccgacggcgtcgccgtcatcaccatctccaacccgcccgtcaacgccctctctttcgacgtcatagcctgtctgcagaggaactatgcggaggctctaagcaggagcgatgtcaaggcaattgtcctcactggtgccaaggggaggttttgcggtggatttgatataactgcatttggaaagaaaccaaaaaacgagaagcccggatccatgtcaattgattttttgagtgacatagtggaagatgctcgcaaaccatcagtggctgctatagatggcattgctctgggtggaggattggagcttgcaatggtctgccatgctcgtatttcgacaccatccgctcaactaggattacctgaacttcaacttggaatcattcctggattgggaggaacccaacggctcccccgccttgttggcctgcaaaaagcccttgagatgttgttgacgtcaaaggctataaaaggaagggacgcgcatgaagttggtctagttgatgccataacttcagctaatgaattggtcaacactgcctgttcctgggctctggaaatcgttgaaaacaggagaccatggttcaagtgtctctacagaactgatagacttccagatcttgtggaagtgaaggatgtccttaaatttgcaagagttcaagctaaaaagaaggctcctaatgttcaacatcccatagtttgcattgatgttattgaagagggaatagtctgtgggcctcgtgttggcctcatgaaggaagcgctctccgcaaaagtggttgagcagtctgaaacaagcaaatgcttaagacacttttttttcgctcagcgtgctacttcaaagattccaaatattaccaacataggtttgacaccacggaaaattaaaaaggcagctattgtcgggggtggtctaatgggatctggaattgcaactgtgttgatattgaacaac

SEQ ID NO: 24076 - protein, 327 aa, Panicum virgatum
  misc_feature: Ceres CLONE 1844426
  misc_feature (16)..(182): Pfam Name: ECH Pfam Description: Enoyl-CoA hydratase/isomerase family
  misc_feature: SWISSPROT Homolog: EC 4.2.1.55 3-hydroxybutyryl-CoA dehydratase
MAKGTTAMEVRADGVAVITISNPPVNALSFDVIACLQRNYAEALSRSDVKAIVLTGAKGRFCGGFDITAFGKKPKNEKPGSMSIDFLSDIVEDARKPSVAAIDGIALGGGLELAMVCHARISTPSAQLGLPELQLGIIPGLGGTQRLPRLVGLQKALEMLLTSKAIKGRDAHEVGLVDAITSANELVNTACSWALEIVENRRPWFKCLYRTDRLPDLVEVKDVLKFARVQAKKKAPNVQHPIVCIDVIEEGIVCGPRVGLMKEALSAKVVEQSETSKCLRHFFFAQRATSKIPNITNIGLTPRKIKKAAIVGGGLMGSGIATVLILN

SEQ ID NO: 24077 - DNA, 1865 bp, Panicum virgatum
  misc_feature: Ceres CLONE 1844436
  misc_feature: Encodes the peptide sequence at SEQ ID NO. 24078
gtccggccgatccctttcacagtgctttcacccttcacccaagcctgcctttcccatcgtcttcctccctccacagtcgtccgggcgctgtgctcccctcctttcttgccgtctgctttcccctccaaaatccgcgccttatctctccggaaagcccggccgattcgtcgccccggccggcctctcccggcagccagccagcggccagctgctgcacatgagatcatgagctcggaggactcgctcaagtccctctcgctcgactacctcaacctgctcatcaacgggcaggccttcagcgacgtcgccttcagcgtcgagggccgcctcgtgcacgcccaccgctgcgtcctcgccgcgcgcagcctcttcttccgcaagctcttctgcggcctcgaccccaaccaccagcccccgccgccgccgcccctcggctcgcccggcgcccggcctgcgggcgccgcgccggagctcgtcatccccgtcagctcgatccggtacgaggtgctcgtcctcgtgctgcagttcctctacagcggccaggcgtcggtggcggcgcccaagagcgggccgctccccggctgcggcaccaggggatgctggcacacccgctgcggcgccgccgtcgacctcgccctcgacaccctcgccgccgcgcgctccttcggcgtcgagcagctcgcgctgctggtccagaagcagctggagagcatggtgaaggaggcgtccgtggacgacgtgatgaaggtgctcatggcgtcgcgcaagttcgagatgcaggagctctgggccacctgctcccacctggtggcgcgctccggcctctctgccgatctcctcgccaagcacctccccatcgacgtggtcgccaagattgaggagatccgcgccaagtccccggtcgccgccgccaacacgccgcgctcgccgttcctcacccaccactacctgcccatcaacgccgcgtcctcggcggcggaccgcgaccacaagatccggcgcatgcgccgggccctggacgcggccgacatcgagctcgtcaagctgatggtcatgggcgagggcctcgacctcgacgacgcgctcgccgtccactatgccgtccagcactgcagccgcgacgtcgtcaaggcgctgctcgagctcggcgcggccgacgtcaactcccgcgccgggccgacggggaagactgccctgcacctggcggccgagatggtctcccccgacatggtgtccgtcctcctcgaccaccacgccgacccgaacgccaggacgctcgacggcgtcaccccgctggacgtgctccgcagcctcacctccgagttcctcttcaagggcgccgtgccggggctgacgcacatcgagcccaacaagctcaggctgtgcctcgagctcgtgcagtccgcggtgatggtgaccacgcgcgacgagatcgagggcgcgcccggcgccggtggcgaggccgggggaagcgacggcgggaatttcccaaggagcgacgccgacgacagcttggtgagcctgacaatgaactccacgctcatgtaccagggccaggagatggcggcggcggtcgccggcgatgcgaggaaagggaacagcggccgggggagcccgtccaacttgtacttccccaatggcttcccataataagtaatccttatctagcatattgtcttttttatatatccatggatctttctcaagccctgttcgatcttttgtgcgcatttttatttgaaacggtgtagctagttattagctactgtttaactaggaggtgtgagcaagaatttcgtggtatttgatgtggattgttcgatcttgaatgactgaacaattgggcagcaactgttgcttggttc

SEQ ID NO: 24078 - protein, 474 aa, Panicum virgatum
  misc_feature: Ceres CLONE 1844436
  misc_feature (319)..(351): Pfam Name: Ank Pfam Description: Ankyrin repeat
  misc_feature (15)..(164): Pfam Name: BTB Pfam Description: BTB/POZ domain
  misc_feature: SWISSPROT Homolog: EC 2.4.2.30 NAD(+) ADP-ribosyltransferase
MSSEDSLKSLSLDYLNLLINGQAFSDVAFSVEGRLVHAHRCVLAARSLFFRKLFCGLDPNHQPPPPPPLGSPGARPAGAAPELVIPVSSIRYEVLVLVLQFLYSGQASVAAPKSGPLPGCGTRGCWHTRCGAAVDLALDTLAAARSFGVEQLALLVQKQLESMVKEASVDDVMKVLMASRKFEMQELWATCSHLVARSGLSADLLAKHLPIDVVAKIEEIRAKSPVAAANTPRSPFLTHHYLPINAASSAADRDHKIRRMRRALDAADIELVKLMVMGEGLDLDDALAVHYAVQHCSRDVVKALLELGAADVNSRAGPTGKTALHLAAEMVSPDMVSVLLDHHADPNARTLDGVTPLDVLRSLTSEFLFKGAVPGLTHIEPNKLRLCLELVQSAVMVTTRDEIEGAPGAGGEAGGSDGGNFPRSDADDSLVSLTMNSTLMYQGQEMAAAVAGDARKGNSGRGSPSNLYFPNGFP

SEQ ID NO: 24079 - DNA, 691 bp, Panicum virgatum
  misc_feature: Ceres CLONE 1844440
  misc_feature: Encodes the peptide sequence at SEQ ID NO. 24080
gcagatcgatcgagcaccccaaacttgcacacaatcaccatcagttctagtagacaagacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattacccttactggtttagcttttagctagtacactagaaaagggaagatctagagatcaaataattgaagctcatcaaatagtatggggaatggagctagctgctgtctagaataaaactgatggaatgcatgaataaacaatgctgtacgtcatgagtgtattatgcatttgaataaatgttcttctctatctgttatattttccgccggaacgaatcccaagaaacgatcttgatctcgatccgcgaggaagctagtcggccacccagccagagccagagcagcggcgcgatccaggagagccagccagccgccatgaacaacct

SEQ ID NO: 24080 - protein, 71 aa, Panicum virgatum; identical to SEQ ID NO: 19463
  misc_feature: Ceres CLONE 1844440
  misc_feature (12)..(71): Pfam Name: potato_inhibit Pfam Description: Potato inhibitor I family

SEQ ID NO: 24081 - DNA, 2919 bp, Panicum virgatum
  misc_feature: Ceres CLONE 1844442
  misc_feature: Encodes the peptide sequence at SEQ ID NO. 24082
aatttccgcgctccatatgcctccaaccaacgaccacttaaacacatcaccgcacacggccgccgcgggcagcccaccggccaccgccatcgatcaactcgggcggccacatacatgaccggcgccaccatgccacggcgacgtccagcttgtccgcgccgcggcgtcgtccctctccctctcctcctcctcctgcggctcggtgccgtcctcctgctcctgcttctgctcacccccgcgccggccgcctcatccgctcccgggaccaccaccaccgacacgatcacggcggccgcgccgctcgcggggaaccggacgctggtctcggcggggcggggcacgttcgtgctgggcttcttcgcgccggagggcggcgcggaggggcgcacgtacctcgggatctggttcaaccgcatccccgagcggaccgtcgtgtgggtggccaaccgcgggagccccgtgctgggccccgccgccggcgccgcgctccgggtcctccccaacggcagcctggccgtcgcgggcggcgacggcgcggtggtctgggccaccccgccgccgccggtgccgtcgtcatcagcggcgtccggcgacgcgatcggtgctgccgctaacgccactgcgcagctcctggaggacggcaacctggtgctgcgcgtcccgggggccggcgtggtgtggcaaagcttcgaccaccccaccgacacgctcctcccgggcatgaagctcggcgtcgacctccgcgcgggcctggaccggcacctgacctcgtggcgggcgcccggggacccgtccccgggggagtacaccttccgcctcgacccgcgcggctcgccggagctcttcctctaccgccgctccgcgcgcacctacggcagcgggccctggaacggcctccagttctccggcgtgcccaacctccgctccgccgccctcctcaccttccgcttcgtctccaagcccggcaccgaggccttctacagctacggcctcgccgacgacggcgccgccgtgctcacgcgcttcgtcgtcgacccctccggccaggtccggcgcctcgtgtggatcgacacgacgcgctcctggagcctcttctggtcctacccgctcgacgagtgcgacggctaccgcgcctgcgggccctacggcgtctgcagcgtcgaccgctcgcccatctgcggctgcgcgccggggttcgacccgcgcttccccgccgagtgggcgctccgggacggctccggcggctgccgccgccgcaccgagctcaactgcaccgccggcgacggcttcgccacgctcgccaacatgaagctgccggagtcggccaacgccacggtcgacatgtccctcggcctcgacgggtgccgccgcgcctgcctcgggaactgcgcctgccgggcctacgccagcgccaacgtcagcagcccgggggcgccggggtgcttcatgtggaccggcgatctgctggacatgaggcagttcagcaatggcggacaggatctcttcgtccgtctcgccgcgtccgatctacctctcagcacctcctcagcagagactaattcaaaaacggcaagggtcgtcgtgatcattgtcccatcggtcgttggactgctgttgctactagttggagtttgcatctgtgtcaagaaggtcaagaagcgccggaaggaagctactcccttaccgtcgaggaacgcacaaagcacgcctttcagacgaaggaaccagattgctgcatcgagtgacgctcaggacgattccctgcacaacggtcagggaaacaacaaggattgcgatctccgttcgttcgatgtggagaagatccaagctgccaccgacaacttttcgatccacaacaagattgggcaaggcggatttggcccggtttacatggggaagcttgacaacgggcaggacatagcggtgaagaggctgtcgcggcggtcgacgcaggggctccgggagttcaagaacgaggtcaagctgatcgccaagctccagcacaggaacctcgtcaggctcctcggctgctgcatcgacggctccgagaggatgctggtctacgagtacatgcacaaccggagcctcaacaccttcctcttcaacgaagagaggcagtcgatgctgagctgggagaagcggttcaacatcatcaacggcatcgcgcgggggatcctgtaccttcaccaggattcggcgctgaggatcatccaccgggacctcaaggccagcaacattctgctcgacagggacatgaaccccaagatctccgacttcggcgtcgcgaggatattcgggacggaccagaccgccgcttacaccaagaaagtggtcggaacatacgggtacatgtcccctgaatacgccatggacggggtcttctccaccaagtccgacgtgttcagcttcggcgtgctggtgctcgagatcgtcagcgggaagaagaacagagggttctaccacaacgagctcgacctcaacctcctgcgatacgcgtggaggctgtggagggacggccagagcctggagttcatcgacccgtccatcgcggacacgtccaacgccatggaggtgctcaagtgcatccagatcggcctgctgtgcgtgcaggagcagccgaagcgcaggccgaccatgtcggcggtgaccacgatgctgaccagcgagagccccacgctgccggagccgtgcgagccggcgttcagcacggggagaaaccaccacgacgacgacgaggaggacgacggcgaggaggacccggaggcgaaggcctgccggtccgacagcgccagcagctggactgtaaccgtagtggagggtagatagctagcgacggcagaaggaacagtgtttgcgttgcgatgtaaatacaaaaacattataacctcaacagcattggattcagttgttttaccaatt

SEQ ID NO: 24082 - protein, 898 aa, Panicum virgatum
  misc_feature: Ceres CLONE 1844442
  misc_feature (236)..(364): Pfam Name: S_locus_glycop Pfam Description: S-locus glycoprotein family
  misc_feature (572)..(843): Pfam Name: Pkinase Pfam Description: Protein kinase domain
  misc_feature (98)..(222): Pfam Name: B_lectin Pfam Description: D-mannose binding lectin
  misc_feature (381)..(448): Pfam Name: PAN_2 Pfam Description: PAN-like domain
  misc_feature: SWISSPROT Homolog: EC 2.7.11.1 Non-specific serine/threonine protein kinase
  misc_feature: Useful for making plants with altered cell wall content and/or composition
MPRRRPACPRRGVVPLPLLLLLRLGAVLLLLLLLTPAPAASSAPGTTTTDTITAAAPLAGNRTLVSAGRGTFVLGFFAPEGGAEGRTYLGIWFNRIPERTVVWVANRGSPVLGPAAGAALRVLPNGSLAVAGGDGAVVWATPPPPVPSSSAASGDAIGAAANATAQLLEDGNLVLRVPGAGVVWQSFDHPTDTLLPGMKLGVDLRAGLDRHLTSWRAPGDPSPGEYTFRLDPRGSPELFLYRRSARTYGSGPWNGLQFSGVPNLRSAALLTFRFVSKPGTEAFYSYGLADDGAAVLTRFVVDPSGQVRRLVWIDTTRSWSLFWSYPLDECDGYRACGPYGVCSVDRSPICGCAPGFDPRFPAEWALRDGSGGCRRRTELNCTAGDGFATLANMKLPESANATVDMSLGLDGCRRACLGNCACRAYASANVSSPGAPGCFMWTGDLLDMRQFSNGGQDLFVRLAASDLPLSTSSAETNSKTARVVVIIVPSVVGLLLLLVGVCICVKKVKKRRKEATPLPSRNAQSTPFRRRNQIAASSDAQDDSLHNGQGNNKDCDLRSFDVEKIQAATDNFSIHNKIGQGGFGPVYMGKLDNGQDIAVKRLSRRSTQGLREFKNEVKLIAKLQHRNLVRLLGCCIDGSERMLVYEYMHNRSLNTFLFNEERQSMLSWEKRFNIINGIARGILYLHQDSALRIIHRDLKASNILLDRDMNPKISDFGVARIFGTDQTAAYTKKVVGTYGYMSPEYAMDGVFSTKSDVFSFGVLVLEIVSGKKNRGFYHNELDLNLLRYAWRLWRDGQSLEFIDPSIADTSNAMEVLKCIQIGLLCVQEQPKRRPTMSAVTTMLTSESPTLPEPCEPAFSTGRNHHDDDEEDDGEEDPEAKACRSDSASSWTVTVVEGR

SEQ ID NO: 24083 - DNA, 1291 bp, Panicum virgatum
  misc_feature: Ceres CLONE 1844464
  misc_feature: Encodes the peptide sequence at SEQ ID NO. 24084
attgccctgcgcagcggatcggagctcgccgcagccaccgtacctaccacacggccggatttgactcgtgtcgggcggaggaagcaagatggatgtggagagccgcgcggcggcgccggaggcggaggacgtcgccgtcgactggcgcggccggccgtgccgcgcgcaccggcacggcggcatgcgcgccgccatcttcgtcctagggatccaggcgttcgagatcatggcgatcgcggcggtggggaacaacctcatcacgtacgtgttcggggagatgcacttcccgctgccgcaggcggccaacgtggtgaccaacttcgtcggcaccatcttcctgctcgccctcctcggcggcgtcctctccgactcctacctcggctgcttctggaccatcctcaccttcggcttcgtcgagctctctggcttcatcctgctgtcgctacaagcgcacctgccgcagctgaagccgccgccgtgcagcatggtggcgtccgcgggcggcggctgcgagaaggcccggggcttcaaggccaccgtcttcttcctcgcgctctacctggtggcgctcggcagcggctgcctcaagcccaacatgatcgcgcacggcgccgaccagttcgacgccgccgcgccgggcggcgccgggaggctctccacctacttcaactcggcctacttcagcttctgcgccggcgagctcgtcgccctcacggcgctggtctgggtgcagacgcactccgggatggacgtcggcttcggcatctccgcggccgccatggccgccgggctcctcagcctcgtctccggcgccgccttgtaccggaacaagcccccgcggggcagcatcttcacccccattgcaagagttttcgttgccgcctacagcaagaggaagcaagtgtgcccatccagatccaattctgtcaatgccggaggagcttgcgagccggcacgcctcgccggcaacttccgccacaacaacaagttcaggttcctggacaaagcatgcatccgggtagcgcagcaggggcccaacacgaagccggagagcccgtggcggctgtgcacggtggcggaggtgcagcaggccaagacgctcctcgccgtgacgcccatcttcgcgtgcaccatcgtcttcaacaccgtgctggcgcagctgcagaccttctcggtgcagcaggggagcgccatggacacctcgctcctgccgggctcctccttccacatcccgccggcgtcgctgcagggcatcccctacgccatgatgctggcgctcgtcccggcctac

SEQ ID NO: 24084 - protein, 400 aa, Panicum virgatum
  misc_feature: Ceres CLONE 1844464
  misc_feature (100)..(400): Pfam Name: PTR2 Pfam Description: POT family
MDVESRAAAPEAEDVAVDWRGRPCRAHRHGGMRAAIFVLGIQAFEIMAIAAVGNNLITYVFGEMHFPLPQAANVVTNFVGTIFLLALLGGVLSDSYLGCFWTILTFGFVELSGFILLSLQAHLPQLKPPPCSMVASAGGGCEKARGFKATVFFLALYLVALGSGCLKPNMIAHGADQFDAAAPGGAGRLSTYFNSAYFSFCAGELVALTALVWVQTHSGMDVGFGISAAAMAAGLLSLVSGAALYRNKPPRGSIFTPIARVFVAAYSKRKQVCPSRSNSVNAGGACEPARLAGNFRHNNKFRFLDKACIRVAQQGPNTKPESPWRLCTVAEVQQAKTLLAVTPIFACTIVFNTVLAQLQTFSVQQGSAMDTSLLPGSSFHIPPASLQGIPYAMMLALVPA

SEQ ID NO: 24085 - DNA, 624 bp, Panicum virgatum
  misc_feature: Ceres CLONE 1844465
  misc_feature: Encodes the peptide sequence at SEQ ID NO. 24086
gctttagcctccccgtccaaaccctagatccccttcgccgcggtggtggcgcccgcggtgacccggcggggcggcggaggggatggcggccgtgccggaggacctccgctgcaagcgctccgacggcaagcagtggcgctgcggcgcgccctccgtgcccggcaagaccgtctgcgagaagcactacgtccaggccaagaggcgctccgcctcctccgcgctccgcgcaacgctccgctcatccgcctccgccgccggcggtgtgcccgccacgcccttccgctccgccgccgccacggcccgcctccacgacggggcccgccccggccagccgccgatggcggtcgcgaggcccgtctacgccagggtcgccggagagagggtgtacgtggcggagcccgtgccggcgccggcgctggcgtggaggggcccggcgtacgacggcctgcccctgggcaatgctgctggcgcgcgctccgcggcggagctggtcgggagaggcccggcgtggtcgacggacgcaggcctggcagggacgacgaattgccaccagtgtcgcaagactggggccgtcctttggtgctccagctgcgacaggagaggctactgtgcccgctgcttctc

SEQ ID NO: 24086 - protein, 180 aa, Panicum virgatum
  misc_feature: Ceres CLONE 1844465
  misc_feature (4)..(49): Pfam Name: WRC Pfam Description: WRC
MAAVPEDLRCKRSDGKQWRCGAPSVPGKTVCEKHYVQAKRRSASSALRATLRSSASAAGGVPATPFRSAAATARLHDGARPGQPPMAVARPVYARVAGERVYVAEPVPAPALAWRGPAYDGLPLGNAAGARSAAELVGRGPAWSTDAGLAGTTNCHQCRKTGAVLWCSSCDRRGYCARCF

SEQ ID NO: 24087 - DNA, 810 bp, Panicum virgatum
  misc_feature: Ceres CLONE 1844465-R
aatattcaaaattaattggatcgctaaacttgtaaaaagtactgaagaaatggtcaatggttgcaaagtatatgatctgcaggatggatgtttttcttacagtgatggcagacagttagcgttaattggtcagcaagaccttggtctctcaaaatgctcgaacagtgatgatattagcaggaattgtgtgtactctcctgtattggaggacttaaaacatgaaggcatcatgcagtttcgtaagcattggataaaggcagagcctattgtcatcagaaaagcatttgagccttccctgtcatcaatctgggaccctttaagtatttggagaggtatccaggagataatggatgaagaaatggatgaaaatgtaatagtcaaagctgtggactgctcaaaccaatctgaggtggatatcgagctcaaacagtttatcaaaggttattcagatggcaacaaggggggtgatggccgcttgttgatgctgaaattgaaagagtggccccagcccagtgtcttagaggagtttctgttgtgccagagaccagaatttattgtcaactttcctcttgttgattttattcatcctagatggggtctcctaaatcttgctgccaagttaccccacgatgatgcattacagcctgaagtagggatgaaactgctaattgcatatggaagtcgtcaagaacttggtaaaggtgatccagtgatgaatctaacgattaacatggttgatgtggttcacatgttaatgcatgcagctgaagtacatgaccaatgtcccaagaggccaccttttgttgcgcg

SEQ ID NO: 24088 - DNA, 2088 bp, Panicum virgatum
  misc_feature: Ceres CLONE 1844473
  misc_feature: Encodes the peptide sequence at SEQ ID NO. 24089
actgcctctgcctgccttgctcttgctggcacatcacgttggcgagcaggcgaatcaatcgccggtaaccccgttccgcctcccctccgacgtggtcctcccagagggggcgaacgaggatgttctggcacggggtcgcggaccggctgacggggaagaacaaggaggcgtggaacgaggggaagatccgcggcacggtggtgctggtcaagaaggaggtgctggacgccggggacttccacgcctcgctgctcgacggcgtccacaggatcctcggctgggacgagggcgtcgccctgcggctcgtcagcgccaccgccgccgaccccggtaagcgctgacgcccccctcccccctctgtctccagagttcagacaccgctcctgggccctggcccgcgcgcggcggccgcgggggtaagagtaagacgccgcccccgccggccgcgtgcggcggcggaaacgtacggcgcgcgccccccactgtgcgtttttcgccgcccatttcggtttcctttttttgctcgtagttgtctcggcctcgggttttctagccgtttggtgccaaaattgatttccccccaaaacaaaggccgatcttgccggagacattccgctagtgaaaaatctgcagaatccgtgttcgtccaacaaaatctgtgatcaccatggatggcgacatggcaagggggcatgagcaggggatagagcttttcgcgttttcccgtggcagcccagaggaagagcaacttgatcgaacccgtggggacccaattttcattgcccgaatggaaatccgtcggaggagttggggggcattcaatgcaattgggacggggcaagtagccacacagcgcaacacgacacggggaacctgagagagagattcgctgtaagcttacacggcaatactccaaaaggttatccgcatcacccgcgcactgctgtcgcgaattgatggggacgcgcaggcgctcagggcccttggattttttttactgaaattctgcagggagcattttatttgaattttgttgctgcggcagtttgtgtgagctgaatttcgcctgtcgtgggtcgatcgcaggcaatggagaccgggggaaggcggggaaggcggcgcacctggaggaggcggtgctgtcgctcaagtccaggacggacggggagacggtgttccgggtgaacttcgagtgggacgagtcgcagggcatcccgggcgccgtcctcgtcaggaacctgcagcacgccgagttcttcctcaagagggtcaccctcgagggcgtccccggcaagggcaccgtcgtcttcgtcgccaactcgtgggtctacccgcaccacctctacgcccaggaccgcatcttcttcgccaacgacgtgagtactacccccgttctgcttctgacacctgcatcttcctcttgctgctgcgtcacggatgcccagtgcattgtgcaaacaaagttgcgtttttgctgcttagaaacaaaaaaagcttcagtgatcaagttccaaatggtaataagaagagctcttgctattgagcctaatcaacctatcttagtttgattgaaatgaaatatggttgtggactatggatcattggattggagtgctggatgctggtcaactttccagttttaaaagcctgtgattggattatgtaccatgttaggtgtactgtgtacctagtagatcctaatgacacgcaatatgtctactgaaaagtacaaagtggcagactaaaatactccggtattaacccactttaaatattactactaagtaggataaaccctgtttagccgccaaattggcgagaatggtcttccggctatgtccacatatggctcatgttgatccagaactggttgacgagtctcaaaagcaacataacaagtctagtaaaaaaaaacccataaatgtctctcaataataatgtaaagaaaagaaggtttgtttcagtaccattgcagaatgaacacccctgaattctgatttacctcatgttgcaccatattaagtacacagattaatccagagtggaaacaatctaacagttgatatgactagataatttgctgagcgg

SEQ ID NO: 24089 - protein, 73 aa, Panicum virgatum
  misc_feature: Ceres CLONE 1844473
  misc_feature: SWISSPROT Homolog: EC 1.13.11.12 Lipoxygenase
MFWHGVADRLTGKNKEAWNEGKIRGTVVLVKKEVLDAGDFHASLLDGVHRILGWDEGVALRLVSATAADPGKR

SEQ ID NO: 24090 - DNA, 2124 bp, Panicum virgatum
  misc_feature: Ceres CLONE 1844475
  misc_feature: Encodes the peptide sequence at SEQ ID NO. 24091
aaaaaatataaacagccttcttcccttcccgttccacccgcaccacttcactcttctcccccctcttcacctcttcttctcgtagatctcccggggtcgccgtctccggccacggcggccggcactcggaggagcggcggggctcggggcggaggtcggcggccatgtacaagaaccagctgcaggagctggcgcagcggagctgcttcaacctcccggcgtacacgtgccttcgggaggggccggaccacgcgccgcggttcaaggcggcggtgaacttcaacggggagcagttcgagagccccgggttcttcaccacgctccgccaggcggagcacgccgccgcggaggtcgcgctcgcggcgctcgcgcagcgcggcccgtcctactcgctcgcggcccgcatcctggatgaaacaggggtttataagaaccttctacaggaagtagctcagagagttggagcgccgttgccttcatatacaacagagcgatcaggccttggccacctgccagttttcacatgcacagtagagctcgctggtatcacatttacaggtgatcctgctaagaataagaaacaggctgaaaagaatgctgcttcagcggcatggtctgcactgaaacaattggtacgtgatgaagcgaattcatccaatgagccggaaaataatgatgagcaggagcagatcaggattgctcgagcccttctcaattatcgcttgaaagagaagatggcaatggccaattatccccatgcttcgccgtttcccaagaagtttcctatgcagccagagagaaagccttcttttggccaaccttcccagtccagctactcgaagatcctccctctattccgccctaaatcaaattcaagatgcagaccagagtcaccagcatctgctgatggagcatctcaaacggctgtacggaccatggaaagcattaatccgaagtcaagatttccagcggcagaggcagccccctatgtgccagttgggcactaccgtatgccttgccatagcatggctccttcagtcacaatcaggactgccgtacctgtgttctctgctccacctctcccacctcctgctgcacgcactcagcagcagcagcagcaacttcctcctctcatgagccacccaccacctattcggatggtgtctccagttcgcatcaggccagggccaccatcctccatgtttggaccctccgctccagttcagggtccgaagcctgtgatgtctgttcagctgaaggatgtgcaacagcaatcgaggagggaacctgtttcacctctgatccctgttcaggtaaaggatgtgcgataccgaccaatgaagggatcagtgtcacctgggattccaattcaggtaaaggatgcacaacgccagccccttatgggatcgctgtctgctgcaatcccaattcagatgaaggatgtgcaaacccaagcaccgaaaccgaaggaatcactggctgctccaattccagcaatcaagtcttcggttaagatcgagacccctgctcaaaccaaggaagcttcagcaatagttacccgtgaagccccatgttctgctgctggcaataccaccgctgcggaatgcactacatcatcagacgttaccttgacaaggcaatcaaggactgcggatggcgacggcagcaaggcggaagctgagcatgaggccgaggctcaagcagtggcagaggcggccatcaggcagctggagatcaattgactttgaaaaaaaaatgctcgtcgccatcttctcccagattttgtaattagctgcctcccgtgcacatttcgttctgtttagttcttggtatgtcttgggttcaattagggctgtctgggcaagctgcgttgcggtagggaacacctaggttttctattcgtcaaaaaaaaatcttgaaaaaacacatgtagtggtggtaggtggtttgcccagtgtttggttggagacggttatacttccctggatatgcagttggtctgcattttaccccaatgatgaggtggattgtgaggtgcctctagggaaggattatgaggcggcttttacatctaaattctgttatcattgtcggtccgccgtaatttctgttctgcttcttttt

SEQ ID NO: 24091 - protein, 525 aa, Panicum virgatum
  misc_feature: Ceres CLONE 1844475
  misc_feature (88)..(153): Pfam Name: dsrm Pfam Description: Double-stranded RNA binding motif
  misc_feature (2)..(68): Pfam Name: dsrm Pfam Description: Double-stranded RNA binding motif
MYKNQLQELAQRSCFNLPAYTCLREGPDHAPRFKAAVNFNGEQFESPGFFTTLRQAEHAAAEVALAALAQRGPSYSLAARILDETGVYKNLLQEVAQRVGAPLPSYTTERSGLGHLPVFTCTVELAGITFTGDPAKNKKQAEKNAASAAWSALKQLVRDEANSSNEPENNDEQEQIRIARALLNYRLKEKMAMANYPHASPFPKKFPMQPERKPSFGQPSQSSYSKILPLFRPKSNSRCRPESPASADGASQTAVRTMESINPKSRFPAAEAAPYVPVGHYRMPCHSMAPSVTIRTAVPVFSAPPLPPPAARTQQQQQQLPPLMSHPPPIRMVSPVRIRPGPPSSMFGPSAPVQGPKPVMSVQLKDVQQQSRREPVSPLIPVQVKDVRYRPMKGSVSPGIPIQVKDAQRQPLMGSLSAAIPIQMKDVQTQAPKPKESLAAPIPAIKSSVKIETPAQTKEASAIVTREAPCSAAGNTTAAECTTSSDVTLTRQSRTADGDGSKAEAEHEAEAQAVAEAAIRQLEIN

SEQ ID NO: 24092 - DNA, 1260 bp, Panicum virgatum
  misc_feature: Ceres CLONE 1844482
  misc_feature: Encodes the peptide sequence at SEQ ID NO. 24093
  misc_feature (1174)..(1174): n is a, c, t, g, unknown, or other
gagcccgcatccgctctgctagcctcaaactctctcagatcccacgaattcagctcaggccctttcgtcgtcgggcactgcagattcctttatacgctctcaacacatcttaaatccctgaacgctattcagatatactagcgagttcagcagcttgagcggttatgtctgtgcattagctagttcttgtagttccctgtgatgatggagccaccatcttcctcccgctgccagcttcacggctctggctctgccatgatacggcggcgatgtctcttcctcctcctgctgctacttgctcttcagagttgccgcagcccgacacttgcaacctcgccgtatctggtcggcatgggcagctacgacataacggggcccgcagcagacgtcaacatgatggggtacgcgagcgccgagcagatcgcagcagggattcacttcaggctcaaggcacgcgcgttcatcgtcgccgagcctggtggcaagcgtgccgtctttgtcaaccttgatgcctgcatggcgtcgcagcttgtgactgtaaaggtgcttgagaggctaaaagcaaggtacggtgatctttataacgagaacaacgtggctatcagcggaatccacactcatgccgggcctggaggttatctgcagtatgtggtttacattgtcacatctcttgggtttgttcgccaatcctttgacgtaatcgtcaacggcattgagcaaaccattgttgaagctcacaataatctccgtcctgggaaaatatatgtgaacaaaggtgacctccttgatgctggtgtgaatcgcagccccggcgcatacctaaacaacccagctgaggaaagaagcaaatacccgtacaatgttgataaggaaatggcccttatcaagtttgtagacgatgaacttggtccagttgggagtttcaattggttcgcaacccatggaacttcaatgagtcgtacaaattctttgatcagtggcgataacaaaggtgcagctgcacgtttcatggaagattgggcggaagaaaatgtcatcccaaatcaggctgctcatgcaagctctggaaatccgagaagagtctctgcactaatttctgagcccaatgagatgacggatgacttagtacgatcggcatcgtcctacaaggcctctggtggaaggcaaatatcangttcaaatgtcaccaggcgtattagaagcactcaacaaaataagcctaattttgtttctgcattctgccagtcaaactgtggggat

SEQ ID NO: 24093 - protein, 302 aa, Panicum virgatum
  misc_feature: Ceres CLONE 1844482
  misc_feature (1)..(299): Pfam Name: Ceramidase_alk Pfam Description: Neutral/alkaline non-lysosomal ceramidase
  misc_feature: SWISSPROT Homolog: EC 3.5.1.23 Ceramidase
  misc_feature (275)..(275): Xaa is any aa, unknown, or other
MGSYDITGPAADVNMMGYASAEQIAAGIHFRLKARAFIVAEPGGKRAVFVNLDACMASQLVTVKVLERLKARYGDLYNENNVAISGIHTHAGPGGYLQYVVYIVTSLGFVRQSFDVIVNGIEQTIVEAHNNLRPGKIYVNKGDLLDAGVNRSPGAYLNNPAEERSKYPYNVDKEMALIKFVDDELGPVGSFNWFATHGTSMSRTNSLISGDNKGAAARFMEDWAEENVIPNQAAHASSGNPRRVSALISEPNEMTDDLVRSASSYKASGGRQISXSNVTRRIRSTQQNKPNFVSAFCQSNCG

SEQ ID NO: 24094 - DNA, 667 bp, Panicum virgatum
  misc_feature: Ceres CLONE 1844482-R
  misc_feature: Encodes the peptide sequence at SEQ ID NO. 24095
ccacaccttaagtgcctacattcaagagtttcagaggctcgctacagctatggtctcaaacaaagaggtcccaacaaatttgcagccccctgatctgctgaacaggcaaattgagctactcccaggtgttatagtcgacaagacgccttccggcgtcacgtttggagacgtcagttcggatgttcctgcaaactcaactttcaggaagggcagcaccgtgaacgctacgttctattcggcctgcccaaggaatgacctcctcactgacggtaccttcgcactagttgagaagctggatggtggcagcgattgggtccctgcctatgacgacgacgattggtctctgcgcttcaagtggtcgaggccgtcacgactgagcccgaacagttttgcgactctggagtggacagttcctgaagatgctccaccgggtgtttacaggttgaggcattttggtgcatccaagccgttgattgggtcgatcaaatattttacagggacctctagtgcattcgtagtacgttaaatggtaaaaagtatgaaatttgcgccggccaatacttgtacatgtttttcccttctggtttttacatgtatccgatgctaataacgttaccaaatcattccaaaccactgctcttgacccagctaatttacggccagccgt

SEQ ID NO: 24095 - protein, 174 aa, Panicum virgatum
  misc_feature: Ceres CLONE 1844482-R
  misc_feature (1)..(174): Pfam Name: Ceramidase_alk Pfam Description: Neutral/alkaline non-lysosomal ceramidase
  misc_feature: SWISSPROT Homolog: EC 3.5.1.23 Ceramidase
HTLSAYIQEFQRLATAMVSNKEVPTNLQPPDLLNRQIELLPGVIVDKTPSGVTFGDVSSDVPANSTFRKGSTVNATFYSACPRNDLLTDGTFALVEKLDGGSDWVPAYDDDDWSLRFKWSRPSRLSPNSFATLEWTVPEDAPPGVYRLRHFGASKPLIGSIKYFTGTSSAFVVR

SEQ ID NO: 24096 - DNA, 2137 bp, Panicum virgatum
  misc_feature: Ceres CLONE 1844485
  misc_feature: Encodes the peptide sequence at SEQ ID NO. 24097
caattgatctgccaactgaaggggctggggagctctactgtgtcttacccccaagaaatggtcattctggcaggagtattggtgattctaagcgttcaactgtgagttggaaaggcgctaaaccatccaagtcggcgcttgaaggggatgacgacctgtactgccggctgcctaagaatggacgttcgggtaggagttctgggggatccaaacgttctgttggtataaaaggtgtgattaggcgtagcagcagtttctccagtcatattcgtgtgaactcggagacatcacctagtaagagggatggctcagtttgcatggctactactgaacggtcatcctctactgtatccacagaagctgaggattcaccaaattactctgcacgaaatgctgaaactcacttgagttctccaatgtcattgagaaggatgatagaaggaagatccgaccgctgccacctccgtaggaggatcttcagccatcacagaagctcatcttttgaatgggcaaaaatctcaatggttcaatgggcaatgaggcttccaagccgttacacttcagtccacccagacagcaaactattgaaatcggatgcaagtccaaggttgaactgtgattctgaaactgaatccacttcagctgttgagccagaatctatgttttctttcgctttctatgatgtagcatggcctccaagtgaattggaattgcttcgacagaagtattcttcagtttgcaggttgtttggttacgaagaactcaaacttgcaacatccaactattcacctgatatgctaattggaaaaggtggaaccagccaagtttacaaggcacaactatatgatggaacatattctgccataaagattctgaaaccctcgattgatgcaatacatgagtttattacagagattgagattgtaaccagcttgcaacatgacaacattgtcgcactaaggggattcagctttgagaactacaatcttgtgttggtatatgatcacatgtccaaaggaagcttggacaaagctcttcatggtaagcctcaaggaaataatgacgacaataattttcttatctgggagaggagaaataagatagcaatcgacattgcaagagcacttgaattccttcatcttggcggtgtgacccaatctgtgattcatggcgatgttaagtcttcaaatgtcctcctttctgaggattttggggcaaggctctgtgattttgggttagcaaagcaagtgtcagcttcgactccccacctaacatgtactgacatcaccggaactttcgggtacttggctcccgaatatttttcgtatggtaaggtcaatgagaagattgacgtctatgcttttggagtcgtactgctagagattatttcaggaaggagacccattacaccaggaactgcaaagggccaggaaagcctggttggttgggcaaagcccttgctgtccagtggagaaattaaacagctgattgacccatttctggggaacgattatgactgcgatgaaatggagaggatgacgctggccgcttcgctgtgcacaaggacatcctctcattctagaccagaaatgtcactggtcctgaaactgctccaaggggacgacgaaacaatcgcttgggcacggtcgcaggtcaccgccagcttcgacggttcggatgaggagatctcaacccctgagtcgaacatgcagtcgcatctgagccttgcgctgctcggggtggaggacgacacgctctcgcgctgcagcagcaccgtggacacctcggccgacggctactggagccggtcgtcgagcttcgactagcaccctcaatctccagagttgtgtgtacagattccatgtgtttgggggtgattggcgagatgattgcgtccgggcagtggaaaacagaggcctgcctgcttattagttgggagatgcgggggtcgtcgcgttgctaatttagttaggaagttgattttgttgtagatctaaccctgctggccctggccctacgatgcagttgttgttctgttatcatttagggaaatttgtctgtggcacatccccgaatggtgaatttatgcacagcacactccactctttgaaattgtgcacaacacactccattcttc

SEQ ID NO: 24097 - protein, 607 aa, Panicum virgatum
  misc_feature: Ceres CLONE 1844485
  misc_feature (261)..(537): Pfam Name: Pkinase Pfam Description: Protein kinase domain
  misc_feature: SWISSPROT Homolog: EC 2.7.11.1 Non-specific serine/threonine protein kinase
IDLPTEGAGELYCVLPPRNGHSGRSIGDSKRSTVSWKGAKPSKSALEGDDDLYCRLPKNGRSGRSSGGSKRSVGIKGVIRRSSSFSSHIRVNSETSPSKRDGSVCMATTERSSSTVSTEAEDSPNYSARNAETHLSSPMSLRRMIEGRSDRCHLRRRIFSHHRSSSFEWAKISMVQWAMRLPSRYTSVHPDSKLLKSDASPRLNCDSETESTSAVEPESMFSFAFYDVAWPPSELELLRQKYSSVCRLFGYEELKLATSNYSPDMLIGKGGTSQVYKAQLYDGTYSAIKILKPSIDAIHEFITEIEIVTSLQHDNIVALRGFSFENYNLVLVYDHMSKGSLDKALHGKPQGNNDDNNFLIWERRNKIAIDIARALEFLHLGGVTQSVIHGDVKSSNVLLSEDFGARLCDFGLAKQVSASTPHLTCTDITGTFGYLAPEYFSYGKVNEKIDVYAFGVVLLEIISGRRPITPGTAKGQESLVGWAKPLLSSGEIKQLIDPFLGNDYDCDEMERMTLAASLCTRTSSHSRPEMSLVLKLLQGDDETIAWARSQVTASFDGSDEEISTPESNMQSHLSLALLGVEDDTLSRCSSTVDTSADGYWSRSSSFD

SEQ ID NO: 24098 - DNA, 583 bp, Panicum virgatum
  misc_feature: Ceres CLONE 1844493
  misc_feature: Encodes the peptide sequence at SEQ ID NO. 24099
gccaataaggtgctcctggggaaacaagccaactccaccagggacagcatcttcgccgctcccccctccagcaccgtctccattccccaccggcgtgtcggcaactgacttccttgcctaccagcgcctggccctgagcaagattgccgcgaacccagccctaatgggccagcacgccctgaagcaggctgcactggggatggacgccggggccagccaggttatctatgacggcggctaccctggcatcaacgctgcagctgcagctcagcagcagcagcagcaacagcagctcatgtacttctagagtgacggcgaagccccagctacctgtcgctgcaggaggaaggcgaggatgatgccccagttacagccccccatatacatatactagtagtaccatagtagatcaagccttaccaggaccttcttttatttacctttattaatctttcgttaaccatctaagtaacttgtcctgtatgccggctctctatatatattcaccaccgtagaacatatatatgtatttctagagacatggaaaccaagtctgagctggtgtcccgctggctttcttagt

SEQ ID NO: 24099 - protein, 101 aa, Panicum virgatum
  misc_feature: Ceres CLONE 1844493
  misc_feature: Useful for making plants with altered lignin content
PIRCSWGNKPTPPGTASSPLPPPAPSPFPTGVSATDFLAYQRLALSKIAANPALMGQHALKQAALGMDAGASQVIYDGGYPGINAAAAAQQQQQQQQLMYF

SEQ ID NO: 24100 - DNA, 550 bp, Panicum virgatum
  misc_feature: Ceres CLONE 1844501
  misc_feature: Encodes the peptide sequence at SEQ ID NO. 24101
ggacacaccagctccccgcacccgcagtgccaccagccttccacttcctgcagctgccatggctgccactcccgtgtccatgccccgcatcaagctgggctcgcagggactggaggtctcggcgcagggcctcggctgcatgggcatgtcggccttctacggccctcccaagcccgagcccgacatggtcaagcttatccaccatgccgtcgctgccggggtcaccttcctcgacacctccgacgtctacggcccgcacaccaacgagatcctcctgggcaaggcgcttcaaggtggggtacgggagaaggtcgagctggccaccaagttcggcgcctcctttgccgacgggaaatgggagatccgtggcgacccagctttcgtgcgggcggcgtgcgagagcagcctcaagcggctcggcgtcgactgcatcgacctctattaccagcaccgcgtcgacaagagggtgcccatcgaggtcacggtgagtagtagtccttgcgcactttgatttctttatttggtagctatggaggcttcatgtgaacat

SEQ ID NO: 24101 - protein, 150 aa, Panicum virgatum
  misc_feature: Ceres CLONE 1844501
  misc_feature: SWISSPROT Homolog: EC 1.1.1.65 Pyridoxine 4-dehydrogenase
MAATPVSMPRIKLGSQGLEVSAQGLGCMGMSAFYGPPKPEPDMVKLIHHAVAAGVTFLDTSDVYGPHTNEILLGKALQGGVREKVELATKFGASFADGKWEIRGDPAFVRAACESSLKRLGVDCIDLYYQHRVDKRVPIEVTVSSSPCAL

SEQ ID NO: 24102 - DNA, 2148 bp, Panicum virgatum
  misc_feature: Ceres CLONE 1844512
  misc_feature: Encodes the peptide sequence at SEQ ID NO. 24103
aaattgctcgcagctcctcggctcgtcgctccctcccgctcccggcgagttttttctagggcttcaggaggggcagcgccacccgcgtgttcccaccccgcgcttccggttcctccgcactcgcatcgtggagacagggggggcaagggcgtggcgcggcgggcgggcgggcgggcgcgtggggttcccatttgcgccggtctcttcattcgacccccgtttgcgaggataggggtcgcgccgaggcggcggcggcggcggctgcgcgatgaacgcgcctgtagtcgatccatatcagggggaatttcccgagacaatcgaggagtacttgcatcatggtactatgaaatgtattgcgtttaaccgtacaggaacacttttggctgctggatgctcaaatggtagctgtgttatctgggactttgaaacaagggggcttgcaagagaatttcgtgataaagattgcactgcacctataacaaccgtatcctggtccaggtatggccaccgtttgcttgcctctgctactgacaagtcattgacactttgggatgtgtcaactggggaaaagattgaccgcataactctccagcagactccattacgtgccagtcttcaacctggttctccaacctcatctatttgtttggcatgtcctctgtcttctgcacctcttcttgttgatttgaatactggaagtaccacggtcctccctgtttctgtatctgagaatggtaacccacctgcacctaatccccgtaataaattcgcggatggtaccccaccttttacaccaacagctgcaacgtttgataagcatggggatctgatatatgtgggcaactctaagggagaaattttgatcgtagattcaaaaaccatccaggtacatgcagtaattcccatccctggtggaactgttgtcaaggatattgttttaagccgggatggtcaatatcttctgacgaattctaacgatcggatcattagagtctacaaaaatattctgcctgttaaaggttctggagaggagattagaaacataagcaacaacagtaatggctatggaagtcactatgataagttaaaagcaaatggtgcaagctgccttattctttcctgtgagctttcagatgccatcacaaagatacagtggaagacaccatgctttagtggtaatggtgagtggatagtcggtgcttctgcaaacaaaggagagcataggttgcaaatatgggaccaaacagggcgacttgtaaagatccttgatggtccgaaggaagctctcattgatcttgcctggcaccccgttgaacctacaattgctacagtatctgtaacaggctttgtatacatttgggccaaggagcatgtagaaaactggagtgcctttgctcctgattttgtagaattagaagaaaatgaagagtatgttgaacgagaggatgagtttgatctgaacccacgtgaagaagaggctgaggaagtagtgatagatgagaatgctgaaattgatatcgagacatttgagaagaacacagttttcagtgacgtggaggattctgtggatgaggttgtcttcttgccagctattccttccccagatgctcctgacgagcagccagagaaatgtcttggaagctcatcaaagttggaggatagcaaccattctggttcaccatcctcaatggatgctgtacagaatggtcaaactgttcctcaggcgtcaagcccaatggaagtggacaactctactgctgaagacccagctgaagggccaaactcaaagcggaagcggcggctgtccgtgaaggggcttgagttgcagcagtctgagaaggtcaaaaagccagcagcaaagaacaagtccaacggcaagtcaacaaaatccagtgccaagcagatggaatctgccaatggaaacagcgccgcctttgatgatgaagcaactgaggacgatgaggttaacattgatagctagtttttctgactgaggacataggcggggaaatagaaaaggctgttctgtattccctccaaatggaagataactactatgtgctgagacaaatcaaacctattaggtatcagtgttgttggctgtaagttgatatttgcagtttcatgttaagaaaaagatattcgctg

SEQ ID NO: 24103 - protein, 570 aa, Panicum virgatum
  misc_feature: Ceres CLONE 1844512
  misc_feature (14)..(51): Pfam Name: WD40 Pfam Description: WD domain, G-beta repeat
  misc_feature: SWISSPROT Homolog: EC 2.3.1.48 Histone acetyltransferase
MNAPVVDPYQGEFPETIEEYLHHGTMKCIAFNRTGTLLAAGCSNGSCVIWDFETRGLAREFRDKDCTAPITTVSWSRYGHRLLASATDKSLTLWDVSTGEKIDRITLQQTPLRASLQPGSPTSSICLACPLSSAPLLVDLNTGSTTVLPVSVSENGNPPAPNPRNKFADGTPPFTPTAATFDKHGDLIYVGNSKGEILIVDSKTIQVHAVIPIPGGTVVKDIVLSRDGQYLLTNSNDRIIRVYKNILPVKGSGEEIRNISNNSNGYGSHYDKLKANGASCLILSCELSDAITKIQWKTPCFSGNGEWIVGASANKGEHRLQIWDQTGRLVKILDGPKEALIDLAWHPVEPTIATVSVTGFVYIWAKEHVENWSAFAPDFVELEENEEYVEREDEFDLNPREEEAEEVVIDENAEIDIETFEKNTVFSDVEDSVDEVVFLPAIPSPDAPDEQPEKCLGSSSKLEDSNHSGSPSSMDAVQNGQTVPQASSPMEVDNSTAEDPAEGPNSKRKRRLSVKGLELQQSEKVKKPAAKNKSNGKSTKSSAKQMESANGNSAAFDDEATEDDEVNIDS

SEQ ID NO: 24104 - DNA, 1362 bp, Panicum virgatum
  misc_feature: Ceres CLONE 1844515
  misc_feature: Encodes the peptide sequence at SEQ ID NO. 24105
accctaccgcggcgcttgttcctgtccaggcgtccatgcctcccgtccgtctgaccgtctcgaccttcccatcgcattcccctcaccccgtctctctctctctctctctctctctctctctctcgcagcggcgacgcctcgggagctcctagggcctgccccttctccggccgccatatccgccgccgcccgatccgagcccctcggagttcagaaatcctcgataaacctgatggctatgattgatgagcctctgtatcccattgctgtattgattgacgagcttaagaatgaggatatccaattgcgtctaaactcaatcagaagactttccacaattgctcgggcgcttggggaagaaagaaccagaaaggaactgattccatttcttagtgaaaacaatgacgatgaagatgaggtgcttcttgcaatggccgaggaattgggtgtgttcattccttatgttgggggtgtagaacatgctcatgttttgcttccaccattggagacattgtgtacggtggaggaaacttgtgtccgcgataaggcagttgaatctctgtgccgtattggtgcacagatgaaggaaagtgacattgtcgactggttcattccagcagtaaagaggctagcagcaggtgagtggtttacagctcgggtatcatcctgtggtcttttccacatagcctatccaagtgcaccggaccaactgaaagcagaattgaggactatatatggtcagctatgtcaggatgacatgcctatggtcagaagagctgctgcatcaactcttggaaagtttgctgccacagttgaacagagtcatctgaagacagaaataatgtctatatttgatgatctaacccaagatgatcaagattcagtgcgtttgttggctgttgaaggctgtgctgctcttggtaaattgttggaaccacaagattgtgtagcacatattctcccagttattgtcaatttttcccaggataaatcctggcgtgttcgttatatggttgccaatcaattgtatgagctatgtgaggctgttggccctgagcctacgagagctgatttagtgcctgcatatgtccgtctccttcgtgacaatgaggctgaagtgcggatagcagctgctggaaaagttactaagttctgtcgcatattaagtccgcagcttgcaatccaacatattcttccatgtgttaaggaattgtcatcagattcgtcccagcatgttcgttcagctttggcttcagtcattatggggatggctccctgtatgggggaggatgctaccattgaacagcttcttcctatttttctttctttgttgaaggatgagtttcctgatgttcgactcaa

SEQ ID NO: 24105 - protein, 376 aa, Panicum virgatum
  misc_feature: Ceres CLONE 1844515
  misc_feature (236)..(272): Pfam Name: HEAT Pfam Description: HEAT repeat
  misc_feature (275)..(311): Pfam Name: HEAT Pfam Description: HEAT repeat
  misc_feature (314)..(350): Pfam Name: HEAT Pfam Description: HEAT repeat
  misc_feature (158)..(194): Pfam Name: HEAT Pfam Description: HEAT repeat
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKESDIVDWFIPAVKRLAAGEWFTARVSSCGLFHIAYPSAPDQLKAELRTIYGQLCQDDMPMVRRAAASTLGKFAATVEQSHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAPCMGEDATIEQLLPIFLSLLKDEFPDVRL

SEQ ID NO: 24106 - DNA, 713 bp, Panicum virgatum
  misc_feature: Ceres CLONE 1844515-R
  misc_feature: Encodes the peptide sequence at SEQ ID NO. 24107
gcaagtcagttaggtgttgggttttttgatgacaagttgggtgcactctgcaagcaatgtttggaagataaggtcttctcaatcagagatgctgctgctaacaacttgaagcggcttgcagaggagtttggtcctgagtgggcgatgcaccatataattcctcaggtgctggaaaagataaacaactcacactacctgtatcgcatgacaattctgcaagctatctcattgttggcccctgtaatgggtgcagaaatcacttgtcaaaagctgcttccagtcgtcattaattcctcaaaggacagggtccctaacatcaagttcaatgttgcaaaagtattgcagtcgcttataccaatcctcgatcaatctgttgtggagaagaccgtgaggccttgccttgttgagctcagcgaggatcctgatgtggatgtaagatactatgcaaaccaggcactgcaggcgtgcgatcaaatgatggtgtcaagctaactagtctgatatttagtgctatattcttttagtccaattttggagtacctgtaatctggcctttagattgaagaaaagttccttctagcctcagtaacagatagaaactgccatgctgataaatggacggtcttgatcccttgttcattgtgttattaatgttgtaattgagcaagacacaacacgttattatgtgtgaatgtagattggactttgctttc

SEQ ID NO: 24107 - protein, 163 aa, Panicum virgatum
  misc_feature: Ceres CLONE 1844515-R
  misc_feature (124)..(160): Pfam Name: HEAT Pfam Description: HEAT repeat
ASQLGVGFFDDKLGALCKQCLEDKVFSIRDAAANNLKRLAEEFGPEWAMHHIIPQVLEKINNSHYLYRMTILQAISLLAPVMGAEITCQKLLPVVINSSKDRVPNIKFNVAKVLQSLIPILDQSVVEKTVRPCLVELSEDPDVDVRYYANQALQACDQMMVSS

SEQ ID NO: 24108 - DNA, 1124 bp, Panicum virgatum
  misc_feature: Ceres CLONE 1844516
  misc_feature: Encodes the peptide sequence at SEQ ID NO. 24109
tccaaaccgctggacagtggacgccctgctcgccgccggaaaggcaaccaacttttttttttttccctctcgccgcccgaaccttccgctcccctcccgtcccctcgccctcgccaccggcccccgccgccatggacacgaccatcggctcggtccccgcggccgcggacgccgccccgccggccccgtcggcgtcggccccgagggaggcgacgctgggccggcacctggcgcggcggctcgccgaggtgggcgcccgcgacgtgttcgccgtgccgggggacttcaacctgacgctcctcgacgagctggaggccgagtcgggcgccacgggggtgcgcctcgtgggctgctgcaacgagctcaacgcggcgtacgcggccgacgggswcgcccgggcgcgcggcggcggcgtgggcgcctgcgccgtcaccttcaccgtcggcgggctcagcgccatcaacgccgtcgcgggggccttcagcgagaacctccccgtcgtgtgcatcgtcggggggcccaacagcaacgactacgggagcaacaggatcctacaccacaccatcggcctgccggatttcacgcaggagctcaggtgcttccagaccgtcacgtgctaccaggctgtggtgaacaacttggaagatgcacatgaacagattgacactgccatatctacagcaataaaggagagcaagcctgtttacatcagcatcagttgcaacctcccttcgatcccacatcccacgttcagccgtcatcctgtccctttcttcctctccccaaggctatcgaaccaaatgaaccttgtggcagcagtggaagcagctgcagcattcttgaacaaagctgtcaagccggtgcttgttggtggacccaagatgagggtgtccaaagcatgcaaagcctttgtagagctggcagatgcctgctgctatcctgttgcggtgatgccttctgcaaagggacttgtgccagagcaccactctaggtttatcggcacatactggggcgctgtgagcactccattctgtgctgagatcgttgagtctgctgatgcctatctatttgctggtcccatattcaacgactacagctcggttggatactcgctgctcctgaaa

SEQ ID NO: 24109 - protein, 330 aa, Panicum virgatum
  misc_feature: Ceres CLONE 1844516
  misc_feature (27)..(208): Pfam Name: TPP_enzyme_N Pfam Description: Thiamine pyrophosphate enzyme, N-terminal TPP binding domain
  misc_feature (230)..(330): Pfam Name: TPP_enzyme_M Pfam Description: Thiamine pyrophosphate enzyme, central domain
  misc_feature: SWISSPROT Homolog: EC 4.1.1.1 Pyruvate decarboxylase
  misc_feature (87)..(87): Xaa is any aa, unknown, or other
MDTTIGSVPAAADAAPPAPSASAPREATLGRHLARRLAEVGARDVFAVPGDFNLTLLDELEAESGATGVRLVGCCNELNAAYAADGXARARGGGVGACAVTFTVGGLSAINAVAGAFSENLPVVCIVGGPNSNDYGSNRILHHTIGLPDFTQELRCFQTVTCYQAVVNNLEDAHEQIDTAISTAIKESKPVYISISCNLPSIPHPTFSRHPVPFFLSPRLSNQMNLVAAVEAAAAFLNKAVKPVLVGGPKMRVSKACKAFVELADACCYPVAVMPSAKGLVPEHHSRFIGTYWGAVSTPFCAEIVESADAYLFAGPIFNDYSSVGYSLLL

SEQ ID NO: 24110 - DNA, 610 bp, Panicum virgatum
  misc_feature: Ceres CLONE 1844516-R
  misc_feature: Encodes the peptide sequence at SEQ ID NO. 24111
tcattgcatgcattggagatggcagctttcaggtgacggcacaagaagtgtcaacgatgctccgatgggggcagaacagcatcatctttctgataaacaatggaggatacacaattgaggtggagatccatgacggtccttataacgttatcaagaattggaactacacgggtttggtggaagcattccacaatggcgagggcaagtgctacacagcaaaggctcgaactgaggaggagctgaaggaggcattgaaggcagctctgggacctaagaaggactgcttatgctttatagaggtcatcgtgcacaaggatgacaccagcaaagagcttctcgagtggggatccagggtttctgccgcaaatagccgtccaccaaatcctcagtgagtacatcaggcatccaaaattgtgctggaaaccaatcctcatatgtccatatgaagaagtcttggggagaatatgctgttgatctctgaataaactctccctttaactgtaattcactgatgttgcaagtctcgtggttacttcacagatttcagaaactgatcttgtatagttcattgctgccaataaatctgaaatcaattttgttgttcttagct

SEQ ID NO: 24111 - protein, 129 aa, Panicum virgatum
  misc_feature: Ceres CLONE 1844516-R
  misc_feature: SWISSPROT Homolog: EC 4.1.1.1 Pyruvate decarboxylase
IACIGDGSFQVTAQEVSTMLRWGQNSIIFLINNGGYTIEVEIHDGPYNVIKNWNYTGLVEAFHNGEGKCYTAKARTEEELKEALKAALGPKKDCLCFIEVIVHKDDTSKELLEWGSRVSAANSRPPNPQ

SEQ ID NO: 24112 - DNA, 411 bp, Panicum virgatum
  misc_feature: Ceres CLONE 1844519
  misc_feature: Encodes the peptide sequence at SEQ ID NO. 24113
atacgacccactccgcaggcagagagcgctctccccctcttgccccccgcaggaagcagagagctagatctctctctctcttcgtcggtggtgcgggtgcccgccctccccgagcgagatctccctgccagtcctcgaaatatggttacacatatacctgtcaggatggtgaagatctgctgcatccgtgctggatatgtcggtgggccgaactatggccgtcatttgccctcaactgcccagacattgatgtcgtccccgttgacctcttctagccccgcatttgaggcctgcaacagtgacaccctccccatctaccagcctggtctcgatgatgttgtgaagcagtgcaggggctagaatcttcttcttcagcactgacgttgagaaagcacgtccttgaagctgact

SEQ ID NO: 24113 - protein, 64 aa, Panicum virgatum
  misc_feature: Ceres CLONE 1844519
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MVKICCIRAGYVGGPNYGRHLPSTAQTLMSSPLTSSSPAFEACNSDTLPIYQPGLDDVVKQCRG

SEQ ID NO: 24114 - DNA, 1911 bp, Panicum virgatum
  misc_feature: Ceres CLONE 1844532
  misc_feature: Encodes the peptide sequence at SEQ ID NO. 24115
ggaggagagagagaagggggcgggaggaggaggaggtggcggcgcggagcgacacgcggagaggaatacgcgacccggtgtgagcctctctcgccccctgcgaaatcccattgattttgattccgattccgccggcggcgaaatcgggccgggcggcgagcgggcaagttggggagggagcgacggtgttgttggggagggggtgagacggtgagggttgaggagcggcggccacggcgaccgggatgaagggagggggcgggaaggagacggtcaccgccaccttcctccgctccctcctcctgctcctgctccccctcaccgcgctctacttcttctacacgctccacctcctcctcgccaccgcgtcgccggccgcctccaactgcccgcctgactcctccgtgtcggtctcccgggcgtccgccaacctcacggccgcggcggccgcggcggcggaggagaagcgccccggttccgccgccgcggcgcccacgccgacgacgctgcagcacgtggtgttcggcatcgcggcgtcgtcgcggttgtgggacaagcgcaaggagtacatcaaggtgtggtggcgcccgcgcggcgccatgcggggctacgtgtggctcgaccgcgcggtgcgcgagtccaacatgtccacggcgcggacggggctcccggccatcaggatctccaacgacacctccgccttcccctacacgcaccgccggggccaccgctccgccatccgcatctcccgcatcgtctccgagacgttccgcctcggcctccccggggtgcgctggttcgtcatgggcgatgacgacacaatcttcttccccgacaatctcctcaccgtgctcaacaagttcgaccacagccagccctactacatcggctccctctcagagagccacctgcagaacatctacttctcctacggcatggcgtacggcggcggcggcttcgccatcagccgcccgctggccgaggcgctcgcgcggatgcaggacggctgcatccgccgctacccggcgctctacggtagcgacgaccggatccaggcgtgcttggcggagctgggcgtgccgctcaccaagcacccggggttccaccagtacgatgtgtacggtgacctgctgggcctcctcgcggcccacccggtggcgccgctcgtgacgctgcaccacctcgacgtcgtcaagcccctgttcccggacgcgaggtcgcgccccgcggcggtgcggcggctgttcgatggaccggtgaagctggacacggcggggctgatgcagcagtccatctgctacgacgacgccaaccggtggacggtgtccgtggcgtgggggttcgtggtgctggtggcgaggggcgtaatgtcgccgcgggagatgaagatgccggcgcgcacgttcctcaactggtacccccgcgccgactacacggcgtacgcgttcaacacgaggcccatggcgcgcagcccgtgccagaagcctgccgtgtactacatgtcgtcggcgcggcgcgcgcccgaccgcgacggcggggagaccacggtgacgcggtacgagcggtggcgccacccgaacgagacgcggccagcgtgccggtgggacatcgccgacccggacgcgcatcttgataacatcgtcgtgttcaagaggcctgaccccgggctctgggacaggtctcccaggcgaaattgctgcagagtggtttcgtcgcccaaggaggggagcgggaagaagatgaccatcgatgtaggcgtatgcagggaaggcgagttcacccaggtagcagcagtataagcttcattagatatagatgaagatagggatattcagaattcttttctgtcttctttgcttgtacgaatctattcttctcggagggtgggtatcagagagtcttcgtttcagc

SEQ ID NO: 24115 - protein, 517 aa, Panicum virgatum
  misc_feature: Ceres CLONE 1844532
  misc_feature: SWISSPROT Homolog: EC 2.4.1.122 Glycoprotein-N-acetylgalactosamine 3-beta-galactosyltransferase
  misc_feature: Useful for making plants with altered carbohydrate content
MKGGGGKETVTATFLRSLLLLLLPLTALYFFYTLHLLLATASPAASNCPPDSSVSVSRASANLTAAAAAAAEEKRPGSAAAAPTPTTLQHVVFGIAASSRLWDKRKEYIKVWWRPRGAMRGYVWLDRAVRESNMSTARTGLPAIRISNDTSAFPYTHRRGHRSAIRISRIVSETFRLGLPGVRWFVMGDDDTIFFPDNLLTVLNKFDHSQPYYIGSLSESHLQNIYFSYGMAYGGGGFAISRPLAEALARMQDGCIRRYPALYGSDDRIQACLAELGVPLTKHPGFHQYDVYGDLLGLLAAHPVAPLVTLHHLDVVKPLFPDARSRPAAVRRLFDGPVKLDTAGLMQQSICYDDANRWTVSVAWGFVVLVARGVMSPREMKMPARTFLNWYPRADYTAYAFNTRPMARSPCQKPAVYYMSSARRAPDRDGGETTVTRYERWRHPNETRPACRWDIADPDAHLDNIVVFKRPDPGLWDRSPRRNCCRVVSSPKEGSGKKMTIDVGVCREGEFTQVAAV

SEQ ID NO: 24116 - DNA, 1138 bp, Panicum virgatum
  misc_feature: Ceres CLONE 1844533
  misc_feature: Encodes the peptide sequence at SEQ ID NO. 24117
acctcccgatcgccgccgccaccgcctccccaacccccagctccccgtctcccggatcggcgccatggtctcggaggccagcaagaagaaggctgcccagaagaaggccgccgcggccgccaagaggggaggcaaggcggcggcgtcctcgtcctcgtcttcttcctccgccgccgcggccgcggacaaggcggcgaacggcgtcgcggccctcaagctctccgaccgcacctgcaccggggtgctcgcgtcccacccgctctcccgcgatatccacatagagtctctttcattaacattccatgggcatgatcttattgtggattctgagttggagctgaactatgggaggcgatatgggttgcttggcttgaatggctgtggaaaatctactcttctcacagcaataggctgcagagaacttcctatccctgaacacatggatatataccatctcagccatgagattgaggcttcagacatgtctgcactacaagctgttgttagttgtgatgaggaaagagtgaagttagaaaaggaagctgaaattttggctgcgcaggaagatggtggtggtgaagctttagatcgtgtgtatgagcgtctagatgcgatggatgctgcaactgcagaaaagcgtgctgctgaaatattatttggtttgggttttaccaaacagatgcaggcaaagaaaactaaagatttctctggtggttggcgtatgagaattgctttggcaagggctctgttcatgaatccaacaatccttttgcttgatgagcccacaaaccatctcgatcttgaggcctgtgtctggttggaagagacactaaagaaatttgaccgcatacttgttgtcatatcacactctcaagattttctaaatggagtgtgcacaaacattatccatatgcaaaacaagaagcttaagttatacacaggtaattataatcagtatgttcaaacccgctctgagcttgaagagaatcaaatgaagcagtacaaatgggagcaggaacagattgcttcgatgaaggagtacattgcccgctttggtcacggttctgcgaagcttgcacgtcaggcacaaagcaaagagaaaactcttgcaaagatggagcgtggtggtctcactgag

SEQ ID NO: 24117 - protein, 357 aa, Panicum virgatum
  misc_feature: Ceres CLONE 1844533
  misc_feature (95)..(286): Pfam Name: ABC_tran Pfam Description: ABC transporter
  misc_feature: SWISSPROT Homolog: EC 3.6.3.28 Phosphonate-transporting ATPase
MVSEASKKKAAQKKAAAAAKRGGKAAASSSSSSSSAAAAADKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVSCDEERVKLEKEAEILAAQEDGGGEALDRVYERLDAMDAATAEKRAAEILFGLGFTKQMQAKKTKDFSGGWRMRIALARALFMNPTILLLDEPTNHLDLEACVWLEETLKKFDRILVVISHSQDFLNGVCTNIIHMQNKKLKLYTGNYNQYVQTRSELEENQMKQYKWEQEQIASMKEYIARFGHGSAKLARQAQSKEKTLAKMERGGLT

SEQ ID NO: 24118 - DNA, 2501 bp, Panicum virgatum
  misc_feature: Ceres CLONE 1844540
  misc_feature: Encodes the peptide sequence at SEQ ID NO. 24119
aaagcgcacctctccaagccaagcgcgcctcagccaaaccaaacccatcgcgcgcggcctcttgtcaagcttcctcgccgcggccgcagcatccttacgtgtttgactgaaggagcgatgaggcgcgtcgctcgccggccagcgaagaagtaggagtaccgagtactagcaaagcttctccttcggtgggagggggatgcggaccgcggcggcggcggcggcggcggcgctgctcctcctcctccttccgtgggtgctgccggagcatgcggcagccgcgggcaacgggagctgcgcgcggagctgcggtggcttgacggtgcggtacccgttcggcttctcccccggctgcgagatacggctcgggtgcgaccaggcggcgaacggcgccgccgcgtggctcggggccgcgcgcgagatgggcctgctcgtgcgcaacgtcacggcgcgcgccctcgtcctcaccctgcccccggactgcacccgccggctcaacgcctccgtcgacgcgctcttctcgggcaactacgcgcctggtacccagaacacgctcctcgtgagctcgtgcaaccgcgccgcgcgccccggcaactgcagcgtcccgcccgcaagctacctcaacggctcgtcccactgcttccacggcgctaacgccgagaacttcggctgcgtctcgccgccactgccgcccagaggcaaccgtttcttggacgaaaccgagatacgggcgctcggctcggaatgcaccggactggtgtcggcggcaagctactgggacgcgccggcgccggcggtcctgctgggcgtgatggaactggagtggtggatgggcgggccgtgcagctgcgcgcccaatgccagctgcacccgcctcaccacgccggccgctgggcaggggttccggtgcgagtgccgggaggggttcgagggcgacggcttcgccgacggcaccggctgccggagagtttcagttcccaaatgtaatccttcaaaaaacctagcagaaggctgtggcaagaccatccaaatcgcccttcttgtggcaggaatcgtgtttggtgcccttgtaacgggcgtgacctgcttggtataccagctgctgaagcgccggtccgcgtccatccggacgaagcggagcacgaagcggctcctgtccgaggcctcctgcgcggtgccattctactcgtaccgcgagatcgagcgcgccaccgacggcttctccgacgccaagcgcctgggcacgggcgcctacggcaccgtgtacgccgggcggctcggcgacagccgcctcgtcgccgtgaagcggatccggcagcgcgacaacgccgggctcgaccgcgtcatgaacgaggtgaagctggtgtcgtgcgtgtgccaccgcaacctggtccgcctcctcggctgctgcatcgagcaggggcagcagatcctggtgtacgagttcatgcccaacggcacgctggcgcagcacctgcagcgggagcgcggccccgccgcgatgccgtggacggtgcgcctccgcatcgccgccgagacggccaaggccatcgcgtacctgcactcggaggtggacccgcccatctaccaccgcgacgtcaagtccagcaacatcctgctcgaccacgagtacgactccaaggtcgccgacttcgggctgtcgcggctgggcaaggcgccgctgggggactcctcccacatctccacggcgccgcagggcacgccggggtacgtcgacccgcagtaccaccagaacttccacctctccgaccggagcgacgtctacagctttggcgttgtgctagtggagatcatcaccgccatgaaggccgtcgacctgacccggccgcccagcgaggtgaacctggcgcagctcgctgtggaccggatcggcaggggccgcgtggacgacatcgtggacccgtacctggacccgcaccgggacgcgtggacgctctcctccatccacaaggtggccgagctggcgttccggtgcctggcgttccacagcgagatgaggccgtccatggccgaggtcgccgacgaactggaccagatacagcgcagcgggtgggcgccgtcggcggacgacgccgcgtacatgtccacgtcgtcgtcgatctgctcgtccgcggcgtcgacgcgcggcacggacaagtcgtcctggggcgccggcaggagccggacggacagggagagggccgcggcgagcgcgctggccgctcaagaggcggccaagggcggcgcggcggagtctcccgtgtccgtgcaggagaggtggttcagcgacaggagctccccttcctccaacagcttgctgggcagtcgccccctgctctgaactgaagcaccacgttgcactactcctgtatactcaacatgtatcagctaactagcttagatctacaaaaaaaaattgtgcatgattagttgggttgcaacagttagattgaatcagggacgattagttcggtgagtggcagcaatgagatagaatcagagac

SEQ ID NO: 24119 - protein, 713 aa, Panicum virgatum
  misc_feature: Ceres CLONE 1844540
  misc_feature (341)..(617): Pfam Name: Pkinase Pfam Description: Protein kinase domain
  misc_feature: SWISSPROT Homolog: EC 2.7.11.1 Non-specific serine/threonine protein kinase
MRTAAAAAAAALLLLLLPWVLPEHAAAAGNGSCARSCGGLTVRYPFGFSPGCEIRLGCDQAANGAAAWLGAAREMGLLVRNVTARALVLTLPPDCTRRLNASVDALFSGNYAPGTQNTLLVSSCNRAARPGNCSVPPASYLNGSSHCFHGANAENFGCVSPPLPPRGNRFLDETEIRALGSECTGLVSAASYWDAPAPAVLLGVMELEWWMGGPCSCAPNASCTRLTTPAAGQGFRCECREGFEGDGFADGTGCRRVSVPKCNPSKNLAEGCGKTIQIALLVAGIVFGALVTGVTCLVYQLLKRRSASIRTKRSTKRLLSEASCAVPFYSYREIERATDGFSDAKRLGTGAYGTVYAGRLGDSRLVAVKRIRQRDNAGLDRVMNEVKLVSCVCHRNLVRLLGCCIEQGQQILVYEFMPNGTLAQHLQRERGPAAMPWTVRLRIAAETAKAIAYLHSEVDPPIYHRDVKSSNILLDHEYDSKVADFGLSRLGKAPLGDSSHISTAPQGTPGYVDPQYHQNFHLSDRSDVYSFGVVLVEIITAMKAVDLTRPPSEVNLAQLAVDRIGRGRVDDIVDPYLDPHRDAWTLSSIHKVAELAFRCLAFHSEMRPSMAEVADELDQIQRSGWAPSADDAAYMSTSSSICSSAASTRGTDKSSWGAGRSRTDRERAAASALAAQEAAKGGAAESPVSVQERWFSDRSSPSSNSLLGSRPLL

SEQ ID NO: 24120 - DNA, 1872 bp, Panicum virgatum
  misc_feature: Ceres CLONE 1844541
  misc_feature: Encodes the peptide sequence at SEQ ID NO. 24121
gcactggcgcagcgggcacttctcatctcctctacaccttctgcactgcagcacaggcaagttccggcaaccaatggcgccttggttctccttcctcgagctctccctctccttcctctgcttcgcggtcttctactactaccacatcaggtccaagcggaagaaccctgtgatccctctggactggccgttgctgggcatgctccccgccctcctcgccaacctccaccacctccacgagtggatcacctccatcctcgtcgccagccccctcaccttcctcttcacgggcccgccgcgctccggcatgcagttcttggtcaccgccgacccggccaacgtccgccacgtcttcacctccaacttcgccaactaccccaagggccccgagttcgaggagatcttcgacatcctcggcggcggcatcttcaccgccgacggcgagtcgtggcgccgccagcgcgccaaggcgcagctcctcatgtccggcgccccgttccgggcgttcgtgtcccggtacagccgcgacaaggtcgggagcgccctgctcccgctgctcgcccacttcgccggcaccggggaggcgttcgacctgcaggacgtgttcctccggctgaccttcgacacgacgacgacgatggtgttcggcgtcgacccggggtgcctgtccgtcggcctgccggaggtgccgttcgcgcgcgccatggacgacgccatgcacgtgctcctgctccgccacgtcgtcccgatgacgtggtggaagctggcgaggcggctggggatcgggtgggagcggacgatggcgacggcgtggcgcaccatcgaccagttcgtcgccgacacgatcgcgaggcggcgggccgagaaggcgaggggcggcatcgagggctcggcggacctgctctcctcctacatcaacgacgacgacgacgaggagggcaccaccaccgtggacgcgttcctgcgcgacacgaccatcaacctgatgctggccgggcgcgacacgacgggctcggcgctgtcctggttcttctacctactgacgcagaacccgcgcgtggtggccaggatcctgcaggagctcgagtccgtgaagggcacctccagcgcccccgacggcatggtgaccttcgacccggacgagctggggcggctgccgtacctgcacgcggcgctgtgcgagtcgctccggctgtacccgccggtgccgcaggagctgaaggaggccgccgccggcgacgtgctgccgagcgggcacgaggtgcgggccggcgacaaggtcctggtgtgggtgtacgccatggggcggatggaggacgtgtggggcggcgactgccgggagttccggccggagcggtgggcgtcggcggaggaggggcgcggcggggtgcggtacgtgccgtcgtaccggttcatttccttcaactcggggccccgcacctgcctcgacaaggacatggcgttcgtgcagctcaaggccgcggcggcaggcgtggtgtggaacttcgaggtggaggcggtgcccgggcaagtcgtggagcccaagctgtccatcatactccacatgaggaacgggttcatggcgaccgtgaggagaaggcgccaggctctggatccggcggcggcgcacgcttgcctgatgatgggctgagatcgatcggtggtcgcggtagcccctaccctagtatacgtgctcaatcaggagcgcgtgaccaccagtcggtacgtatgttagatgacatgtacgtacgtacgtactttctcgtgttgtgtgtacgtgtaccgtagtgtacctgtgtatgttatccgtcgatgtcgtgtttgcttatccagaacgaattgaagctggtgctacgtgtacgcaccgcacgc

SEQ ID NO: 24121 - protein, 525 aa, Panicum virgatum
  misc_feature: Ceres CLONE 1844541
  misc_feature (32)..(506): Pfam Name: p450 Pfam Description: Cytochrome P450
  misc_feature: SWISSPROT Homolog: EC 1.14.13.13 Calcidiol 1-monooxygenase
MAPWFSFLELSLSFLCFAVFYYYHIRSKRKNPVIPLDWPLLGMLPALLANLHHLHEWITSILVASPLTFLFTGPPRSGMQFLVTADPANVRHVFTSNFANYPKGPEFEEIFDILGGGIFTADGESWRRQRAKAQLLMSGAPFRAFVSRYSRDKVGSALLPLLAHFAGTGEAFDLQDVFLRLTFDTTTTMVFGVDPGCLSVGLPEVPFARAMDDAMHVLLLRHVVPMTWWKLARRLGIGWERTMATAWRTIDQFVADTIARRRAEKARGGIEGSADLLSSYINDDDDEEGTTTVDAFLRDTTINLMLAGRDTTGSALSWFFYLLTQNPRVVARILQELESVKGTSSAPDGMVTFDPDELGRLPYLHAALCESLRLYPPVPQELKEAAAGDVLPSGHEVRAGDKVLVWVYAMGRMEDVWGGDCREFRPERWASAEEGRGGVRYVPSYRFISFNSGPRTCLDKDMAFVQLKAAAAGVVWNFEVEAVPGQVVEPKLSIILHMRNGFMATVRRRRQALDPAAAHACLMMG

SEQ ID NO: 24122 - DNA, 1818 bp, Panicum virgatum
  misc_feature: Ceres CLONE 1844546
  misc_feature: Encodes the peptide sequence at SEQ ID NO. 24123
ccagacgggaacgtgacgtgccgaggaccaccataagatctcaacgtgtacgcgacgcgaccaagctcagctccagctccagctccagcttccgctccaatggcttcccaccctcctcccgagccttcttccaactcgaacaaggggtgggccgagccggaggagatccacgtctcctccggtggcgtccaggcgtacaccgacgacgacgccgactgcgagggcaggcgccctttgctgctcgggactccagcctccgccgagtgctactccgtctccgccgccgccctcccgttcttctttccagctttgggaggccttctctatggctatgacattggggcaacatccggggcgaccatatcgctcaagtcttcgacattcagtggtacaacctggtacaatttatcatctgtgcagactggccttgtggtcagtggctcactgtatggtgctttgatcggctctgtcttggcatatactattgcagactatttagggcgacgcaaagagcttatcctttcttctatctcatatttgattggagcccttctgacagcagtagcacccaacttcgctatcatggtggttggccgctttttatatggaataggaattggattggctatgcatgctgctccaatgtatattgcagagactgcaccaagccagataagaggcatgctcatttctctaaaggagttctttattgttcttgggatgcttcttggttatatagcaggcaatctctatgtggaagtggtttccggttggcgttatatgtatgccaccagtacaccattatgtctcgtaatgggagtcggagtgtgttggttaccctcgtcacctaggtggctcctgttatgtgccatacaagggaagggaaacctgctggagacaaaagaaattgcaacccggtgcttatgtcgattgaggggtcaagcttcgcctgatttggtctcagatcaggttaacttgattctggaggaactgtcgtatattgatcaagagaagcaagttggcttcagggagatctttcaaggaaaatgtcttaaagcaatgataattggatgtggtttggtgttctttcagcaggtcactggtcaacctagcgtgctatattatgctgctacaatctttcagagtgctggattctctggggcatctgatgccactcgtgtgtcaattcttctaggtttactgaagttgatcatgactggagtagcagtcctcgtggttgacaggcttggccgaagaccgttactcattggaggtgtcagtggaattactgtttccttatttttgctgtcctcctactacaccttactgaaggatgcctcctatgtggctgtcatagcacttctactgtatgttggctgttaccagctgtcatttggtcctattggctggcttatgatctcggaagttttcccattgagactgcgaggccgtggattgagcgttgctgttcttgtgaatttcgcatccaatgcgctggtcacctttgctttctctccactggaggatttgattggaacggggttgctcttctgtggattcggggtgatcgcagtggcatctctcgtcttcatattctagatcgtcccggagacgaagggactcaccctggaggagattgaagcgagtctgtagtagattaatccagaagaatgctcattcgtccaagtttcagttaactgaaggaactgctggtatcattttgcagtcagccttcttctgtagctagcttgttcagatttctgcaagctgttgtattactgtttcctggtaaagattaattcatgaggtgttcgtatc

SEQ ID NO: 24123 - protein, 499 aa, Panicum virgatum
  misc_feature: Ceres CLONE 1844546
  misc_feature (65)..(499): Pfam Name: Sugar_tr Pfam Description: Sugar (and other) transporter
MASHPPPEPSSNSNKGWAEPEEIHVSSGGVQAYTDDDADCEGRRPLLLGTPASAECYSVSAAALPFFFPALGGLLYGYDIGATSGATISLKSSTFSGTTWYNLSSVQTGLVVSGSLYGALIGSVLAYTIADYLGRRKELILSSISYLIGALLTAVAPNFAIMVVGRFLYGIGIGLAMHAAPMYIAETAPSQIRGMLISLKEFFIVLGMLLGYIAGNLYVEVVSGWRYMYATSTPLCLVMGVGVCWLPSSPRWLLLCAIQGKGNLLETKEIATRCLCRLRGQASPDLVSDQVNLILEELSYIDQEKQVGFREIFQGKCLKAMIIGCGLVFFQQVTGQPSVLYYAATIFQSAGFSGASDATRVSILLGLLKLIMTGVAVLVVDRLGRRPLLIGGVSGITVSLFLLSSYYTLLKDASYVAVIALLLYVGCYQLSFGPIGWLMISEVFPLRLRGRGLSVAVLVNFASNALVTFAFSPLEDLIGTGLLFCGFGVIAVASLVFIF

SEQ ID NO: 24124 - DNA, 312 bp, Panicum virgatum
  misc_feature: Ceres CLONE 1844561
  misc_feature: Encodes the peptide sequence at SEQ ID NO. 24125
tcaaagcacttactagtgagcaactgcagtgcacagagtgagagatggcaacatcaatagagatcatgaacccccgcattgaggttcttgagactgcagtcacctcggtattccagccagggaagcttgcggtcgaggtgattgcagtggatcatgacacaaatcccacaccacccatcccgatcttgattgcttctcccaaggatgcaggaacataccctgtcgccctgctcctgcatggtttctgcctccagaaccctttctatgaagaagttctcaaacatattgcctcttttggcttcatcctggttg

SEQ ID NO: 24125 - protein, 89 aa, Panicum virgatum
  misc_feature: Ceres CLONE 1844561
  misc_feature: SWISSPROT Homolog: EC 3.1.1.14 Chlorophyllase
MATSIEIMNPRIEVLETAVTSVFQPGKLAVEVIAVDHDTNPTPPIPILIASPKDAGTYPVALLLHGFCLQNPFYEEVLKHIASFGFILV

SEQ ID NO: 24126 - DNA, 2233 bp, Panicum virgatum
  misc_feature: Ceres CLONE 1844568
  misc_feature: Encodes the peptide sequence at SEQ ID NO. 24127
gcatgttcagctgttacactttcgcaatggataaccctgttcatccctagctaacacgaggtcttatatatcacaggctaaatcttgctggcaatacgatctttcaacttctccttacagcaagactgaagaaattcctgaacaagctgcggagaacagattaagcaagcaaggctgatagtgaagtttcagaaagctcattgaacgacgtgatggatcccaccactgttgaatcgaaatgggtgtctcccaccactgaagatgggtcaatggacaggagaggaaacccagctgccaaagcagcatctggaagatggagatctgccatcctgctgctcgccaactacgggctcgtgacgtgcgccttcttcggcgtcggtgtgaacctggtggtgttcctgcggcgggtgctccaccaggacaacgccgaggcggccaacaacatcagcaagtggaccggcaccgtctacatcttctcgctcatcggcgccttcctcagcgactcctactggggccgttacgtcacctgcgccatcttccagatcatctacgtgacgggcctggtgattctgtcgcttgcgtcatggttcttgctggtgaagccctccggctgcggcggcgtcgatgcgcgctgcgacgagccgtcggcgcccggcgtcgcgctcttctacctgtccacctacatgatcgcgttcggcaacggcgggtaccagccttcgatcgccacgttcgggtcggaccagttcgacgagacggaccccaaggaggcgcgctccaaggtcgccttcttcagctacttctacctggcgctcaacgtcgggtccctcttctccaacacggtgctggtgtactacgaggactcgggccgctgggtcatggggttctgggtctcggcggccgccgcggcgctggcgctcgtgctcttcctgctcggcacccccaactaccggcacttcaagccgagcggcaacccgctgacgcgcgtcgcgcaggtgttcgtcgccgcgctccgcaagtggcacgcggaggtgccccgagaagagttcctccacgaggtggaaggagaggaccccaaggtctcgggcatccgcaagatccttcacagcgacgagctcaggttcctcgacagggcggcgacggtcaccgaggaggagtacggcgcgccggagaagatgaaggacccgtggcggctctgcacggtgacgcaggtggaggaggtgaagtgcatcctgaagatgctgcccatctggctgtgcacgatcgtgtactcggtggtgttcacccagatggcgtccctgttcgtggagcagggcgccaccatgaacaccaacatcgggtcgttccacttccccgccgcgagcatgtcgctgttcgacatcctcagcgtgctggcgttcatcgccatctaccgccgcgtgctggtccccgtgatggcgcggctgtcgggcaacccgcagggcctgacggagctgcagcgcatgggcgtggggctcgtgatcggcatggcggccatggtggtggcgggcgcggtggaggtggagcggctgcggcgcgtggcggccccggaccagccgagctcgctgagcgtgctgtggcaggtgccgcagtacgcgctgatcggggcgtcggaggtgttcatgtacgtggggcagctggagttcttcaacgggcaggcccccgacggcgtgaagagcttcggcagcgcgctgtgcatggcgtccatctcgctggggaactacgtgagcatcatgctggtgagcgtggtcaccagcctcaccgccggggagaggcggcccgggtggatcccggggaacctcaactccggccacctcgacaggttctacttcctcctcgccgcgctctcgctagtggacctcgccgtgtacgtcgcgtgcgcgacgtggtacaagggcatcaagctcgatggcggcggcgagacgaggaagaaccccgcgcacgtttaaacactgggcctgggccgttcttttgggtgttctggtttggagacgtgccgtgctggcccgtagaaaataaaatgtcaaagaactggcatgtggtccgtgttggatggcctattttgttctgtgtctttggtctagctccaagaatcagtctcagaactccatgtaatgctgctatgtatgtaaatataataaatatagtatatgtatggatgtctgctgaacttgcatgcagccaacctgtcaaagacagacttttttgtgtgtgatcg

SEQ ID NO: 24127 - protein, 583 aa, Panicum virgatum
  misc_feature: Ceres CLONE 1844568
  misc_feature (103)..(504): Pfam Name: PTR2 Pfam Description: POT family
  misc_feature: Useful for making plants with altered carbon content
  misc_feature: Useful for making plants with altered nitrogen content
MDPTTVESKWVSPTTEDGSMDRRGNPAAKAASGRWRSAILLLANYGLVTCAFFGVGVNLVVFLRRVLHQDNAEAANNISKWTGTVYIFSLIGAFLSDSYWGRYVTCAIFQIIYVTGLVILSLASWFLLVKPSGCGGVDARCDEPSAPGVALFYLSTYMIAFGNGGYQPSIATFGSDQFDETDPKEARSKVAFFSYFYLALNVGSLFSNTVLVYYEDSGRWVMGFWVSAAAAALALVLFLLGTPNYRHFKPSGNPLTRVAQVFVAALRKWHAEVPREEFLHEVEGEDPKVSGIRKILHSDELRFLDRAATVTEEEYGAPEKMKDPWRLCTVTQVEEVKCILKMLPIWLCTIVYSVVFTQMASLFVEQGATMNTNIGSFHFPAASMSLFDILSVLAFIAIYRRVLVPVMARLSGNPQGLTELQRMGVGLVIGMAAMVVAGAVEVERLRRVAAPDQPSSLSVLWQVPQYALIGASEVFMYVGQLEFFNGQAPDGVKSFGSALCMASISLGNYVSIMLVSVVTSLTAGERRPGWIPGNLNSGHLDRFYFLLAALSLVDLAVYVACATWYKGIKLDGGGETRKNPAHV

SEQ ID NO: 24128 - DNA, 3488 bp, Panicum virgatum
  misc_feature: Ceres CLONE 1844606
  misc_feature: Encodes the peptide sequence at SEQ ID NO. 24129
agctgagaggaggagaacagagaggccgagatggctggcatagcggtgagcgcttccactggagtgatgaactcgctcctctccaagctctccatcctgcttagtgatcagtacaagcaactcaagggggtccgcaaggatatcgagttcctcagccgtgaactccttgacatgaatgcagcgctggagaagctagcggatatggagaagatggatgttcaaacaagggtgtggagggacaaggttcgtgagatggcctacgatattgaagattgcattgatgtcttcatgcatcaccttggccagggagatgacaaggatggcttattccacaagaccgcacgcaagatcaggaagctgcgggtgcgctatcaaattgccaacaagattcaagaactcaaagctcgtgttgtggagcagagccaaagccgagatagatacaagattgctgatgctgctgacacccctgcagtgcctccagtcgatccacgggtacgagcaatgttcgaagatgcaaaaaggctagtgggcattgatggtccaagagatgaaatcacccagtggctgatggaggaaggtgatacttctgaacagcttaaagtggtgtccatcgtgggttttgggggtctcggcaagacaactcttgcaaaccaagtgtacaacaaaatcaagagtgagtttcagtgcccagcgttcgtgtcagtttcaagaagtcctgatatgccaaagattctgaaagacatgctttctaaagttggatatcacagcatggatatggcagatgacgtcagcaagcttatcacggccctcactgaacaccttgcagataagaggtacctagttgtaattgatgacatctggagcagcaccgcatgggacatcattagatgtgcttttgtgcaaaataataaaaagagtagagttatcactactacgcgcattcaagaagtagccgcagcatgttgctcaggatgccaaggatacgtgtatgaaatacgaccgcttaacagccttgactctagaagcttattttttaaacggctattcgacacagaggatggctgtcccaagcaatacagagatatctgtgaagatatgataaagaagtgccgtggtgtgccattggctattactagcattgctagccttttggaaagccaaggcatgcatgttgagaaatgggagaaaattcgggattctctgggttatgagcttgaaactagctctaaaatggaatggatgagacatgtgttaagccttagctacaatgacctgccacatcatctcaaaacatgtttgctttatcttggtgcatatcctgaagactaccgaatttggaaggatgatttagtgaggctatggattgcagaaggatttgttcctgaaaaacacggtttggatctagaggaggtcgctgagggctattttaatgaattgatcaacagatgtatgatccaaccttttgttgatcatattggtgagattttaggtgaggtgaggtcatgtcgagttcacgatctaatgcttgatcttattctgttgaagtgtactgaagaaaactttatcactaccaatggttgtctgcataatatgaaaggaacatcacaagttcgtcggattagccatcagttccatactagaaatatggccccagcagttgaaaggatgaatctatcacaacttcggtcctatatgttgtaccctgcagctaagtatgtacctgttatttccaagtttgaactattgcgagtgctgcgcttggagtccgattcctatggaaggaaagactctgagtgccttgatttatccaacagcacaagtcacctttttctgttgagatacctggaggttagtggctttcgcttgaaactgccaaagaaatttggaaaacttcagcatttgatgaccctacatttgacaacgaactggttagattctagtaatcccacactggatgttacttctttgtcatcactgaggcatctcaccctcccatgtaatccaacttgtttggagctgcgcaatggagtcagtaaactgagcaacctacaaactctgttcggttttgatataagcatgaactctgtcgagaccatccgagaactcggtgagctgaccaatctaagggatcttcgcctcatggcctcaggtggtactggagaagaggattctgaaaccaaaactctaaagtacgacaccctggcagcctcccttcgcaggcttggtaacagtaacctccgctggctacgtgctggcttttctgccacagagcagttttggaataattgcttcacatgtcctcccagattccaacgtggatggcacaagctaataggttggcatatttaaacctgcttcaagttgcgcagctcccgagcgaggacgtccaagttctggtagccgaaatggtccccgagaaaaagcatcatcatccgctccaacatattcccagtcctcaagcaattaaaatttagctacaagttatcctgcctgacgtttgagccaggtgcaatgccacggctaaagaagcttgacatatcctacgattctcgtggacccggttcagagcatgaggtcagtcccgttgctggagtcgagcacctcgcaagccttgaagagctctccgtggtagtacaggcgaaacgtggtgaggggtccaagcttgggtctttatgcagggaatccatccaaaggcatccaagatatcaagccataaagaccaaactacgctatgatgagtatgatgatgaaaaccgtcttgtaaaatcatcagacatatgatgatggaaaagcgcccctaatgaagaaaataatgctgcatcactgagacttgggactactgaatatctccatgactagagggctaagatgctttttcccatatcaatcctcaagcatgtgcatggtataaatgggcctatgacttcgtcaaatttggaagtcactttcagaacattactttccaacggtggttcagccatggaaacaactcacacatgcttctcatggtgggctcatccatggagcaaccagctgtctgcaaaattatgagcattcatctgcatcacaaataatcagcaccgacatcactgatgttttacagacatttaatcaaagaaaattgctctcatattaatggagagtacgtgtaaagcagatgatggaaaaacgctgttgaaacctgagttcaaactgattgagactgtttctatcttgatttttcattagttttttgcgatatcactggccacgtggcttgaactcccgcctgctctgttttactgtatggcaatagcctgttgtgtaacatcctaattctatctttccctttcctgtatccccttcccattgtgctgtacttatctattttttccctttccctttcctgtatgatggcttggattttctttttctaggggagaatgtagtgtatctttgaattcttctcggtagcagaacagtactgcaatctgctcttattccttctc

SEQ ID NO: 24129 - protein, 772 aa, Panicum virgatum
  misc_feature: Ceres CLONE 1844606
  misc_feature (150)..(455): Pfam Name: NB-ARC Pfam Description: NB-ARC domain
  misc_feature: SWISSPROT Homolog: EC 2.7.11.1 Non-specific serine/threonine protein kinase
MAGIAVSASTGVMNSLLSKLSILLSDQYKQLKGVRKDIEFLSRELLDMNAALEKLADMEKMDVQTRVWRDKVREMAYDIEDCIDVFMHHLGQGDDKDGLFHKTARKIRKLRVRYQIANKIQELKARVVEQSQSRDRYKIADAADTPAVPPVDPRVRAMFEDAKRLVGIDGPRDEITQWLMEEGDTSEQLKVVSIVGFGGLGKTTLANQVYNKIKSEFQCPAFVSVSRSPDMPKILKDMLSKVGYHSMDMADDVSKLITALTEHLADKRYLVVIDDIWSSTAWDIIRCAFVQNNKKSRVITTTRIQEVAAACCSGCQGYVYEIRPLNSLDSRSLFFKRLFDTEDGCPKQYRDICEDMIKKCRGVPLAITSIASLLESQGMHVEKWEKIRDSLGYELETSSKMEWMRHVLSLSYNDLPHHLKTCLLYLGAYPEDYRIWKDDLVRLWIAEGFVPEKHGLDLEEVAEGYFNELINRCMIQPFVDHIGEILGEVRSCRVHDLMLDLILLKCTEENFITTNGCLHNMKGTSQVRRISHQFHTRNMAPAVERMNLSQLRSYMLYPAAKYVPVISKFELLRVLRLESDSYGRKDSECLDLSNSTSHLFLLRYLEVSGFRLKLPKKFGKLQHLMTLHLTTNWLDSSNPTLDVTSLSSLRHLTLPCNPTCLELRNGVSKLSNLQTLFGFDISMNSVETIRELGELTNLRDLRLMASGGTGEEDSETKTLKYDTLAASLRRLGNSNLRWLRAGFSATEQFWNNCFTCPPRFQRGWHKLIGWHI

SEQ ID NO: 24130 - DNA, 611 bp, Panicum virgatum
  misc_feature: Ceres CLONE 1844609
  misc_feature: Encodes the peptide sequence at SEQ ID NO. 24131
tgtcatcagcaaaatctcctccctacgtgtgctgcggctgccattcaacaatatcacagggacaaatccactgcccacactagcagctgagtgtcctttacttgaagttattgatcttgggtctaatgtgctcgacggggagataatgccaaacttgtgctcatcattgccatcactacgaaagctcatcctcccgaacaattacctcaatggaactgtgccaccatcactcagcaattgcagcaatctagagtcaatcgacctcagtttcaacctgttacacggtcagattccaacagaagtattattccttcctaagcttattgatctggtcatgtgggcaaacaatctttctggtgaaataccagacatactatgctccaatagcactattctggagacattggtgataagttacaacagcttcactggaggcatccctccatccatcaccagatgtgtgaatctcatatgggtatcacttgctggcaacaatctgactgggagtgtgccctcaggctttggcaacctccagaagctttccattctacagctgaacaagaattcactctctggccaggtgccagaagaatttggcagctgcagcaacc

SEQ ID NO: 24131 - protein, 203 aa, Panicum virgatum
  misc_feature: Ceres CLONE 1844609
  misc_feature: SWISSPROT Homolog: EC 2.7.11.1 Non-specific serine/threonine protein kinase
VISKISSLRVLRLPFNNITGTNPLPTLAAECPLLEVIDLGSNVLDGEIMPNLCSSLPSLRKLILPNNYLNGTVPPSLSNCSNLESIDLSFNLLHGQIPTEVLFLPKLIDLVMWANNLSGEIPDILCSNSTILETLVISYNSFTGGIPPSITRCVNLIWVSLAGNNLTGSVPSGFGNLQKLSILQLNKNSLSGQVPEEFGSCSN

SEQ ID NO: 24132 - DNA, 662 bp, Panicum virgatum
  misc_feature: Ceres CLONE 1844611
  misc_feature: Encodes the peptide sequence at SEQ ID NO. 24133
acgcgcagtaagcaagatccctcgcgctaccgacagccagtggtaaatggcgagctcagacacaagcagcgtccacgtgctactcctttcctacccggcccagggccacatcaacccgctcctccagctcggcaagaggctcgccgcccaccgcggcgtgcgctgcaccctcgccgtgacccggttcctcctcggccagagcaagccgcagaccggcgcggtccacgtcgccgcctactccgacggctgcgacacgggcggctacgacgaggctggcgacgcggaggcgtacctcgcgcggctcgagtcggcggggtcggcgtcgctagacgagctcctccgcgccgagtccgctggaggccggcccgtgcgcgccgtggtgtacgactcgttcctgaagtgggcgccgcgcgtggcgcgccggcacggcgcggcgtgcgcggccttcttcacgcaggcgtgcgtggtgaacgtggcgtacgcccacgcgtgggccggccggatggacctgccggtggcgccgggcaaggcgctgccggaactgcccggcctgccggcggggctcggaccggccgacttcccgacgttcctcacggaacccgaaagcggcggccgcgcctaccttgacctccttctgcaacagtgccaggggtttgaggtgg

SEQ ID NO: 24133 - protein, 205 aa, Panicum virgatum
  misc_feature: Ceres CLONE 1844611
  misc_feature: SWISSPROT Homolog: EC 2.4.1.121 Indole-3-acetate beta-glucosyltransferase
MASSDTSSVHVLLLSYPAQGHINPLLQLGKRLAAHRGVRCTLAVTRFLLGQSKPQTGAVHVAAYSDGCDTGGYDEAGDAEAYLARLESAGSASLDELLRAESAGGRPVRAVVYDSFLKWAPRVARRHGAACAAFFTQACVVNVAYAHAWAGRMDLPVAPGKALPELPGLPAGLGPADFPTFLTEPESGGRAYLDLLLQQCQGFEV

SEQ ID NO: 24134 - DNA, 683 bp, Panicum virgatum
  misc_feature: Ceres CLONE 1844627
  misc_feature: Encodes the peptide sequence at SEQ ID NO. 24135
gaaaagaagaaaatctccgcttctccacgcctctgctcctccgctgcgtatgcgtccctctcgtctcgtgtgaccagctgcggagcaggcgaccaggcataaacgccctgcgcgcgcagcgcggcggcggcaatggcgcccacggcctgcctccggttcccctatctcccggctcgagccccggcccgctccgccaacccggccgccacctacccgtcgccccaccgcccctccctgaaatgcagcgccgccaacggcgacagctccatctccagccccaattccatctccatctccccgatctcgccaccgcgggcgacggtggcggacggcgttgagtcggcggatgccaacgggctgcgccgcccgcccgcgcccgtctccggcctcaccgtccctggcgcccgcgattcccactggttgcctcggccgctcactagtgcggacgtcttggatgcgaatgggaagggactcaaggttgcttaccagcgaggcagcagcaaaaaaggcatacccgaattgtgagactgtgccctgcgagcacttcgatactgcatttcaggctgttcaaaactgggtggctgatagggctgtactgccacttgagaattcattgggaggtagcattcatcgtaactatgaccttttgcttcggcatagtttgcacattgttggagaagttc

SEQ ID NO: 24135 - protein, 112 aa, Panicum virgatum
  misc_feature: Ceres CLONE 1844627
  misc_feature (48)..(112): Pfam Name: PDT Pfam Description: Prephenate dehydratase
MPTGCAARPRPSPASPSLAPAIPTGCLGRSLVRTSWMRMGRDSRLLTSEAAAKKAYPNCETVPCEHFDTAFQAVQNWVADRAVLPLENSLGGSIHRNYDLLLRHSLHIVGEV

SEQ ID NO: 24136 - DNA, 1112 bp, Panicum virgatum
  misc_feature: Ceres CLONE 1844637
  misc_feature: Encodes the peptide sequence at SEQ ID NO. 24137
ctccctctcgctctacaagaaagcgactaccaccgcgctgcaccaccgagagtcaactggcgagtgatagagtgctgacgggaagcttcgatccctgaccagagttcggaggaggaggaggagatgaacgtcgacttcggcgcgcccaaggagctcgcagggggcctgcagcagcgcagggccctctaccagccccgcctcccgccgtgcctccagggcccgacggtgcgggcggagtacggcgacacgaccaccaccatcgaccccagctgcgccaacgtcgtcgcgcaggccttcccgaacaccttcggccagccgctcgtcagcttcgtcgcgccggccgacgccgccgccgccgccgccgccgcggaggagcgccctacgatcagggtgggcgtggtgttctccgggaggcagtcgccgggagggcacaacgtcgtctggggtctgcatgacgctctcaaagcctacaatcctcagagcgtgctctacggatttgttggtggcacagaggggctgtttgcaaacaagacactggagatcactgacgatgttcttacttcctacaagaaccaaggtggtttcgatttgctcggcaggagtatcgatcagatccgcacaactaagcaagtcaactctgcaatggcaacatgccgcagtctgaacttggatgggctggtcatcattggaggagtgacctccaattcagatgctgcacagcttgcagagatccttatccaaaataactgtaagaccaaggttgttggtgtgccagtttcattgaatggtgatctcaagaaccagtttgttgaaacaaccgttggatttgatacagtttgcaaggtaaattcacagcttgtaagcaatgtttgcctcgatgcaatctcagctggaaagtactattatttcgttcgtctgatgggacgaaaagcatcccatgttgccttcgaatgtgcacttcagtcacacccaaacatgctcatcttaggagaggaggtggcattgtcaaaactcactctaatggagattataaacaagatatgtgatggagtgcaagcaagagcagaattagggaaataccatggtgtgctagttattccagaaggactaat

SEQ ID NO: 24137 - protein, 329 aa, Panicum virgatum
  misc_feature: Ceres CLONE 1844637
  misc_feature: SWISSPROT Homolog: EC 2.7.1.90 Diphosphate--fructose-6-phosphate 1-phosphotransferase
MNVDFGAPKELAGGLQQRRALYQPRLPPCLQGPTVRAEYGDTTTTIDPSCANVVAQAFPNTFGQPLVSFVAPADAAAAAAAAEERPTIRVGVVFSGRQSPGGHNVVWGLHDALKAYNPQSVLYGFVGGTEGLFANKTLEITDDVLTSYKNQGGFDLLGRSIDQIRTTKQVNSAMATCRSLNLDGLVIIGGVTSNSDAAQLAEILIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGL

SEQ ID NO: 24138 - DNA, 2493 bp, Panicum virgatum
  misc_feature: Ceres CLONE 1844657
  misc_feature: Encodes the peptide sequence at SEQ ID NO. 24139
aatgcagtccagtccccctcactccagcccagatccatcatccatccatccatccaccaaccatcaccactgcttgccttgcctccaacagtggaacacatcttgctcttcagcatcgactactagcctccggcagcgtctcactttgctttggatgcttgtggttagcggagagtgatcaggaagaaacacggctggtttgaaggcggccgtaaccgtaaaggcagaggaggaggttttcgaattcgcgaatcttttcctgggctcccgcaagcctacaaaccccctgcttgtcctcttgctcccgccgccgctggatatcgagagagagagagagagagagagagagagagagagagagggccgccgtagggaggagataagaataagcagaaaggcgaagaagcacaagggaagaaaggggaatagaaaggcgaggccttttcctgattgctcctcgcacagctttcccctcggctcaaaatctctctggattccctggaaagttcctgcttcttttcgagaccagcggcctgagcttctgaattcgagtctggtcggagttgggcgttcgcgtgacgttgctgatccaatgggggagacgaaccagccgccgccgcctcaggtgaccgcgccgccgcccatgatgcccatgatggcgccggccgtcggcgccggcgccatccacccgccccatgagcagttccaccatctcgcctactgcgtccactccaatccgtcttgggttcaggtggcagcactggcattccttcactatcttgtgatgttgggctcaactgttatgcttgcatcaattattgttcctgcaatgggtggtaatcctggggataaggctcgagttattcaatcattcctatttatgagtggcataaatacattgctgcaaacacttattggaacgagacttccaacaattatgaatgcctcctttgcatttgttgtccccgtgctgtcaatagccagagacatggatccaaataacttcacaaataatcaccagagatttctccatacaatgagaactacgcaaggagctctgattgttgcttccatcctcaacatgattcttgggttcagcacaatatggggggcatatgctaagaaattcagtcctgtaataatgacccctgttgtttgtgtcgttggtcttggactattcgaacttggttttccccaggttggtaaatgtgtggaaattgggttgccaatgctcattcttgcggtgatcgtgcagcagtatgtgccacattacttcagtcatatccatgagcggatcacctacttgtttgagaggtattcgttgcttctttgtattggcattgtgtgggcctttgcagctatccttactgctgcgggtgcatacaatcatgtttcacctaagacgcagcagcactgccgcactgataggtctttcctgatgtcatctgcaccatggattaaaattccataccctttccaatggggtacgccaatcttcactgctggtcattcatttgggatgatgggtgctgtacttgttggagcctttgagtcaactggagcacactttgcaactgcacgtctggcgggtgctacaccacctccaggtcatgtccttagtcgaagtgttggcttgcagggtattgggatgttcctggaggggatcttcggtgctccagcaggttcatctgtatcagttgaaaacattggtctccttgggctgaccaaagtcggaagtaggagagtgatccagatatcaaccggatttatgatatttttctccatatttgggaagtttggggccttctttgcatcaattccactgccaatcttcgcagcaatttactgcatcttgtttggcatcgtagctgctgtgggagtctcattcatgcagtttgccaacaagaactcgatgaggaacatctacatcattggactctcgttgttccttggtatttcagtccctcaatactttaatgaatatacttcttctgctggccgtggacctgcccgaacaaatgctggatggttcaatgacattataaacaccgtgtttgcttctggcccaacagtggcgctgattgtctcctctgttctggataacacattggaggccaggggcaacgactctgaccgagggctttcatggttcacgccgttcctgcgccgccacaaaggttactcggacccgagaaacgatgagttctacagtttcccaatcagggttcacgacttcgtcccgagtcggttcctctgactttctcatgagcgctgttactgcgcatgtaaatctctttgttcttggtagtcttactcctgtgacctgtagtgattggttctctacattctagtgggatatgggtacaagaatgtttaggaaatttgctttatttaccccttctgcgctaagaaatggtaacatgacaatgtagggctgcgtgcccaggcgtatggttttgggaaggattacagaagaatagcaccttgttgatg

SEQ ID NO: 24139 - protein, 537 aa, Panicum virgatum
  misc_feature: Ceres CLONE 1844657
  misc_feature (35)..(446): Pfam Name: Xan_ur_permease Pfam Description: Permease family
MMPMMAPAVGAGAIHPPHEQFHHLAYCVHSNPSWVQVAALAFLHYLVMLGSTVMLASIIVPAMGGNPGDKARVIQSFLFMSGINTLLQTLIGTRLPTIMNASFAFVVPVLSIARDMDPNNFTNNHQRFLHTMRTTQGALIVASILNMILGFSTIWGAYAKKFSPVIMTPVVCVVGLGLFELGFPQVGKCVEIGLPMLILAVIVQQYVPHYFSHIHERITYLFERYSLLLCIGIVWAFAAILTAAGAYNHVSPKTQQHCRTDRSFLMSSAPWIKIPYPFQWGTPIFTAGHSFGMMGAVLVGAFESTGAHFATARLAGATPPPGHVLSRSVGLQGIGMFLEGIFGAPAGSSVSVENIGLLGLTKVGSRRVIQISTGFMIFFSIFGKFGAFFASIPLPIFAAIYCILFGIVAAVGVSFMQFANKNSMRNIYIIGLSLFLGISVPQYFNEYTSSAGRGPARTNAGWFNDIINTVFASGPTVALIVSSVLDNTLEARGNDSDRGLSWFTPFLRRHKGYSDPRNDEFYSFPIRVHDFVPSRFL

SEQ ID NO: 24140 - DNA, 2060 bp, Panicum virgatum
  misc_feature: Ceres CLONE 1844659
  misc_feature: Encodes the peptide sequence at SEQ ID NO. 24141
acctccccgccccccgcctgcgtcggcctcgccctctcaactctcaagtctcgactcaccgcgccacaccacaccacaccacaagccccagctcgcccgttcgcgccgctacagtcccccccgcgcgcctctcctcctcgtactgccgccgcgcgcgcccgccggtccgctcccccgctcgctcggcccgcgcgagcccggagcctggtggcggcggcggaggtgggggattcggattgggagcccgggcgcggcggggtcgctcgccccaccccacgaggcagggagatcggggcgcgcgcgggtgcccgcagctctcgccgggctcggttccgcgggatcgctccggcgcggtgcggcccatgccgtgagtgaagtcctggctttgccgcccgggggagagatcttgccgccacagcagcagcagccgcagccgcctgaagccggtgctccggcggccgaggccgaccggcgcccgccaccgaccgccatggctggcagcgacgaggtcaaccgcaacgagtgcaagacggcggtgccgatccacacatgggtgctcatctccaacttcaagctggcctacaacatgctccggcgggcggacggcaccttcgaccgcgacctcgccgagtacctcgaccgccgcgtgccgcccgacgcgcgcgcccaggagggcgtctcctccttcgaccacgtcatcgacccgtccgtcggcctcgaggtccgcatctaccgcgccgccgccaccaacgccgcgggcgcaggcgccgccgcggtcacgctgcccatcctcgacttcctcaccggcgcgccgtccccggacccgttccccgtcatcctcttcttccacggcggcagcttcgcgcactcgtcgtccagcacggccatctacgacaacctgtgccgccggttcgtgaagctgagcaagggcgtggtgctgtccgtcaactaccggcgcgcccccgagcaccggtacccgtgcgcctacgacgacggctggacggcgctcaagtgggccatgtcgcagcccttcctccgcagcggcgagggcgcccagccccgcgtgttcctctccggcgactcctccggcggcaacatcgcccaccacgtggccgtccgcgccgccgacgccgggatcaggatctgcggcaacatcctgctcaacgccatgttcggcggctgcgagcgcaccgactcggagcggcggctggacggcaagtacttcgtcacgctccaggacagggactggtactggaaggcgtacctgcccgaggacgccgaccgggaccacccggcgtgcaacccgttcgggccgaacgggcggcgcctcagggggctccccttcaccaagagcctcatcatcgtgtcgggcctggacctcacctgcgaccggcagctggcctacgccgagggcctccgggaggacggccaccatgtcaagctcgtgtaccgcgagaaggccaccatcggcttctacctgctgcccaacacagaccactaccacgaggtcatggaggagatcgccgacttcctcagggctaacctcctctagtacatacaccaaccaaccacagctgctcatctgatcatcacactccactccactccactccacttgttatagcaagatggtaagcttgacttatactagtagttctgtcgtctcgtcgtatactgctgctgctgctgcttggggatcatcatcgtctgaattccggccatggcaagtgcactggaaggacaacctcctctgcttctgataaaaagctcaaaccaaccatggcaacttttgtttcccccctcgtcgtcgtcgtccgctgaaagaaaaaccgtctgctgctgatcgcgaagccctgcgtccctggttgatggagagaagcctattatttcgccttcaatcaccctccggctcgtccccgggggcaaattcatctaacattctgtgtacagtgatgaactgatgatggatcaacaaggcggcgtgtggtctttttgttgctcgtttgatgtagtggctctctctctctctctctctctctctctctctctctctctctctc

SEQ ID NO: 24141 - protein, 353 aa, Panicum virgatum
  misc_feature: Ceres CLONE 1844659
  misc_feature (116)..(330): Pfam Name: Abhydrolase_3 Pfam Description: alpha/beta hydrolase fold
  misc_feature: SWISSPROT Homolog: EC 3.1.1.79 Hormone-sensitive lipase
MAGSDEVNRNECKTAVPIHTWVLISNFKLAYNMLRRADGTFDRDLAEYLDRRVPPDARAQEGVSSFDHVIDPSVGLEVRIYRAAATNAAGAGAAAVTLPILDFLTGAPSPDPFPVILFFHGGSFAHSSSSTAIYDNLCRRFVKLSKGVVLSVNYRRAPEHRYPCAYDDGWTALKWAMSQPFLRSGEGAQPRVFLSGDSSGGNIAHHVAVRAADAGIRICGNILLNAMFGGCERTDSERRLDGKYFVTLQDRDWYWKAYLPEDADRDHPACNPFGPNGRRLRGLPFTKSLIIVSGLDLTCDRQLAYAEGLREDGHHVKLVYREKATIGFYLLPNTDHYHEVMEEIADFLRANLL

SEQ ID NO: 24142 - DNA, 2953 bp, Panicum virgatum
  misc_feature: Ceres CLONE 1844674
  misc_feature: Encodes the peptide sequence at SEQ ID NO. 24143
acgcccgagtctcccttcgtctcggccgcccccaaaaccacacagatccagcctcttacccttccgccacagccgatggcctccgcccagccggcgccggcaccggcgcacacagcggggccgtctctggtggacaccctctttcagcgctccctggacgacttcatcaagtccctccgcgccgacccgtcggccgccggcgagtccgcggccatcgcccgcgcgctgtccgagatccaccgcgagatccgcgcccccgacgccaccaccaaggccgtcgcgctacagaagcttacctacctctcctccctccacttcacccccgtcgcctcccacccactcgctttcccggccatcgaactcctcgcctcgccaagcctgccccacaagcgcctcgcctacctcgccgcctcgctctcgctacacccggcctcgttatccctcctcccgctcgccacgcaccagctacacaaggacctcaccccctccgcctccggcgccgcgacccaccggcacgtctccgcgcttgcgctccagctcctcggatccccccccgtcgccgccgccgctccggacctcgccgttcaccttgcgcacgatctcgtgccacacctctttcgcggcagtccacgcgccatcgcggccgccgcgcgcgtcatagccggcgcgccgtccacggccgtgccggtcctcttcaagccgctggcagcctgtctcacatcccctgacccgcgggcgtcgaccgcggctgcggcagcattctgtgacctgtcagcgccgcctgctgacgcggcccctttcctgccgctggcgcctgatctctacaacctgctcaccacttcacggtccaactgggaactcatcaaggtgctcaagctgtttgcacgtctggcccctctagagtcccgccttgccgctcgaattgtcgaccctgtctgccagctcctgacccgatctgcagccatgtcactgacctttgagtgtgtccgtacagtgctcaccgcactgccagcacatgacgccgctgtccgccttgccattggaaaagcgaaggagttccttgctgctgatgatgatcccaacctccggtaccttgggctactggcgcttggcatgcttggcccaggttatgcaacaacagtgaatgattgccgggatgttattgtgcggtcactgggtgatgccgactcaaacattcgccgggaggcattgcacctcatgatggagatggttgatgaaaacaacgtaatggacattgcaagtatgctggtcagtcatgctgcaaagtcagacccggagtttgcaaatgacattctcggggccgttctagcagcatgtgggcgtaatgtgtatgagctggttgtggactttgattggtatgcttcactgcttgcagacatggcaaggagccttcattgtgcccagggagatgagattggtcggcagcttgttgatgtgggattgcgggtgcaggatgcaaggtcagaacttgtccgttcagctcgaactctcctaattgaccctgctttgcttggaaaccacttcctctgccctgttctttcagctgccgcatggatttctggtgagtatgtggacttcatgaaggatcctgtcgagcttgttgaagcactcttgcaaccaaaggccagcctcctgcctatgtcagtgagagcagtctacatccatgcagtttttaaggtgctcactttctgtttgagtgtgtatgttgagaaattgggtgattcaagcaaggaagtggctgtagtgttcagtgggttggctattgatcaaactgttcgtggggaaagcaaggttgcacttgggtctgctgtcgagcaagatattagggcaagcacagtgcaaaaggacccattttcacatgaatctatactttacgtgattaacttgattgaaacaacagttggcccactcgttgagtgtaatgaagtagaagtccaggagagagcacgcaacctgattggttttgtccatttggtaagacatattcaagaattgaaagaaaataaggttgctgatgatgacaagcaaagcagggtaaaagagcatgtcaaaactatgcggacagtattcagtcaagaacttggtcctgtttctgcgactgcacatatgaaagtagcctctccagatggtcttaacctgaatgggaatcttgctgaactcacagacattgtgagtgaagatgatactgctccgtccacttcactctttttttatcctcgcagccgtgattctgtagagacaagagatcctgcagtgtcaatcggttcatcttctctttctgagcatcgtaaaaggcatgggctcttttatctccccacaggaaaaattgaggacgagctaagtgattacccccatgccaatgatactctaccatcttgtagtaatgaaactgttagtgatgataagtcaaagaccgttgaacctgtatttgctgggaaaaagtcgaagaccacaaagtccagaccaaaagtagttaaattggatggtgaggatttcctcagttctatgatgtctaccgcaaatgttccaaaagaagaccccttgtctggtgctctacgtggtgggctcttgggtagagacgctattgcatcaccttcacaaaaggtttcagaagtaaactctgaagcaatgctgaaagaaatgggcactaatgaatctagctttcagcggatagagaatttaggaagccatcctgcttcaagttctgtaacaagtaaacagaaccctgacaatgccaaagaatcgagaaagcacaggagctctggtagaagtggacatcgccaaggaaaacatgagcacagagaaaggtctagtactcagcctgatattgtacctcaagctccagttatacaagacttgcttctatagtggctgagagactctcgtttggtacatttcagttaccgaatacatgttgattttttgttcattc

SEQ ID NO: 24143 - protein, 937 aa, Panicum virgatum
  misc_feature: Ceres CLONE 1844674
  misc_feature (43)..(642): Pfam Name: Adaptin_N Pfam Description: Adaptin N terminal region
MASAQPAPAPAHTAGPSLVDTLFQRSLDDFIKSLRADPSAAGESAAIARALSEIHREIRAPDATTKAVALQKLTYLSSLHFTPVASHPLAFPAIELLASPSLPHKRLAYLAASLSLHPASLSLLPLATHQLHKDLTPSASGAATHRHVSALALQLLGSPPVAAAAPDLAVHLAHDLVPHLFRGSPRAIAAAARVIAGAPSTAVPVLFKPLAACLTSPDPRASTAAAAAFCDLSAPPADAAPFLPLAPDLYNLLTTSRSNWELIKVLKLFARLAPLESRLAARIVDPVCQLLTRSAAMSLTFECVRTVLTALPAHDAAVRLAIGKAKEFLAADDDPNLRYLGLLALGMLGPGYATTVNDCRDVIVRSLGDADSNIRREALHLMMEMVDENNVMDIASMLVSHAAKSDPEFANDILGAVLAACGRNVYELVVDFDWYASLLADMARSLHCAQGDEIGRQLVDVGLRVQDARSELVRSARTLLIDPALLGNHFLCPVLSAAAWISGEYVDFMKDPVELVEALLQPKASLLPMSVRAVYIHAVFKVLTFCLSVYVEKLGDSSKEVAVVFSGLAIDQTVRGESKVALGSAVEQDIRASTVQKDPFSHESILYVINLIETTVGPLVECNEVEVQERARNLIGFVHLVRHIQELKENKVADDDKQSRVKEHVKTMRTVFSQELGPVSATAHMKVASPDGLNLNGNLAELTDIVSEDDTAPSTSLFFYPRSRDSVETRDPAVSIGSSSLSEHRKRHGLFYLPTGKIEDELSDYPHANDTLPSCSNETVSDDKSKTVEPVFAGKKSKTTKSRPKVVKLDGEDFLSSMMSTANVPKEDPLSGALRGGLLGRDAIASPSQKVSEVNSEAMLKEMGTNESSFQRIENLGSHPASSSVTSKQNPDNAKESRKHRSSGRSGHRQGKHEHRERSSTQPDIVPQAPVIQDLLL

SEQ ID NO: 24144 - DNA, 1604 bp, Panicum virgatum
  misc_feature: Ceres CLONE 1844704
  misc_feature: Encodes the peptide sequence at SEQ ID NO. 24145
aaggaaaacgcgctataaaatgcggccaccgccctccgcctcccacctctctcgcgttcgaggcgaagccgacggcgagctcagcagcgccggctggccccttcctcgagaataggtgtaaattagagtaaaacatagtgatgtggcgtcactgggtttgctgcaattgccaagttgatgagtctgataagcgtgaaaataggcatatcaaggccacaaccaacaatgtcgatggtatgacaaaggggctgaaagattctgctactggaaaagtcgacccacaaaatgctgctccccctatcaatattcctgttctatccttggatgaactgatagaaaaaactgatgactttgggtcaaaggctttgataggtgaaggttcttatgggagagtgtactatgccgtccttgataatggaatgaaaatggcagtgaaaaaacttgattctactgaaaatgaagccaccaatgaattcttgacccaggtttcgttggtttcgaggctgaagcatgaaaactttgtagatatgttgggttactgtacagagcgtaatcttcgcattgtagcctttgaatttgccaccatgggttctctgcatgatgttttacatggaagaaaaggagttcaaggtgctcaacctggcccagcacttgattggatgcaacgagtgaaaattgctgttgatgctgccaaaggacttgaatatctgcatgagaaagttcagccttcgattgtccatagggatattagatcaagtaacatcctcttatttgaggacttcaaggcaaagatagcagacttcaatctctcaaatcaggctccagatatggctgcccggttgcattctactcgtgtgctgggaacctttggatatcacgcaccagagtatgcaatgactggtcaactaacccagaaaagtgatgtatatagctttggagtagttctcttggagcttttgacaggtagaaagccagtggaccatacaatgcctagaggacagcagagtctggtaacctgggctacaccaagattaactgaagacaaagtgaagcagtgtgtagatcctcggttgatgggtgaatatccagcaaaaggactcgcaaagctcgctgctgtagcagctttgtgtgtgcaatacgaagctgagtttcgcccaaatatgagcattgtggtcaaggctttatctgtgctgctcgtaagtaagcagactcaaacacctgcaccaccagtccacttgccgttgacagttgatgcatagaattaaccaaaaatgcctggaacatcctgatttggacagacagttcactctctgcaatatcagttaggctgcaaatatgataggaacaacagcttggataatgcacacaaaggctcaattcacctctcagatttcaacaactaactgcatgaaggacgtcttcagtactgcaaggagcatctgcagttctgtaacaatgttcatatttatctttcaggagacctgaattctgatgcaagtcggcattttggctggctataggaacttcatgcctgtacttgggtcaaacatataaactggaatgtacaagtcacaggaattcgttcaaaacagcttgggtctgtc

SEQ ID NO: 24145 - protein, 372 aa, Panicum virgatum
  misc_feature: Ceres CLONE 1844704
  misc_feature (59)..(348): Pfam Name: Pkinase_Tyr Pfam Description: Protein tyrosine kinase
  misc_feature: SWISSPROT Homolog: EC 2.7.11.1 Non-specific serine/threonine protein kinase
MWRHWVCCNCQVDESDKRENRHIKATTNNVDGMTKGLKDSATGKVDPQNAAPPINIPVLSLDELIEKTDDFGSKALIGEGSYGRVYYAVLDNGMKMAVKKLDSTENEATNEFLTQVSLVSRLKHENFVDMLGYCTERNLRIVAFEFATMGSLHDVLHGRKGVQGAQPGPALDWMQRVKIAVDAAKGLEYLHEKVQPSIVHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLMGEYPAKGLAKLAAVAALCVQYEAEFRPNMSIVVKALSVLLVSKQTQTPAPPVHLPLTVDA

SEQ ID NO: 24146 - DNA, 1730 bp, Panicum virgatum
  misc_feature: Ceres CLONE 1844705
  misc_feature: Encodes the peptide sequence at SEQ ID NO. 24147
ccagctgccggataagcaagcaggagtgcaggaggccagctgttgcagcaggtcggtgaggtgctgagctcacctgctcagtcagacgacctcagctgtttttacctgcaggcccctcccctctggctctaggtcttggactgagcaagctcacctcaccggcgggcggcggctcccctcccctccgcttgcttgttgaccgaatcgaccccctccggctccaggctccagattcttcagcttcaggggccgcagatgagcaaatgggctatcaagttgtaggagatttttatttcagtggagattttctgcagcgcttgaactcttggaaatcattctgccagatttgcacgattcccctccaaaaaagaatcaatctgtttgctagattggtgcagaagactcaagctttttctgaatcccattcccacctgcagattgagcaggcacagcctcacattgagaattggggatgacctagcgaggcatggaggaggtaggcatggagctggagcgcaccgcctgcaaccgcccgcgcgccgcgctggacggcggcacggcggccgcggcggcgtggcggacgtgccgggtggcgcgcgcggccgccgggggtaaggaccggcacagcaaggtcgtgacggcgcgggggctccgcgaccggcgcgtccggctctcggtgcccacggccatccagttctacgacatccaggaccgcctcggcgtcgaccagcccagcaaggccatcgagtggctcatccgcgccgccgccggtgccatcgatgagcttccctcgctggactgctctttcgccctccccgtcggcgcctcctcctccccgccggccgccggagacgatgccgtggtcagcacctccgagaccagcaagagctccgtgctctcgctcgccaacggcccgaccgacaacgccgccaccgctgctcaccaagtcaaccacgcctacaacggcggcaataccgaaaacggcagctcattcgctgagctcctgaactgctccgccaacgacagtaagccaatgcagcagcagccgacgctcgcctactacgctgcccagcttccgagctcgcacgccgcgccggccatgtccttcgagacgatgccccagctcgccttcctccaggagcagccgcaccccgcggtcggcttcgaccggggcacacttcagtccaatgtcaccgtcgctgcgccactgtggccgccatctcagcaggcgtgcttcctgcagaggttcgccgctgctccggttgatgccgctggactgtcattctttctaggaggcggcactgctgctcctccggtgacggtcaatgcagagccgaggctgcagctctgggacttcaagcaggaaaggaagacctgaaatgtgaaacccagagtttggtgtttcatatgactatttcttggagagtcgactgtaacaatgtttgctgctgtgccaagtcatctctgacaaggttaaccaagatcagaaagttcagaactgaagatatcagcgtgaggaagatattgaaaaattaatgtaccaccatatatctttcgttcgtcacttccatttgtcattcgctaagagcatgcggcttgtttgtgacacctattgctgtgatgagataccatttgttatcttttctacttcatcagttgtactctagtaatttgacactggcagacctgatggttcccatggttgcctgaatttcacacatctcctgatc

SEQ ID NO: 24147 - protein, 296 aa, Panicum virgatum
  misc_feature: Ceres CLONE 1844705
  misc_feature (34)..(223): Pfam Name: TCP Pfam Description: TCP family transcription factor
MEEVGMELERTACNRPRAALDGGTAAAAAWRTCRVARAAAGGKDRHSKVVTARGLRDRRVRLSVPTAIQFYDIQDRLGVDQPSKAIEWLIRAAAGAIDELPSLDCSFALPVGASSSPPAAGDDAVVSTSETSKSSVLSLANGPTDNAATAAHQVNHAYNGGNTENGSSFAELLNCSANDSKPMQQQPTLAYYAAQLPSSHAAPAMSFETMPQLAFLQEQPHPAVGFDRGTLQSNVTVAAPLWPPSQQACFLQRFAAAPVDAAGLSFFLGGGTAAPPVTVNAEPRLQLWDFKQERKT

SEQ ID NO: 24148 - DNA, 1287 bp, Panicum virgatum
  misc_feature: Ceres CLONE 1844707
  misc_feature: Encodes the peptide sequence at SEQ ID NO. 24149
aatagaaaagcaagccgcaaaaataatcgccaaaagagatagagagtgagaaaggagagacgcgaacgcgagggccgggggtggaagaagagggggggaaaagaagagcgagaaaagaaaatccccgtccaccgcgcgcttcccgggccggagccggcgcgagtgctgggattcagtgaggggccgggcgggagccggggccacggatcgacgagcggcagcgatgacgccgcacccgacggcgccggagccggggcccgagcaggcggcgccggcgccggaggcggcgctccccctggctgaggccgcgccggcgccggtcaagaagaagcggaacctccccgggacgccagatccggacgccgaggtgatcgcgctctcgccggggacgctgctggcgacgaaccgcttcgtctgcgaggtgtgcgggaagggcttccagcgggaccagaacctgcagctgcaccggagggggcacaacctgccctggcgcctgcgccagcgcgggcccggcgccgcgccgccgcgccgccgggtctacgtgtgccccgagcccggctgcgtgcaccactccccggcccgcgcgctcggcgacctcaccgggatcaagaagcacttctgccgcaagcacggggaaaagcgctgggcctgcccgcgctgcggcaagcgctacgccgtccaggcagacctcaaggcgcacgccaagacctgcggcacccgcgagtaccgctgcgactgcggcacgctcttcaccagacgggacagtttcgtgacgcaccgcgccttctgcggcgccctcgtggaggaggccggcagggcgctggcgccaccggcgccgccatcgcctcggccgcctgatttggaggctgaggagaatgtggacaaggacaaggagaaggggcaggaggaagaggagaacgaggactctgcagtggccgaggcggagcagcctcagcgtgtggaggcaccggtgccggaagcgccgcagcgcattccgtcaccacctccattgccacaggagccaccgcgccgtccgtctccacctccattgccaaaggagccgctgcgccgtccgtccccacctccattgccaaaggagccgccacaccgtccgtccccacctccattgccaaaggagccacagctctttccctcgccacttccatttccactggagcagcgaccagttgtggcagtggtgccaaatgtggatgagccagaggtggttcctgagacaactgtggctgccaaattggaggatgaagctgatcaagatgaagacacatg

SEQ ID NO: 24149 - protein, 354 aa, Panicum virgatum
  misc_feature: Ceres CLONE 1844707
  misc_feature (63)..(85): Pfam Name: zf-C2H2 Pfam Description: Zinc finger, C2H2 type
  misc_feature (141)..(163): Pfam Name: zf-C2H2 Pfam Description: Zinc finger, C2H2 type
MTPHPTAPEPGPEQAAPAPEAALPLAEAAPAPVKKKRNLPGTPDPDAEVIALSPGTLLATNRFVCEVCGKGFQRDQNLQLHRRGHNLPWRLRQRGPGAAPPRRRVYVCPEPGCVHHSPARALGDLTGIKKHFCRKHGEKRWACPRCGKRYAVQADLKAHAKTCGTREYRCDCGTLFTRRDSFVTHRAFCGALVEEAGRALAPPAPPSPRPPDLEAEENVDKDKEKGQEEEENEDSAVAEAEQPQRVEAPVPEAPQRIPSPPPLPQEPPRRPSPPPLPKEPLRRPSPPPLPKEPPHRPSPPPLPKEPQLFPSPLPFPLEQRPVVAVVPNVDEPEVVPETTVAAKLEDEADQDEDT

SEQ ID NO: 24150 - DNA, 718 bp, Panicum virgatum
  misc_feature: Ceres CLONE 1844707-R
tgatgatggggccatcaccactgttcgtccccaagcctgctacgctggacttccctgggctgggcatcggagggaccatgggcggctccacggccaacggtggcctcccggcattgatggttggaggagagctggacatggggtcttcggcacaggtgccggcgccatgggaggacgccaacaggaagaccaacggccgcacgatcctgtgaggttttcgttttcatgtaaccttgggggtttcgtgccttggctcgctcattctttcagtttcagtcgcagctgtgttggtggtagagctagaaactctgtacatagctcgatgcttctcccaatcctgcaattctgtctgaaaaagaaaactcgaattgaagctgttattatagccaaaattcgatcccggcaagatggaacctgacatttgatgcggtgcccgttgctttcaagatgtgaccaggtaacagggtaagtagtggcctttattaccgagatcttcggtgctactaatccagtactgtttttggaaagatccgagattaggacagcgacgctgacatgtgaaaggtgtttttactgtttgctgctgctgctgctgctgctaagtcggcatggtttcctaattacctaacctgccggccagcaacttgttcagcagccttggtacttttggaaaatttatcgtgtacttggtgtccaaaaaaaaaatccctgcttgatt

SEQ ID NO: 24151 - DNA, 2349 bp, Panicum virgatum
  misc_feature: Ceres CLONE 1844715
  misc_feature: Encodes the peptide sequence at SEQ ID NO. 24152
atatgagctgagcaaggttgggagcaagactagttgtgtagagcaaacatcgtagtgagaaaaaaaaatctcttccctggctcatagattccccaagaaccagaagaaaaaacaacacttatcagttgtttctctagccgctgctcgatctagcttttcgctatttttcttcgcattttgtagacattttcttctttcagtgttcttctacacatagtaaattcagaaccaagaaatccagccaaaaaaaattccacctctttttcctggtcattcggtcctatcttccaggcagaagccataggacaaagaaccaccatagcaagatctcggttatgttccatttgcatcagttcagccgtgtagaatcgatcccaacttgagcagcagcaagactcccatctttaggggcccttcagccgccgtcttcaggaagttgtagttccagcagcggaagaaaaagcccagtctccagctatggcggcggcgctggggtgctggtcagggcggccgagcaccgacgaggagatggtggagcaggttctcatgaagccccacggccgctcagacgactccctcccgacctgcgccgactctgcctacaccggcgagcccacgtcggcgccggtgcctcccaagaagtggcagaggctgggccgcaacttcgccggtgccatcgccgcgttcaagaacacgcttagcctggatggcggcggcctcccccgcgacccctcaccgcgcgctgagaagccaccaccgctcctcctccgcggccttgcgcagctctactcccgcggcgccaacaaccagcagctgccagagaagctcgttgccgacctccgccgccacttcgacgctctgcccaacagctgtgcacaggcaggatttgacatgaaagacgtccttttgcatgcccgccttgtagagcaggcgactggtgaggatcagcctgcagtgaacattgaggaaattcatggcaggggaggtagtgatgaaggcattacttttcagctaacatttgcttgcattgccccgctttcatggcagtcaatgtccggatcattagatagccctttgttctgttgcaagaagatccagatctttgagaagagagggttgacacttggtgttgtcatgatacttgtggagtctgggaatgaggtggtcttcaagaaccgggttgagtctgcactgaaatcggttgtaaagaagcagaggaagaacagtggtggtgtgaagctaccatttgggctttgtggttgccaagaagaaggatcaagaaactttgatgaggagtcaatgtttgacccagatgatggtcaggtacttgacaatgagccgattcgcagaccacagcttcccactcccctaccacagtcatcagtctttgtctcggtggatgaatggcaaacaatccgatctggtggtgaggagtttggacgctggatgctgcgttctgaggatattgagttcattgactgggttggtgctaattcattcaagggggtctttagaggaaagaaggtttgggtcaacaaattgaggggttgtgacatgggaagtgcttatgatgttgagatccgtcaggacttgctgcagctgatgagctgtggccagaggaacatcctccaattccatggcatttgcttcaacgaaaaccatgggctctgcatagtgacgaggatgatggaagggggatctgttcatgatattattatgcagagaaacaaaagactgtcgctccgagatacagttaggattgcccttgatgttgctgatgggctagccttcatgaatagctatggcattgcgtaccgtgatctcaattatcggaaaatcctgctagacaggcaagggaacgcttgccttggggatatgggcattgttaccccttgtaataatgtcggtgaggtcacggagtatgagacatctggatatcgatggctagctccagagatcattgctggagatcctgaaacagtctctgagacctggatgagcaacgtctacagctacggaatggtgctgtgggagatgatcaccggagaggaggcatactccacctactcgccagtgcaagcagcggttggaatcgccgcctgcgggctgaggcctgagatcccaagagactgtcctcctttcctgaggtcactgatgaacaggtgctgggacaataaccctctgaggcgccctcagttctctgagatcatatccatcctacagaggcagaatgctagatagttttcttatttttccttctacgatatgctatatatcagtttggcttggctgtttgcctaatcatgcaggaaactgcatccgataaaatataatataatatatatgtgc

SEQ ID NO: 24152 - protein, 587 aa, Panicum virgatum
  misc_feature: Ceres CLONE 1844715
  misc_feature (330)..(581): Pfam Name: Pkinase_Tyr Pfam Description: Protein tyrosine kinase
  misc_feature: SWISSPROT Homolog: EC 2.7.11.1 Non-specific serine/threonine protein kinase
MAAALGCWSGRPSTDEEMVEQVLMKPHGRSDDSLPTCADSAYTGEPTSAPVPPKKWQRLGRNFAGAIAAFKNTLSLDGGGLPRDPSPRAEKPPPLLLRGLAQLYSRGANNQQLPEKLVADLRRHFDALPNSCAQAGFDMKDVLLHARLVEQATGEDQPAVNIEEIHGRGGSDEGITFQLTFACIAPLSWQSMSGSLDSPLFCCKKIQIFEKRGLTLGVVMILVESGNEVVFKNRVESALKSVVKKQRKNSGGVKLPFGLCGCQEEGSRNFDEESMFDPDDGQVLDNEPIRRPQLPTPLPQSSVFVSVDEWQTIRSGGEEFGRWMLRSEDIEFIDWVGANSFKGVFRGKKVWVNKLRGCDMGSAYDVEIRQDLLQLMSCGQRNILQFHGICFNENHGLCIVTRMMEGGSVHDIIMQRNKRLSLRDTVRIALDVADGLAFMNSYGIAYRDLNYRKILLDRQGNACLGDMGIVTPCNNVGEVTEYETSGYRWLAPEIIAGDPETVSETWMSNVYSYGMVLWEMITGEEAYSTYSPVQAAVGIAACGLRPEIPRDCPPFLRSLMNRCWDNNPLRRPQFSEIISILQRQNAR

SEQ ID NO: 24153 - DNA, 2408 bp, Panicum virgatum
  misc_feature: Ceres CLONE 1844739
  misc_feature: Encodes the peptide sequence at SEQ ID NO. 24154
gcgatgcaacgccgcccatttcgccccgcgccaccgagctagcagccatgtcggcgtcctcccctgcctcccgctcgctcctcctctgcctcagcctcaccctgctctcccacttcgccgccgccttgcctcgcgacctccgcttctccgccgaggacatcgccgcggtggaggcggcgctgccgcgccacaggaggtcgtcgaggaccaccttcttcgaggtcgaccgcccgctgcgcccgcccaaggggagctcggggccctgctccacgctcctgctctcgcacgccttcgccttcacgctcaccaagccgcccgtcaccgcggcgtactcgccgccgagctgcctgcggggcgccggcgccgtctcgctcgcggtgctcgagtggcgcgccgagtgccgcggggtgcagtacgaccgcgtcttcggcgtctgggtcggcggcgccgagattctgcgggggagcaccgcggagccgaagcccggcggcgtggcgtggtcggtgtccaaggacgtcacgaggtacgcgccgctcctcgccgccggcaacgccacgctcgccgtgtacctcggcaacctcatcgacgacacctacaacggcgtctaccacgccaacctcacgctccacctctacttccgccgcgccgggcgcgcgcggccgccgccaccgcagccggcggcggccgacgtcgtcgtccccatctcgaggagcctgccgctcaacgacgggctctggttcgtggtccagaacgccaccgacgtgcagtccacgcgcctggcagtgccggccaacgcgtaccgcgcggtgctcgaggtctacgtgtcgtcccactacgccgacgagttctggtacatgaacacgccggagcagaacgggccgttccgcgaggtcaccgtccatctcgacggcgacatcgtcggcgcggtgtggccgttccccgtgatctacaccggcggaatcaaccccctcatctggcgccccatcaccagcattgggtccttcaacttccccacctacgacatcgagctcacgcccttcttgagcaagctcctggacggcgagcagcacgagctcgggttcgcggtgaccaacgcgcagaactcctggtacgtggacgccaacctccacctctggctcgaccccaggagctccaagaccaccggcggcctcatcgcgtacgacgcaccgaagctcgccggcagcatcgtctcgcgctccgcggacggcatcgacggcgagtacgaggcgacggcgagccgcaacatcacggccacggggtgggtgagctcgtcccgcggcaacgtgaccacgacgttcacgcagcggctcggcttcgcgaacacgaacgtggtgagcggccacggcagcgcgcaggcgatcaaccagacgacggacgcgctgaccgacgtcgccggcgggggtgcggccgcgcagcagcgggtgcagcagagcttcccgctctacatcttcctgggcggcgacggcagcggcacgccctcgcagcggctgatgcggagcgtggagatcgggttcgaggagtcgcgcgtctggggcggcggcgccgcgacgagcacgctgcggaacgagcaggcggcggcggcggaggtgacgctccgggacgacgccgtggtgggcgcgtcgtggcggatgcaccagacgtacgcgtacggcgcctccgacggcggctgctacctgaggaacgtgagcagcgtcgggtacgacgtgcttttcgaccattacgacgcgtcgtgcgccggcacgcgcggccgctgacgcccgtcgccgacagtgagcaccgtgtcggcgaccccggccgccgcgcggggcggtggcacagcggataacggccgggggaggcggggagcgacaaccgaccatggaatacaaaaccgctcgataatcgcgattatcggtgaaatttaccgttaccgatgttgactgatatcagttttcaattgatttttcgatggatttcgatccaaatttcaaaaattcaaataaatttataactagtgtggaaaaaattctataaaaaactagagcctctctatagtctagaatgatgtcacatattaaaaacaaccaccgtttgcttagacaaaaaaatgtttccaatactaaagcctgataattgatgcaaatccatcgataatcaatgcaaatcagttgatattcaataattttggttgattttctatttcctttcaccaacttgaccaaatatgtatggggtatttactatattgttgtatattatgctacaaatggatggttatactgataatttgcaatgtagattagtgttaaatattagtggtgggaagaaagacttcaatgttgacttgttgttaaatcagttaggatacaataggcttcaatgttgactataatatatatgcttatact

SEQ ID NO: 24154 - protein, 575 aa, Panicum virgatum
  misc_feature: Ceres CLONE 1844739
  misc_feature: SWISSPROT Homolog: EC 3.5.1.52 Peptide-N(4)-(N-acetyl-beta-glucosaminyl)asparagine amidase
MSASSPASRSLLLCLSLTLLSHFAAALPRDLRFSAEDIAAVEAALPRHRRSSRTTFFEVDRPLRPPKGSSGPCSTLLLSHAFAFTLTKPPVTAAYSPPSCLRGAGAVSLAVLEWRAECRGVQYDRVFGVWVGGAEILRGSTAEPKPGGVAWSVSKDVTRYAPLLAAGNATLAVYLGNLIDDTYNGVYHANLTLHLYFRRAGRARPPPPQPAAADVVVPISRSLPLNDGLWFVVQNATDVQSTRLAVPANAYRAVLEVYVSSHYADEFWYMNTPEQNGPFREVTVHLDGDIVGAVWPFPVIYTGGINPLIWRPITSIGSFNFPTYDIELTPFLSKLLDGEQHELGFAVTNAQNSWYVDANLHLWLDPRSSKTTGGLIAYDAPKLAGSIVSRSADGIDGEYEATASRNITATGWVSSSRGNVTTTFTQRLGFANTNVVSGHGSAQAINQTTDALTDVAGGGAAAQQRVQQSFPLYIFLGGDGSGTPSQRLMRSVEIGFEESRVWGGGAATSTLRNEQAAAAEVTLRDDAVVGASWRMHQTYAYGASDGGCYLRNVSSVGYDVLFDHYDASCAGTRGR

SEQ ID NO: 24155 - DNA, 2437 bp, Panicum virgatum
  misc_feature: Ceres CLONE 1844740
  misc_feature: Encodes the peptide sequence at SEQ ID NO. 24156
aatatgatgggggtcatcgttgccagatcagccctagtactgttgatgttaggcgcggccctgctggcgccggcgtcggctcagcagccggcggactgccccgacaggtgcggcaacataagcgttccctatcccttcggcatcggcccccgctgcgcccgcgactttggcttcgagctcgtgtgcaaccactcctacaaccccccacgcctcaccttcttccctccactccccacacctacttctgtcctggccgggcgccggctgaatctggccagcttgtccctcaccgacggcgaggccgtcgcgctcatcatcgcctaccgcgagtgcaacaccacggcgggctcggtcgtcagcaacagcaacgctatcgacgggaaccagacgacatacctgtccctccttggcagcactacctaccgcttgtcagcgacgaggaaccgcttcgtcgcgctcggctgccccaacctcagctacctcaccgacgacaggggctactacgttactggctgcacgtccgtctgccggccgtcacagtggaacgccgtctccccgggggcgtgcaccggcgtggggtgctgccagagcaggatcccccccaatgttagcttctacgaaccgtctgttcaagtcattgacaaggatagtttagtcttcaatgagaacaccaccgcttgccggtacgcgttcgtggcggaggacaagtggatcgagaccacctacggtgtccgcccggatttcaaccggagcgacgacttcgccgtgcccgtcgtgctcgactgggccatccggaacgccgccaactgcgccatcgcccagcgcaacaagacggactacatgtgccggagtgcctacagccgttgcgtcaactccaccaacggcgccgggtaccggtgcaactgttcccagggctacgagggaaacccctacctttacggtggatgcaaagatattaacgagtgcgaccacttggacaagtacccgtgctacggagtctgcacaaatgtgcagggaggctacaggtgtgattgccctcctggattcagcggagatgccacgaagaataatgattgccgtccaaaggacaagttcacgttagccctgaaagtagtcacaggggtcagcgttggtgtgttcctgtcggtgttcatgtgcttttggctgtacttggggctccagaagaggaagctcatcagaacaaaacaaagattcttcgagcagaatggaggagtcatcctccagcagcagatgcggcatttgggcggaggtgccagcgggttcaggatattctccacggaagagcttgagaaggccaccaacaacttcgccacggaccgtgttctcggccgcggtggtcacggtgtcgtctacaagggtgtcctggacgacaacatgatggtggccatcaagaagtcgaagatgacagaggaagcccagaccaaggagtttgctagagagatgttcatcctctcccagatcaatcataggaacgttgtcaagctcctggggtgctgccttgaagttcaagtgccaatgttggtctatgaatttgtctcaaacggcacactctaccactacatccatggcaaggaacccaaagttgacatagcacttgatacccgacttcggatagcggcggagtcggctgaggcactctcctacatgcactcgtctgcttcaccgccaatcctccatggagatgtcaagacagccaacatcctgcttgatgacaagctcaacgccaaagtttcagattttggggcgtcaaaactagcaccaactgatgaggccgagattgcaacgttggtgcagggaacttgtgggtacctggaccctgaatacctgatgacatgccaattaaccgataagagcgacgtctatagttttgctgttgttgtgctggagcttctatcaaggaagaaggcattgtacctggacgggccagaggaagataggagcctagtgtcatgcttcaccacagcagtcaaggccggacgtcatcaagagcttctggacagccaggtaagggacgagatgaatgacgaaatgctcacagagattgcaaaccttctgatgcgatgcctaagcatgaacggggaagaacggccaacgatgaagaaggtagcagagaggctggagatgctgaggagataccagcagcacccttgggctgaagctggaggcagtgacgaggagaatcagagcttgctcggcatggaatagctgaattcaaattattaccaattcaggaaggatgatgttctttatctagaagaacgaagcacatatacgtttagcttgtagattatattggttgtctatccttttggcaatcaatcaattgaggattgtaatagctcaacttgtaagattccttatggtacggttggacatgcggcctgcccatccgcaagggcgggtatttaagtagtgc

SEQ ID NO: 24156 - protein, 740 aa, Panicum virgatum
  misc_feature: Ceres CLONE 1844740
  misc_feature (442)..(712): Pfam Name: Pkinase_Tyr Pfam Description: Protein tyrosine kinase
  misc_feature (317)..(358): Pfam Name: EGF_CA Pfam Description: Calcium binding EGF domain
  misc_feature: SWISSPROT Homolog: EC 2.7.11.1 Non-specific serine/threonine protein kinase
MMGVIVARSALVLLMLGAALLAPASAQQPADCPDRCGNISVPYPFGIGPRCARDFGFELVCNHSYNPPRLTFFPPLPTPTSVLAGRRLNLASLSLTDGEAVALIIAYRECNTTAGSVVSNSNAIDGNQTTYLSLLGSTTYRLSATRNRFVALGCPNLSYLTDDRGYYVTGCTSVCRPSQWNAVSPGACTGVGCCQSRIPPNVSFYEPSVQVIDKDSLVFNENTTACRYAFVAEDKWIETTYGVRPDFNRSDDFAVPVVLDWAIRNAANCAIAQRNKTDYMCRSAYSRCVNSTNGAGYRCNCSQGYEGNPYLYGGCKDINECDHLDKYPCYGVCTNVQGGYRCDCPPGFSGDATKNNDCRPKDKFTLALKVVTGVSVGVFLSVFMCFWLYLGLQKRKLIRTKQRFFEQNGGVILQQQMRHLGGGASGFRIFSTEELEKATNNFATDRVLGRGGHGVVYKGVLDDNMMVAIKKSKMTEEAQTKEFAREMFILSQINHRNVVKLLGCCLEVQVPMLVYEFVSNGTLYHYIHGKEPKVDIALDTRLRIAAESAEALSYMHSSASPPILHGDVKTANILLDDKLNAKVSDFGASKLAPTDEAEIATLVQGTCGYLDPEYLMTCQLTDKSDVYSFAVVVLELLSRKKALYLDGPEEDRSLVSCFTTAVKAGRHQELLDSQVRDEMNDEMLTEIANLLMRCLSMNGEERPTMKKVAERLEMLRRYQQHPWAEAGGSDEENQSLLGME

SEQ ID NO: 24157 - DNA, 1910 bp, Panicum virgatum
  misc_feature: Ceres CLONE 1844748
  misc_feature: Encodes the peptide sequence at SEQ ID NO. 24158
agcctcgcctcgcacgcaggctcgcagcctcccccgcgacccgacaccgccgacgccccacgcctctaccgccgctgcccaccgtctccgccgacgcccctccggcaaagcttaccccggttcgtttgccctgcctcgccgcgcgcatcagcaacccccctgcgcgaggagggctcgtatcgacaccgacatctcagaccgcagagcagagaagaggaacatcctacatggatgtcatgcagacaagtgactcttcacatcatggaattgtagagaatagcccatatagaatcccatatagcagaaatgcagaaggcggcaaacttggtaattcgtggtattttagtagaaaagaaatagaagaaaactccctttcgaggaaagatggcattgatctgaagaaggagtctcatcttcgcaagacgtactgcgtttttctgcaggatttgggaatgaggcttcaagtgcctcaagttacgattgctacagctatagtattctgtcatcgttttttccttcgtcaatctcatgcaaaaaatgataggcggacaattgcaacagtttgtatgttcttggcgggaaaagttgaagaaacccccagacctcttagggatgtcatactcctttcctatgagatcattcacaaaaaagatcctgctgcggttcagcgaatcaagcagaaggaagtatatgaacaacagaaggaacttattttacttggggagcgtgttgttctcgtaacacttggttttgacttgaatatccaccatccgtataagcccttggttgaagcaataaagaaattcaagattgctcaaaatgcacttgctcaagttgcctggaactttgtcaatgatgggctccgcacttcactttgcctgcaatttaagccccaccatattgcggccggtgcaatcttcctggctgcgaaatttctcaaagtcaagcttccatcagatggcgagaaagtctggtggcaagagtttgatgttaccccacggcatttggaagagattagcaaccaaattttggagctctacgagcaaagtaatgttgcgccaccaccatcacaaggaaatgatacggataggagccccgctagtgttgctaatcatcgtgtgtccgggaaagctccaggaactgttggtgcacctactgcccatgaacaccatcaagcatccagacagtcgagccagcaaaacatgccaggccgccgtggctatgaccaccctgatccagagaagcaaaactcaaaccagaggacgccacagaatgacgcaaaggatggtgaggctcccaaaatgtcatcctcgatgatggatgcgatgaagaagatagacaaggataaggtgaaagcagccctggagaagcggaggaaatctaaaggtgacgtttctagaaaggttgacatgatggatgatgatgaccttattgagagggagctggagcatggtgtggagttggctgctgagggtgagaaggtcaagcaggagagaaagcagagttggtcccatccttctgctcaccgggaggaccagcagaaggccgctcgcgtgacgggaactactgaggagggcgagctgtccactgatagccaagaacaccattccccaacccttgacagtcggaggaggaacgacgtccatgagcaccggaactatgaccgcggtgaaagggacattaaaaggcttaggccatgagcaccggaagctgttgtttgtagtgtattgcatgtggcttcaggttatatatgatgactgtatgttgtagaacctatttttctgccgcaggcgttgaataagcatcaggctcattcggtatgctgggaaatttgaaatgaggtacatgatgtaagagatggcctccccgaggggcaagtctatatagcaagcactgttgatattgatatc

SEQ ID NO: 24158 - protein, 490 aa, Panicum virgatum
  misc_feature: Ceres CLONE 1844748
  misc_feature (35)..(178): Pfam Name: Cyclin_N Pfam Description: Cyclin, N-terminal domain
MDVMQTSDSSHHGIVENSPYRIPYSRNAEGGKLGNSWYFSRKEIEENSLSRKDGIDLKKESHLRKTYCVFLQDLGMRLQVPQVTIATAIVFCHRFFLRQSHAKNDRRTIATVCMFLAGKVEETPRPLRDVILLSYEIIHKKDPAAVQRIKQKEVYEQQKELILLGERVVLVTLGFDLNIHHPYKPLVEAIKKFKIAQNALAQVAWNFVNDGLRTSLCLQFKPHHIAAGAIFLAAKFLKVKLPSDGEKVWWQEFDVTPRHLEEISNQILELYEQSNVAPPPSQGNDTDRSPASVANHRVSGKAPGTVGAPTAHEHHQASRQSSQQNMPGRRGYDHPDPEKQNSNQRTPQNDAKDGEAPKMSSSMMDAMKKIDKDKVKAALEKRRKSKGDVSRKVDMMDDDDLIERELEHGVELAAEGEKVKQERKQSWSHPSAHREDQQKAARVTGTTEEGELSTDSQEHHSPTLDSRRRNDVHEHRNYDRGERDIKRLRP

SEQ ID NO: 24159 - DNA, 2024 bp, Panicum virgatum
  misc_feature: Ceres CLONE 1844753
  misc_feature: Encodes the peptide sequence at SEQ ID NO. 24160
atcacccccgcagcaactgtgccggtgtgccacttgctgtcggccagctagagcttgagctgagtaagagagggagggttggtgttcagttcagagcatggacaccatcgaggagtgcggcgacggagaccggcacctgctctccggctccaggatactcgtcggcgtgccggacaactcccgggggtgctccgagctcctgtcttgggcgatcggcgccgtcgccaaggccaacgactccgtcgtcgccgtgcacgtcctcggagggagggggaggaagaagaggctgcagaaggcgaacgccttcgtcatctacatgctcggcgagttcgtcgaagcctgcgaggccaaacagatcaatttggaggctaaggtggttcgcagctcaaacattgggagagccctgacccaagaagctgcactgactgatggaaacatccttattgttgggagatcaagaaatgcataccataggagccattttgagattgcaaactactgcttcatgcatgctccaaaaaactgctctgtgatagctgttggaagagaaggcctaccacaatgtaatacccgattgaagtctcggtcattcgatgcagagagcaatatatcctcaagctcaacatggagcagaaggttcccaccacttcagaagctactcagatcaaactcaatgagaaaactggctcaatctagtaaggaagatgccgaggacaagagttcacctagagcggttcttgatggtccagaagaaagggagcaccaagtcactgaagaatgctacaacacgtctagccatgaggtgagccggcgtggccaaaatggcctatggaggcggttgtcggacatgaagctctggcttccattcctaaggacaatcggcgatgacagcgctagggccagcgatgctggttcggcgtatgccgaagatcagaagcctgcctggaggtgcttcagctttcaggagatttcagtggctactaatgacttccatccaggtatctcttttcaatcatttcattaaattatcagtatttctgtccaggctagtgtatgcaaattgaaagagtttctgaagatcactgaatttggcatcataagaagtacagcaatgggatcagtatacaaataattcattcagtttcaagaattttgtctactcttatgtaacaaaagtttactgatttggtgtcatcataagtgaggcatctgtaatcttttatggtttcttgtagataacttggcgggaagaggaggctatgcagaagtatacaagggcgtcctatctgatggccagcaagtagctgtgaagaggctggcaaaaggcacgcccagtgaacagaaggagaaagagttcctggcggaactagggattcagggacatgtatgccacccaaatacatcatatcttcttggatgctgcgttgagaatggactatacctgatatttgaattctgcgcaaatggaactctagcatcggcattgcacgggaagagtggtaaaacccttgaatggcctttgaggtacaagattgcggttggtgttgcaaggggcttgcaatatctgcatatgttctgcaggcatagaatcatccatcgtgacatcaaggcctccaatgtgcttcttggtgatgactttgaacctcagatttcagactttggactagcaaagtggctccccaagcagtggactcatcactctgtcatacctatagaaggcacatttgggtacttggcaccagaatatttcatgcacggcatcgttgatgagaagactgacatattcgcttttggggttctgctgctggagattgtcactggaaggagacctattgactgctccaaacaaagccttttgcagtgggcaaagccactcctggaggctgggcaagcgactgaacttgccgacccgaacctcggagatgactatgacaaggatcaactgaagaggatgatcgccgtctcgtcccgctgcattatgcgaccggcaatgtggcggccctcaatggccgaggtcctgcatt

SEQ ID NO: 24160 - protein, 308 aa, Panicum virgatum
  misc_feature: Ceres CLONE 1844753
  misc_feature (17)..(149): Pfam Name: Usp Pfam Description: Universal stress protein family
MDTIEECGDGDRHLLSGSRILVGVPDNSRGCSELLSWAIGAVAKANDSVVAVHVLGGRGRKKRLQKANAFVIYMLGEFVEACEAKQINLEAKVVRSSNIGRALTQEAALTDGNILIVGRSRNAYHRSHFEIANYCFMHAPKNCSVIAVGREGLPQCNTRLKSRSFDAESNISSSSTWSRRFPPLQKLLRSNSMRKLAQSSKEDAEDKSSPRAVLDGPEEREHQVTEECYNTSSHEVSRRGQNGLWRRLSDMKLWLPFLRTIGDDSARASDAGSAYAEDQKPAWRCFSFQEISVATNDFHPGISFQSFH

SEQ ID NO: 24161 - DNA, 2406 bp, Panicum virgatum
  misc_feature: Ceres CLONE 1844758
  misc_feature: Encodes the peptide sequence at SEQ ID NO. 24162
cgcgacgcgttccgcccggttcacgcggcagccggtcgccacgccatggccggcgacggcgggggcgccgcggagagggtggcggcgggcgtcgaggcggcggcggcgggcggctgggatttccggaacgcgtaccggcggcagctcctggcactgtcgcgccggattcggctcctcggacccttcgccgaggagcttcgggaggcgcgccggggccccgcggagaaggagcgggagcgggcgctggcgccgctcgccgacgcgctggagaaggcgctcgacctgctccggctcggccgcgacgggagcaggatcttcctggtccttgagagggataatgtaatgaagaagtttcaaggagtaattgcccagctggagcaagctttgtgtgattttccatatgataagttggatatatcagatgaagttagagagcaggttgagttagtgcatgcacagctcagaagagcaaaagaacgggcagacatgcctgatgatgagttctacaatgacgtactgtctctgtataacaagagctatgacccaagtgctgaactggatatccttgaaagattgtcagaaaagttacacctgatgaccatcactgatctcacacaagaatcacttgctttgcatgagatggtggcatctggtggtggtcaggatccaggagaacacattgagaaaatgtcaatgctattgaagaagatcaaggactttgtgcaaactcaaaaccctgagatggggccaccaataggtgccaagctaatggattccaatggggagccaagacctgtaaacattcccgatgagttccggtgtccaatttctcttgagctaatgaaagatcctgttattgtttctactggccagacatatgagcgggcatgcatcgagaagtggctagcttctggtcaccatacttgtccaaatactcagcagaggataacaaacacaacactgacaccaaactatgttcttagaagtcttattgcccagtggtgtgaggccaacgggattgagccacccaaacgttcatcacaacctaacaagcctacatcagcatgctcttcaagcgaacgtgctaacatcgatgctcttctgtcccgattatgctctcatgatcctgaggagcagaggtcagctgctgccgaactccggctcctagcaaagcggaatgcaaacaaccggatttgcattgctgaggctggtgccattcccttactactgagtctcttgtcttcatctgacctgcggactcaagaacatgctgtgactgcacttctgaacctctccatacatgagtataataaggcaagcatcatttcctcaggtgctgtgccgagcatagttcatgttctgaagaatggcagcatggaagcacgggagaatgctgcagctacacttttcagcctctcagtgatcgatgaatacaaagttacaattgggggaacaggggctatccctgcccttgtagttcttttaagtgagggcagccaacgggggaagaaagatgcagcagcagctctattcaacctttgcatttatcaagggaacaagggtcgtgcaatacgagctggtcttgtgccgctcatcatggggctggtgacaaaccccacaggagctcttatggatgaggctatggcaatactgtcgatattgtccagccaccctgaggggaaggcggctattggcgcagcggagcctgttcctgttcttgtggagatgattggaagcgggtcaccaaggaatagagagaatgctgcagctgtgatgttgcatctttgcagtggtgagcaacaacttgtgcatttggcccgtgcacaagagtgcagcatcatggtcccgctacgggagctgaccctgaacggcacggagaggggaaagagaaaggcggtgctgctgcttgagcgaatgagcagattcctggttcagcaacaagaggaaaaggaagcccagctgctggcatccgcacaggccattcctcggatcccggaacagctccaagagaccgacatccctgaacaattggacagtccttcacctcaatatcccgcagtcgcatgatgatgaatgaatatatttgcaacaatactgcaaaaaggttgggcaagcagtatctgagtcacttggcttctagattcatgattcatatactgattgagagtttttaagctatcagagtcacttctaatcggtgatgatcccagacgcttcatcccatgcttggttgctgaagctcccatcgcaccacctgtttctgggtatgtaaattatcccagaatgttaagatgtgtacagtctagtaaagatgttgctccagatgtcatgtagctattattagtatatgtacattttcactatgacactatataaaagagaagttatagcggcggacataatatc

SEQ ID NO: 24162 - protein, 673 aa, Panicum virgatum
  misc_feature: Ceres CLONE 1844758
  misc_feature (378)..(418): Pfam Name: Arm Pfam Description: Armadillo/beta-catenin-like repeat
  misc_feature (460)..(500): Pfam Name: Arm Pfam Description: Armadillo/beta-catenin-like repeat
  misc_feature (419)..(459): Pfam Name: Arm Pfam Description: Armadillo/beta-catenin-like repeat
  misc_feature (542)..(582): Pfam Name: Arm Pfam Description: Armadillo/beta-catenin-like repeat
  misc_feature (252)..(326): Pfam Name: U-box Pfam Description: U-box domain
MAGDGGGAAERVAAGVEAAAAGGWDFRNAYRRQLLALSRRIRLLGPFAEELREARRGPAEKERERALAPLADALEKALDLLRLGRDGSRIFLVLERDNVMKKFQGVIAQLEQALCDFPYDKLDISDEVREQVELVHAQLRRAKERADMPDDEFYNDVLSLYNKSYDPSAELDILERLSEKLHLMTITDLTQESLALHEMVASGGGQDPGEHIEKMSMLLKKIKDFVQTQNPEMGPPIGAKLMDSNGEPRPVNIPDEFRCPISLELMKDPVIVSTGQTYERACIEKWLASGHHTCPNTQQRITNTTLTPNYVLRSLIAQWCEANGIEPPKRSSQPNKPTSACSSSERANIDALLSRLCSHDPEEQRSAAAELRLLAKRNANNRICIAEAGAIPLLLSLLSSSDLRTQEHAVTALLNLSIHEYNKASIISSGAVPSIVHVLKNGSMEARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLCSGEQQLVHLARAQECSIMVPLRELTLNGTERGKRKAVLLLERMSRFLVQQQEEKEAQLLASAQAIPRIPEQLQETDIPEQLDSPSPQYPAVA

SEQ ID NO: 24163 - DNA, 674 bp, Panicum virgatum
  misc_feature: Ceres CLONE 1844769
  misc_feature: Encodes the peptide sequence at SEQ ID NO. 24164
aattggagcactgatccggttttctcaccagggaaagctggttaagcaatacgttggatacttcccatatgtcaacttatctgcaattgtgagcccaatcactaggacggttcttaaagttgacctgcatataacgcctgattttgtgtggaaagatcgttatcatggcatgtcagaacgatggtggattattgttgaggattctgaaaatgacaccatctatcactctgagctattcacactgacaaagaagatggcaagaggaacacccacaaagatatcttttaatataccaatatttgaacctcacccaccacagtactatatacgagccatatcagactcatggttacatgctgagtcactctttactgtttcttttcataatctgacattgccacagacacaaataacgcacactgaacttttggacttgaagcctcttccgctgagtgctcttggcaacaaaacatatgaggatctctacagattttcacatttcaatccgatacaaactcaggctttccatgttctttatcacacggataataatgtacttttgggagctccaactggaagtggaaagacaatttcggcagaactagcaatgcttcatcttttcaatactcaaccggacatgaaggtagtttacattgcccctctactctcgctag

SEQ ID NO: 24164 - protein, 224 aa, Panicum virgatum
  misc_feature: Ceres CLONE 1844769
  misc_feature (1)..(127): Pfam Name: Sec63 Pfam Description: Sec63 Brl domain
IGALIRFSHQGKLVKQYVGYFPYVNLSAIVSPITRTVLKVDLHITPDFVWKDRYHGMSERWWIIVEDSENDTIYHSELFTLTKKMARGTPTKISFNIPIFEPHPPQYYIRAISDSWLHAESLFTVSFHNLTLPQTQITHTELLDLKPLPLSALGNKTYEDLYRFSHFNPIQTQAFHVLYHTDNNVLLGAPTGSGKTISAELAMLHLFNTQPDMKVVYIAPLLSL

SEQ ID NO: 24165 - DNA, 2048 bp, Panicum virgatum
  misc_feature: Ceres CLONE 1844794
  misc_feature: Encodes the peptide sequence at SEQ ID NO. 24166
aactccaagcaaccaccaccactcccaatttcacttcacctcgacagcgcactccccacccaccggtctccctctccctcccctccaccaccaccgaatcccaggtaggggcaggcagagagcagagcggcggcagggggacctctccctcctctcctctccttcccttcctcacccccttcgcccggcgagccagccagccatggagccgccggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgcgctggcgcgggcgctcgtcgactactacccgctcgcggggcgcctcgccgtgtccgacggcgccggcgggctccacgtcgactgcaacggcgagggcgtctggttcgtcgaggccgccgtgcggtgccggctcgaggacgtcgagtacctcgagtacccgctgcagatccccaaggacgacctgctcccgcacccgctgccgcgccccagccgcgaggaggagaacaagctcatcctgctcgtccaggtgaccacgttcgggtgcggcggcttcgtggtggggttccggttcagccacgcggtggcggacgggctgggcgccgccaagttcatgggcgcggtgggggagctggcgcgcggggcggaccagatctcgccgcccccgacctggggccgcgacgccatcccggacccggccggcgcgcacgtcggcagcctccccgagctggacggcgccaagcgcctcgagtacctggccatcgacatctccgccgactacatcgaccacttcaagtcccagttcgcggcggcgtcgggcgggggccggtgctcggccttcgaggtgctcatcgccaaggcgtggcagagccgcacccgcgccgcggcgttcgacgccggcaccaccgtccacctctgcttcgccatgaacgcgcggccgctcctcgccgcccgcctcccgcgcgccggcgtcggcttctacggcaactgctactacatcatgcgcgtgtcctccacggccgggaaggtctccacctcctcggtcaccgacgtggtgcggatcatcagggaggggaagaagcggctgccgtcggagttcgcgcggtgggcggccggggaggaggccggggacccgtaccagatcacctccgactaccggacgctgctggtgtcggactggacgcggctgggcttcgccgaggtggactacgggtggggcccgccggcccacgtggtgccgctgacgaacctggactgcatcgccacgtgcatcctcgtcaagccctgggcccacaagccaggggcgcggctcatcacgcagtgcgtgacgcccgaccgcgtcgccgccttccacgacgccatggtggacatgaactgctagtagtagtccacaccttccatctgacgcacatggttcttttaaactcttcaattaaattaccgcggtaattagcagggggtaatggcattaaacagcccttctggtggtgaagagcgacagcaaagaataaagtcagaaagtgacaaaatatcgataaaaagtacatagagccagcaggtacgggggacaccggtagacagctagatggtagttggcaaaatagtgggattggtattgttccttgtttcctttggatgtcttcttcttttgttggtggtggtgggaggcaaaggtctaggactctaggtgtgtgtgtatacatgtcctcgtttcttcttattttctgctgtcagttcttggggggctttgattgaaggaaggatgatcaaagctggacttggtgggaagccaccaactaacctccccctaaatctcaatacaaagatgtggattagatgacctgtattatagtattcaacatttttttttcttctttgtcacatatacacaagccaataataatgagtacagcctttgaaaagtggattct

SEQ ID NO: 24166 - protein, 431 aa, Panicum virgatum
  misc_feature: Ceres CLONE 1844794
  misc_feature (6)..(429): Pfam Name: Transferase Pfam Description: Transferase family
  misc_feature: SWISSPROT Homolog: EC 2.3.1.167 10-deacetylbaccatin III 10-O-acetyltransferase
MEPPAKTVERLAQRLVPPAEPTPTGPHRLSWLDRYPTQMALIESLHVFKPDPARDGVSPAETIQRALARALVDYYPLAGRLAVSDGAGGLHVDCNGEGVWFVEAAVRCRLEDVEYLEYPLQIPKDDLLPHPLPRPSREEENKLILLVQVTTFGCGGFVVGFRFSHAVADGLGAAKFMGAVGELARGADQISPPPTWGRDAIPDPAGAHVGSLPELDGAKRLEYLAIDISADYIDHFKSQFAAASGGGRCSAFEVLIAKAWQSRTRAAAFDAGTTVHLCFAMNARPLLAARLPRAGVGFYGNCYYIMRVSSTAGKVSTSSVTDVVRIIREGKKRLPSEFARWAAGEEAGDPYQITSDYRTLLVSDWTRLGFAEVDYGWGPPAHVVPLTNLDCIATCILVKPWAHKPGARLITQCVTPDRVAAFHDAMVDMNC

SEQ ID NO: 24167 - DNA, 721 bp, Panicum virgatum
  misc_feature: Ceres CLONE 1844798-R
  misc_feature: Encodes the peptide sequence at SEQ ID NO. 24168
gcatgttgtggctctcgatgctctgggacacgtttatacatggggcagaggatactgtggagccttgggccatggtgatgagaataataaaactagcccagaattgatcagcagtctgaagagccaagttgctgtgcaggtatgcgcaaggaagagaaagacctttgttctcacagatgagggctcagtttatgcgtttggatggatgggctttgggagtttagggtttcctgaccgaggatcatctgacaaagtaatgaagccccgcattctcgagagcctgcggggtcactatgtctcccaaataagtaccggactatatcacactgttgctgtgacatataaaggcattgtatttgggtttggggacaatgaacgagcgcaacttgggcatgaatacattcgtgtgtgcttgaaacctactgagataatgttccagaagactatggaagatatagcgatcgcggcacctagtggttgaattcaagacccaaaaccaccattttggacactgttgcctgcatatgttgtatttataaggtattcttctcggcaactgtattttatactgtgatttgtgagtaattgggtgaacagaagaagatcgaggttggaggacagtgttgtgtagctaaagaagcatatagtctagtaatgtgtgatgtattgaataatttaacccaccatttttcctctgtataaaaaatattggtgtgtttgc

SEQ ID NO: 24168 - protein, 159 aa, Panicum virgatum
  misc_feature: Ceres CLONE 1844798-R
  misc_feature: SWISSPROT Homolog: EC 2.7.11.1 Non-specific serine/threonine protein kinase
HVVALDALGHVYTWGRGYCGALGHGDENNKTSPELISSLKSQVAVQVCARKRKTFVLTDEGSVYAFGWMGFGSLGFPDRGSSDKVMKPRILESLRGHYVSQISTGLYHTVAVTYKGIVFGFGDNERAQLGHEYIRVCLKPTEIMFQKTMEDIAIAAPSG

SEQ ID NO: 24169 - DNA, 1296 bp, Panicum virgatum
  misc_feature: Ceres CLONE 1844798
aagaattccctctgcgtgctggcgcggcggctcccctctgtttcctctcgccatcggcttccccctttcggctccccccgcggcgtagcttttggagtctgcgttcgtccgtccgtgcgtgtgagatcgcgtgcaagcgcacgcacgcgcgccgattttcgaagagttggggggcaaggaatcccccgattaggaaagattccccgctcccacgcgtcaaatcccatcccctgatccccccagcacggccgccctcgattagcttccggttgctgctgccgaggtcgggattggtgctggaattcggtgcgggggagctgttccgcgcccaattcggccgcccccctccgcgcgattcgattggttcccaccggggcttgctgcttccgccgccgggggtgctcccagctgctcgagctgggcggcggagtctccgggtgataccctccgctgctcgatctaattcggtccccagccgccgcagctcccccgcggccgcttcctgctgattccggcgccatttcgacccgcgcggccggatccttggatgattccgatcgatccgggaccaagaggaccagggcttcgtcacctcaccagggccccggcggcggtggatccatggcgggggagaaggcgtcgcgtgcgttctccatcgaggagctcccgggccacctcgtcggggaggtcctgacctccggcaggctcacggccgccgacctcgcaaggctcgaggccacctgccgcgcgctcaggccgctcgcggagtacgccgcgtccaagctctgcgtcgcgcgggcggcgttcgcggccatggggcctgcggcgaggggggacctgctggagcggtgcgggggcagctggaagaaggtgctcaggttccttcagtccatcgagcagtcgtccggcacagtcgcgacctcatcgggcagcatgcaagtagccacaggaggatatcacacacttttggtccgtgactcttctctctattcttgtggatccagcttgtgtggtgtgctaggtcatggcccagatactacacagtgtgcagcattcagtcgggtttcctttccatcactttcccgtgttatcaacatctctgcctcgcacaaccatgctgcttttgttacggagtctggtgaggttttcacctgtggtgataattcatcattatgctgtggtcatggtgaagtggggaggacgatatttcgaccaacgcaagtagaaacacttaaaggggtttcttgcaagcaggtcgccactggtctaagttttactgtgattcttacaagggat

SEQ ID NO: 24170 - DNA, 1217 bp, Panicum virgatum
  misc_feature: Ceres CLONE 1844812
  misc_feature: Encodes the peptide sequence at SEQ ID NO. 24171
attctcacctttcccaggcagcaaccgtaagctgtggaggaagaaagaacctttgtgcggtgctttcttgcaggaaatattcctgccttttgtgtttgcggtcgtgctcatgctcatgcggggtgctagttcctcactttgagtacattgtgaggtctatatataggtggttcgtggtgatcagagccacacaggcaagatggcgacctttcacaagatcacccttgttctcatattctgcctggtaaccttggggagatcagagtatctcaagtacaaggatccgaagcagcctgttgctgttcgtgtcaaggatctgcttagtcggatgactcttgctgaaaagattggccagatgacccaaattgagctgaaaaatgccacagccgatgtattggctaagttcttcataggcagtgtacttagtggtggaggcactgtgcctgctcctcaagcatctgctcaggcttgggcctccacggtgactgagctgcaaaagggcgctctttccacccgccttggcattccgttcatctatggtatagatgcggtgcatggtcacaacaatgcctacaaagctactatcttcccccacaacgttggtcttggagctactagggaccctgatcttgtcaagagaataggagaagcaacagctcttgaagttagagctactggaattcaatacgtctttgctccctgtattgcggtttgtagagatccaagatggggacgctgctacgagagctacagtgaggacccgaagattgtccagtcaatgacctcactcatctctggtttgcaaggcgaagtaccggcgaatgacgtgggaagaccatatgttgctggaagtaagaatgttgctgcttgtgcaaagcactacgttggtgatggtggcacatatctgggaatcaacgagaacaacacaatcatcgacacacatggactgctgagcatccatatgcctccttactataattctattatccgaggcgtctccactgtcatggtctcatactcaagctggaacgggaaaaaaatgcacgcaaaccatttcctagtcactgattttctcaagaacaagctcaagtttaggggttttgtgatttctgactgggaaggcattgaccgcatcactgatcctcctcacgctaactattcctactccattgaggctggagttggtgctggtattgacatgatcatggttccacaca

SEQ ID NO: 24171 - protein, 339 aa, Panicum virgatum
  misc_feature: Ceres CLONE 1844812
  misc_feature (101)..(337): Pfam Name: Glyco_hydro_3 Pfam Description: Glycosyl hydrolase family 3 N terminal domain
  misc_feature: SWISSPROT Homolog: EC 3.2.1.21 Beta-glucosidase
MATFHKITLVLIFCLVTLGRSEYLKYKDPKQPVAVRVKDLLSRMTLAEKIGQMTQIELKNATADVLAKFFIGSVLSGGGTVPAPQASAQAWASTVTELQKGALSTRLGIPFIYGIDAVHGHNNAYKATIFPHNVGLGATRDPDLVKRIGEATALEVRATGIQYVFAPCIAVCRDPRWGRCYESYSEDPKIVQSMTSLISGLQGEVPANDVGRPYVAGSKNVAACAKHYVGDGGTYLGINENNTIIDTHGLLSIHMPPYYNSIIRGVSTVMVSYSSWNGKKMHANHFLVTDFLKNKLKFRGFVISDWEGIDRITDPPHANYSYSIEAGVGAGIDMIMVPH

SEQ ID NO: 24172 - DNA, 105 bp, Panicum virgatum
  misc_feature: Ceres CLONE 1844812-R
aggaagcacgcccccgggcacggcgcaccccccccacccagcacgccggcacagcagaagcaagacgacaacgaacgccgaaaggcagggagcgaccgggccacg

SEQ ID NO: 24173 - DNA, 2032 bp, Panicum virgatum
  misc_feature: Ceres CLONE 1844822
  misc_feature: Encodes the peptide sequence at SEQ ID NO. 24174
acggcgttacttcgcttgctcttgctcccccgctccgttcccgcctcccgagggcgcgctccaccaccaccgcccgccgcctcctcctcctccgtgcccggcctccccacctctctctctcgagccaagataagccggatcggaatgctgacgcgtgcgcctgctccttgtgtcttccccatccagccggcgccccgccccgtgatggtcgcggccgcgccgctcgcgctcccgctcccgctcccggcctcgccggcgctcccgctccgcggtgccccgcccgtggccgcgcgccccatctcccaccgccccgcgctcgcgccggtgccctccgtcctcctctcgcccccgctggccgcagcctcctcgcgccccccggcggacgacgtccccgacggtgactcctcgcacctcctcgccgtccccgtccccgtcaccatggaccccgccgccgccgaagatgcagccgtcgccaaccaagtgcccgaggtggcgccgcgcccgccggagcgggacttcgccggcacgccctacgtccccgtatacgtcatgctccctcttggagtagtgaatgtcaatggtgaggtggtggacgcggacgagttggtgggccagctgcgggtgctcaaggcagctggggtggacggggtcatggttgactgctggtgggggaacgtcgaggcgcacaggccccaggagtacaactggactggctacaagcgcctcttccagatgatcagggagctcaagctcaagttgcaggcggtcatgtcattccacgaatgtggtggcaatgttggagatgatgtgtccattcctctcccacattgggtaatagagattggaaggagcaacccggatatctactttactgacagggcaggaaggcgtaataccgagtgcttatcatggggaattgataaggaaagggttctacaaggccgaacagcagtggaggtatattttgacttcatgagaagcttccgagtggagtttgatgagtattttgaggatgggatcatctcggaaattgagattggactaggggcttgtggagagctgcggtatccatcttatccagcaaaacatggctggaaataccctggcattggagaatttcagtgctacgacaggtacttacagaaaaatttgagaagagctgcagaagcacgaggacatactatatgggcaagagggccagacaatgctggccattataattctgaaccaaatctcactgggtttttttgtgatggaggagactatgatagttattatggtcgttttttcctcaactggtactctcagatgttggtggatcatgcagaccgtgtcctcatgttagcaaggttggcttttgagggttcaagcatagctgttaaggtttctggagtgcactggtggtacaaaactgcctgtcatgctgctgaactaactgctggtttttacaacccatgtaaccgtgatggctatgctccaattgctgcagtgttgaagaaatatgatgctgctttgaactttacatgtgttgaattgcgcactatggaccagcatgaggtataccctgaggcatttgcagatccagagggcctggtatggcaggtgctaaacgctgcatgggatgctgggatacaagtggctagtgagaacgctttaccttgctacgatagagatggattcaacaagattttggagaatgccaaaccactgaatgacccagatggacggcatttgtttggattcacctacctgaggcttagcaaagttctgtttgagaggcgcaactttttcgaattcgagcgctttgtcaagagaatgcacggtgaggtggttcttgatctgcaagtatagattgctagcgtattacatacacatatacaagtgattctgattggcttaggccttaaggcttacattttcgctctttcctttttgtttcgtaggtagtagtatcagctgattttgacctgttacatagaactcgctgctctatttgtaaaggctatttttatatacatataccctagatttg

SEQ ID NO: 24174 - protein, 548 aa, Panicum virgatum
  misc_feature: Ceres CLONE 1844822
  misc_feature (114)..(534): Pfam Name: Glyco_hydro_14 Pfam Description: Glycosyl hydrolase family 14
  misc_feature: SWISSPROT Homolog: EC 3.2.1.2 Beta-amylase
MVAAAPLALPLPLPASPALPLRGAPPVAARPISHRPALAPVPSVLLSPPLAAASSRPPADDVPDGDSSHLLAVPVPVTMDPAAAEDAAVANQVPEVAPRPPERDFAGTPYVPVYVMLPLGVVNVNGEVVDADELVGQLRVLKAAGVDGVMVDCWWGNVEAHRPQEYNWTGYKRLFQMIRELKLKLQAVMSFHECGGNVGDDVSIPLPHWVIEIGRSNPDIYFTDRAGRRNTECLSWGIDKERVLQGRTAVEVYFDFMRSFRVEFDEYFEDGIISEIEIGLGACGELRYPSYPAKHGWKYPGIGEFQCYDRYLQKNLRRAAEARGHTIWARGPDNAGHYNSEPNLTGFFCDGGDYDSYYGRFFLNWYSQMLVDHADRVLMLARLAFEGSSIAVKVSGVHWWYKTACHAAELTAGFYNPCNRDGYAPIAAVLKKYDAALNFTCVELRTMDQHEVYPEAFADPEGLVWQVLNAAWDAGIQVASENALPCYDRDGFNKILENAKPLNDPDGRHLFGFTYLRLSKVLFERRNFFEFERFVKRMHGEVVLDLQV

SEQ ID NO: 24175 - DNA, 1915 bp, Panicum virgatum
  misc_feature: Ceres CLONE 1844828
  misc_feature: Encodes the peptide sequence at SEQ ID NO. 24176
ctggcattccgttcggctgttgggctgcagccgttcggtatcctctcccacctcgcacactcgccgccgcctccacattcgccgccgccttccgccgtcggcctcgtcccgtccttgccacggcctccagcggcgagatccagccgggagcgggcagttcctcgcaggcaccggaagattcgcccccaccgccgcctccctcgtctacccaacgttcaagtcgaagcaccgcgggggcgacccgggcgaccgggatccggggtcccgcccaccaccgtggcagggacccgggctcccggcggacgccgactcccgccgcccgggtgcagcgcgctcgtggcgatcccgctagtctcctgcggcaggtacgctccgcctcgcacctaccctcgccgagttgatgtagtatttttcttccctctctcgtgcgagcgcgctcgtctcctccgcgcctccatctcctcaggtttggacttcggagtcagcggtatggagggctgccgcgacgccaagaggggtgccgcggctacggcggcggacgacctccccgacgacgccgtcgtggagatcctctcccgcgtccccgtgaggtccatccaccggttcaagtgcgtctcgaagcgctggcgcgacctcattgccgaccccctccaccggaagcggctcccccagacgctcgaaggatttttctgcagcgacggaggcggattcggctggcgcttcatcagcctgccggggagatccgcgcctcccgttgacccttccttctccttcctgacgaagctgcccgggatcgagaacatcaagctcttgggttcctgcaatgggctcctcctctttgagcatggccggaaaccggacacggcaccggcctacgccgtttgcaaccctgccactggggaatgggtggccgtgcccagcgccagctgtcgctctcctgatcccctggaagagcgcaccgagttgattttttatccggctgtatcgccacacttccacttggtccatatctgctatgaacatgttaagattgaggtgcgtgcctactcgtccgagaccagggtgtggagtgacatggtaagccaaaagagtggatggcaggatggtggatggaaacaatgggttaatggtggagccatgctgagatccacgttccgtggtgcctttgtcaatggcatgctgcatttaatcaccttccgttctgagtatccttgggagaatcaaatagttgcggtggatatcaaagggaagacgagtaggatcattccctggccagatacgagcagttgcccactttttgttggtcaatcccaagggcgccttcattgcatgggtagacttgatgaatgggaaagaaagtgtttaaaatgggctggcctgtgcatttgggttcttgaggactatgatacaggaggatgggtcctcaagcacagggtgagcttcttgaagctgtttggacaaatgagtcgctatgtttatgaaagatatgagctcgccattcatccggatcgcaacatgattttccttactgaattgagcaaccagaagctgatggtatatgacatggacaatgagaatttggatgccttccacactcttggacacaactatgggtctcttattccatatgttcccaatttcttgattttggtgcttacaaatgagcattgaaatgttgattttggagtacacatgggcatattcttcaggaaattgatcccatgtatggaaaatctagcatgtagcatccttagtagcgagtaattactaaatgcgagttcttggttgctcagtgcttatttatgctgaacaagctaatctaccatatattgtaagcaatgcatgtatcagaaaagcttaaatataaaactctgtcaactgtcatattaagatagaaagctgcccaattatatag

SEQ ID NO: 24176 - protein, 393 aa, Panicum virgatum
  misc_feature: Ceres CLONE 1844828
  misc_feature (14)..(61): Pfam Name: F-box Pfam Description: F-box domain
MEGCRDAKRGAAATAADDLPDDAVVEILSRVPVRSIHRFKCVSKRWRDLIADPLHRKRLPQTLEGFFCSDGGGFGWRFISLPGRSAPPVDPSFSFLTKLPGIENIKLLGSCNGLLLFEHGRKPDTAPAYAVCNPATGEWVAVPSASCRSPDPLEERTELIFYPAVSPHFHLVHICYEHVKIEVRAYSSETRVWSDMVSQKSGWQDGGWKQWVNGGAMLRSTFRGAFVNGMLHLITFRSEYPWENQIVAVDIKGKTSRIIPWPDTSSCPLFVGQSQGRLHCMGRLDEWERKCLKWAGLCIWVLEDYDTGGWVLKHRVSFLKLFGQMSRYVYERYELAIHPDRNMIFLTELSNQKLMVYDMDNENLDAFHTLGHNYGSLIPYVPNFLILVLTNEH

SEQ ID NO: 24177 - DNA, 650 bp, Panicum virgatum
  misc_feature: Ceres CLONE 1844830
  misc_feature: Encodes the peptide sequence at SEQ ID NO. 24178
ctctcctcccttggcccttgctcttccttccctggcgaccacggctgggcgagcggcggcgccatttatcacgtattcacccagccctttgccggcgccaggcatccaccaggcagaggccgtatagaggtgccgctatattgcttactcagtggctggctatgcaatctgcttatgacttccgtttcccgagattctgtctgcatcttgcccctgatctgccgaccttcactacaattgatgctttagaaaggggctctagcattggcagtgatctgagctcacggcgttcaaagcctgtacgcacgcttcaaagagatggtcccgtggcaagcttttcaaaagaaagaatacccccatcgtcgccgacaaatcgaaagaaatgtatgagagcagccggttgcgccattgcgctgatcttgttggtgttcttcgcatatgcttcttggagatatttccatgtattcctctctgaaggaaactctgaataccatgtggttcttgattgtggcagcacaggtacaagagtgtatgtctatgaatggccacatcaatcataatgatgcccatggattttcctatttgtttgaaaccttttagggaatgctcctaacaacaaatttggcaaattaacctagactgtaccaagc

SEQ ID NO: 24178 - protein, 132 aa, Panicum virgatum
  misc_feature: Ceres CLONE 1844830
  misc_feature: SWISSPROT Homolog: EC 3.6.1.6 Nucleoside-diphosphatase
MQSAYDFRFPRFCLHLAPDLPTFTTIDALERGSSIGSDLSSRRSKPVRTLQRDGPVASFSKERIPPSSPTNRKKCMRAAGCAIALILLVFFAYASWRYFHVFLSEGNSEYHVVLDCGSTGTRVYVYEWPHQS

SEQ ID NO: 24179 - DNA, 1968 bp, Panicum virgatum
  misc_feature: Ceres CLONE 1844837
  misc_feature: Encodes the peptide sequence at SEQ ID NO. 24180
ttcttcagttcttctttccttgcaagcagaggggaacaggggaggagggggaaaaaaaatagagaggagagacctcgcagctcacgcgcacacgccaaaccccaatcggagccgctgccgccgacgccgatccggagcaaggtatcaaatccatggcgagcggaggcgatggcgcagggagcggcgagtccccgcctgctgccgcgggggaggcgccggccgcggcgggggcgacgctgcacatccggtgcgcgaacggctccaagttcacggtgcaggccgacctggctgccacggtgggcgcgttcaaggaggtcgtggccgggagctgtgacgtgccggcgccgcagcagcgcctgatctacaagggccgtatcctcaaggacgagcaaaccctagaaagctacggcgttgaaacagatcacacaattcacttggtgcgtggtgttgccgcaccggctgcatcaggtgcacctgctgctgccagtccccttgcttcatctactcctagcagtggcccagcaggtggcctgggaggcctatttccaggtgttggtgctccaagaagtggcaggccatcaggtttatttggagcaggatttccagaattagagcaagttgagcagcatttaagccagaatcccaacttgatgagggagatgatgaatatgccagcaatgcaaaatctcatgaacaacccagatttaatacgcaatatgatcatgagcaacccacagttgcgcgagatcatggatcggaatccagatcttgcccatgtgctcaatgacccgagtgtcctccgccaaactcttgaagctgctagaaaccctgaaatcatgagagagatcatgcggaacacggacagagctatgagcaacattgaatcttctcccgaagggtttaatatgctccgacgaatgtatgaaactgtccaggagccattcctaaatgcaacaacaatgggcggggaaggcaacacagcctcaaacccatttgcagctcttcttggcaatcagggttctaaccaacctggtcaaccggcaacaaatgctccaattcctggttctgagtcaacaacaggaacccctgctccaaatactaatccacttccaaatccctggagcaccaatgctgggggtgcacaaggagcagcacggtccggtcctactagcaatgcaagaactggtgccactgggagcctgggagggttgggttcaccagatttgagtagtttgctcggtggtcttgctggcagtcaaagatctggtgctgctggtggtctaggagggttgggatcagcagatcttgggagcatgcttggtggttcagctgatgcttctttccttaatcagatgctgcaaaaccccgcaatgatgcagatgatgcagagcattatgtctgatccacagaccatgaaccagttgcttaacttcaacccgaatgcacgcaacctgatggaatcaaacactcagctgagggaaatgttccaaaatccagaatttcttcgccagttgacatcgccagggactttgcagcaattactctcatttcagcagaccttattaggacagcttggtcaacaacaacctagccaggatggcaacaatttgggcagcgccacaggtacccaaggaaaccctagccttgacaccttgatgagcatgctcagcgggcttggatcaggaggtggccttggtgttccaaataattccaatgtgccgccggaggagctgtatgcaacacagcttactcagctccgagaaatgggtttcattgacaatgcggagaacatccaagcactgcttgctactgctgggaatgtacatgccgcggtggagcgcctccttggtaatcttggccagtagccaaagcgagtcagaggctgctcaaaattccgcgcacctgcaggagtgtccccggcttgctgttttttgagcccagaatttgaaggcggtgcccatagtccgg

SEQ ID NO: 24180 - protein, 570 aa, Panicum virgatum
  misc_feature: Ceres CLONE 1844837
  misc_feature (32)..(100): Pfam Name: ubiquitin Pfam Description: Ubiquitin family
  misc_feature (527)..(564): Pfam Name: UBA Pfam Description: UBA/TS-N domain
MASGGDGAGSGESPPAAAGEAPAAAGATLHIRCANGSKFTVQADLAATVGAFKEVVAGSCDVPAPQQRLIYKGRILKDEQTLESYGVETDHTIHLVRGVAAPAASGAPAAASPLASSTPSSGPAGGLGGLFPGVGAPRSGRPSGLFGAGFPELEQVEQHLSQNPNLMREMMNMPAMQNLMNNPDLIRNMIMSNPQLREIMDRNPDLAHVLNDPSVLRQTLEAARNPEIMREIMRNTDRAMSNIESSPEGFNMLRRMYETVQEPFLNATTMGGEGNTASNPFAALLGNQGSNQPGQPATNAPIPGSESTTGTPAPNTNPLPNPWSTNAGGAQGAARSGPTSNARTGATGSLGGLGSPDLSSLLGGLAGSQRSGAAGGLGGLGSADLGSMLGGSADASFLNQMLQNPAMMQMMQSIMSDPQTMNQLLNFNPNARNLMESNTQLREMFQNPEFLRQLTSPGTLQQLLSFQQTLLGQLGQQQPSQDGNNLGSATGTQGNPSLDTLMSMLSGLGSGGGLGVPNNSNVPPEELYATQLTQLREMGFIDNAENIQALLATAGNVHAAVERLLGNLGQ

SEQ ID NO: 24181 - DNA, 3499 bp, Panicum virgatum
  misc_feature: Ceres CLONE 1844858
  misc_feature: Encodes the peptide sequence at SEQ ID NO. 24182
gcaaccgcaactgcaatcccctttcccctcgtgctcctccccttccctcctctctaaccgcattggattcgattcaccgcaatccccttctcctgaagccagcccaagcccagacatggggtcgaggaggggaaggcggcagcagcagcaggagcaggaggagggctcacagcctccgcacccgcggcctgctgctgctggaagaggcggtcgtgctcagcaggcaccgcaaggaggaggtcgtggggggaaccaggggcgcccatctcctgttcacgaggcccaccagcagcagcccaggggtcgccctggagagcatccgggcaggggacatgctcgcggtcgcggtggaactggaacgcggccgcaacagtacccacgtgctggtgctggtgctgctacgggtggccaggggttatccacaggaccatcaagccctttggctcccgagctgcgccaagcaatgcaagctccacatgagcttcctcaagcctcaccaccgcaggcaggtccttcacaatcaccacccgagattcagcccatggaggagcacaaactcgctgcaggccaccaggctgtgcctgcaattccctcctcaagcaagtcactcaggtttcctttgcgcccaggaaaaggtagtgttggcaccaggtgtttggttaaggccaatcatttctttgcccaacttccagacagggatcttcatcactacgatgtctctatcacaccggaagttacatcacgacttcttagtcgagccataatcaaggagctggtaaatctccacaagcaatcttacttgggtgggcggcttccagcctatgatggtaggaagagcctatacacagcgggcccattgccatttacttcccaggaatttcatatcacgttacttgatgatgatgatggctctggttccgagaggcgacgtaggaaatttaaggtagtcattaaatttgctgcacgagccgacctccaccgtctcgagttgtttttagctgggaggcatgcagaagctcctcaagaggcactgcaagttcttgatattgtgctgcgggagctgccttctgcaagatatgcaccatttggccggtccttcttttcgcctgacttaggccgaaggcagccccttggtgatggattagaaagctggaggggattttaccagagcattaggcctactcagatgggcctctcactgaacatcgatatgtcagcaacggctttcattgagccattacctgtaattgaatttgttgcacaactgctgaattctgacattcactctaggcccctctcagatgcggaacgtgtgaagatcaagaaggccttgagaggagttaaggtggaagttactcatcgtggcaacatgcggagaaagtatcggatatctgcattaacaactcaggcgactcgagagttaacttttcctgttgatgaagggggcacaatgaagtcagttgtacaatactttcaagagacatatggcttttccatccaacacacctaccttccttgccttcaagttggcaatcaacagcgtccaaattacttgcctatggaggtctgcaaaatagtggaaggacagaggtattccaagagattaaaccaaaatcagataagagctctcttggaggagacatgccagcacccacgtgatcgtgagcgcgatataattcggatggttaaacataatgcctatgatagggatgattacgcgcaagagtttggcattaagattagcgatcgtctggcatcagtagaggcacggattttaccagctccacggcttaagtacaatgagactggtcaggagaaggattgcttacctagagttggtcagtggaatatgatgaacaagaaaatggtaaatggtggcaaagtcagaagctggatatgtgtcaattttgctcgcaatgtgcaagagagtgttgttcgtgggttctgtcatgaactcgcactgatgtgccaagcgtcaggaatggactttgctcgggagcctgttcttccacctctatatgcacgtcctgatcaagtggagcgagctctaaaagctaggtaccatgatgccatgaacgttcttggaccccaacgaaaggaacttgatttacttattggaatactacctgacaataacggttcactttatggtgatttgaagcgtgtgtgtgaaatagatcttgggatagtttcgcagtgctgttgtacaaagcaggtgttcaaaatgaacaaacaaattcttgcaaatcttgctctgaagataaatgtcaaggttggaggcaggaataccgtactggtagatgcagtctcaaggcggattcctctggtaactgacagacctacaattatatttggtgctgatgtgactcatcctcatcctggagaggacagcagcccttcaattgctgctgttgtggcctcccaagattggccagaagtgacaaagtatgctggattagtttctgctcaagctcatcggcaagaattgatagaggatttatataaggtctggcaagacccgcagagagggacagttagcgggggaatgataagggagctacttatatccttcaaaagatcaacaggggagaagccccagcgaataatattttacagggatggtgttagtgaaggacaattttatcaagttctgctatatgagctcaatgcaatccgaaaggcctgtgcctccctggaagcaaactaccaacctaaggtgacttttgttgtggttcagaagcgccatcataccagattatttgctcacaaccacaatgatcgaaattcaattgacaggagtggaaacatactcccaggtacggttgtagattcgaagatctgccatcctactgaatttgacttctacttgtgcagccatgctggcattaagggcactagccgtccagctcattatcatgtcttgtgggatgagaacaacttctctgctgatgggttgcagactcttaccaacaacctctgttacacatatgcaaggtgcacacgctctgtatcaatcgttccaccggcatattatgctcacctggctgccttccgtgctcgtttctacatggaaccagagacctcggacagtggttctatggcaagtggtcctgcaggccatggaccacaatcagcatcccgtagcactcggacccctggtggtgcagctgttaggccacttccggctctgaaggataatgtaaagagggtcatgttctactgctgaggctaggctttggcggcttatggactaccctcacttgtaaatatgggaggagagagtaataatctggcagctgctattttacgtgctggactgttaccgtttgctataccgatctccatatgctaggatgtgtcactcatgctgtctcttgtaatggtaataccctcggttgtttgtgagtaattccgtctgtcccatatgtgtcatgtaaagcaattggtatttcagtatggtgctttttaagctccgtgggaggagcctgtggcggcaatt

SEQ ID NO: 24182 - protein, 1036 aa, Panicum virgatum
  misc_feature: Ceres CLONE 1844858
  misc_feature (665)..(986): Pfam Name: Piwi Pfam Description: Piwi domain
  misc_feature (375)..(512): Pfam Name: PAZ Pfam Description: PAZ domain
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
MGSRRGRRQQQQEQEEGSQPPHPRPAAAGRGGRAQQAPQGGGRGGNQGRPSPVHEAHQQQPRGRPGEHPGRGHARGRGGTGTRPQQYPRAGAGAATGGQGLSTGPSSPLAPELRQAMQAPHELPQASPPQAGPSQSPPEIQPMEEHKLAAGHQAVPAIPSSSKSLRFPLRPGKGSVGTRCLVKANHFFAQLPDRDLHHYDVSITPEVTSRLLSRAIIKELVNLHKQSYLGGRLPAYDGRKSLYTAGPLPFTSQEFHITLLDDDDGSGSERRRRKFKVVIKFAARADLHRLELFLAGRHAEAPQEALQVLDIVLRELPSARYAPFGRSFFSPDLGRRQPLGDGLESWRGFYQSIRPTQMGLSLNIDMSATAFIEPLPVIEFVAQLLNSDIHSRPLSDAERVKIKKALRGVKVEVTHRGNMRRKYRISALTTQATRELTFPVDEGGTMKSVVQYFQETYGFSIQHTYLPCLQVGNQQRPNYLPMEVCKIVEGQRYSKRLNQNQIRALLEETCQHPRDRERDIIRMVKHNAYDRDDYAQEFGIKISDRLASVEARILPAPRLKYNETGQEKDCLPRVGQWNMMNKKMVNGGKVRSWICVNFARNVQESVVRGFCHELALMCQASGMDFAREPVLPPLYARPDQVERALKARYHDAMNVLGPQRKELDLLIGILPDNNGSLYGDLKRVCEIDLGIVSQCCCTKQVFKMNKQILANLALKINVKVGGRNTVLVDAVSRRIPLVTDRPTIIFGADVTHPHPGEDSSPSIAAVVASQDWPEVTKYAGLVSAQAHRQELIEDLYKVWQDPQRGTVSGGMIRELLISFKRSTGEKPQRIIFYRDGVSEGQFYQVLLYELNAIRKACASLEANYQPKVTFVVVQKRHHTRLFAHNHNDRNSIDRSGNILPGTVVDSKICHPTEFDFYLCSHAGIKGTSRPAHYHVLWDENNFSADGLQTLTNNLCYTYARCTRSVSIVPPAYYAHLAAFRARFYMEPETSDSGSMASGPAGHGPQSASRSTRTPGGAAVRPLPALKDNVKRVMFYC

SEQ ID NO: 24183 - DNA, 440 bp, Panicum virgatum
  misc_feature: Ceres CLONE 1844861
  misc_feature: Encodes the peptide sequence at SEQ ID NO. 24184
gcgctgggcgttgaggccggggccgagtgaagtgacactgacactgtgggagagtgaccgtcaccgtccgtccccgagcagctaactgcagctagctaccgacggccgcagggagcccggccatggagagcggcgacctgcggggagcggcggcggagtacgcgcaggacgggtccgtggacctgcgcggcaaccccgtgctccgctccaagcgcggcggctggacggcctgctccttcatcgtcgtgtacgagctgttcgagcggatggcgtactacgggatcgcgtccaacctcatcatctacctgacggacaagctccaccagggcaccgtggaggcctccaacaacgtcaccaactggtccggcaccgtcttcctcacgccgctgctcggcgcctacgtcgccgacgcgtacctcggcaggtactggaccttcgtc

SEQ ID NO: 24184 - protein, 105 aa, Panicum virgatum
  misc_feature: Ceres CLONE 1844861
  misc_feature: Useful for making plants with altered carbon content
  misc_feature: Useful for making plants with altered nitrogen content
MESGDLRGAAAEYAQDGSVDLRGNPVLRSKRGGWTACSFIVVYELFERMAYYGIASNLIIYLTDKLHQGTVEASNNVTNWSGTVFLTPLLGAYVADAYLGRYWTF

SEQ ID NO: 24185 - DNA, 2507 bp, Panicum virgatum
  misc_feature: Ceres CLONE 1844875
  misc_feature: Encodes the peptide sequence at SEQ ID NO. 24186
accgcatcgaccgggacggtctctccagacgctgcctagcatcctctcttcctgacctcccagccctccctccaagcagtctctccgatccttgagcccgcagccagccatgaggccgggcggaggaggaggaggaggagacccgcagggcggcgacggcggcgcgacgcggcggaccgcggcggccgggcaggccatggtggagctgcaggccaacgcgtcggcggcggcgggcggcgccgccatggtggtggggctcagcccgctcagcgagacgctgtggcgggacagcaaggcgctcccgccgggcgccggccccgccgcgctcatcgcggacgtgtcggccaggctcacctggaaggacctctgcgtcaccgtggcgctgggccccggcaagacgcagacggtgctggactcgctcaccggctacgccgagcccggctcgctcaccgcgctcatggggccctcgggctccggcaagtctacgctcctcgacgccctcgccggccgcctcgccaccaacgccttcctctccggcaacgtgctcctcaacggccgcaagaccaagctctccttcggcgccgcggcgtacgtgacgcaggacgacaacctgatcgggacgctgacggtgcgggagacgatcggctactcggcgctgctgcggctgccggacaagatgccgcgggaggacaagcgcgcgctggtggagggcaccatcatcgagatggggctccaggactgcgccgacaccgtcatcggcaactggcacctccgcggggtcagcggcggcgagaagcgccgcgtcagcatcgcgctcgagctcctcatgcgaccgcgcctcctcttcctcgacgagcccaccagcggcctcgacagctcgtcggcgttcttcgtgacgcagacgctgcggggcctggccagggacggccggacggtgattgcatccatccaccagcccagcagcgaggtgttcgagctcttcgacatgctcttcctgctgtcaagtggcaaaaccgtctacttcggccaagcatcgcaagcatgtgagttcttcgcttcagccggtttcccttgcccgcctctgaggaatccgtcggaccatttcctgaggtgcgtcaactccgactttgacaaggtgaaggccaccctcaaaggatcaatgaaagcaaggattgagaggtccgacgacccactggataggatgaccacatcagaggccatcaggaagttgattgcatcatacagcaggtcccagtactactacgccgcaagggagagagtcaatgatatctcacgaataaaaggaaccgtgctggattcaggtggcagccaggccagcttcctgatgcaggcttgcaccctgaccaagcgctcgttcatcaacatgtcacgggactttgggtattactggctcaggcttctcatctatctcctcgtgaccgtctgcatcggcacaatatacctggacgtcggcaccaaatacacatccatcctggcccgggctgcttgttctgcattcgtctttgggttcgttacatttatgtccatcggaggattcccttcatttgtcgaagaaatgaaggttttccagcgggaacggctgaatgggcactatggtgttgcggcatttgtcatcagcaacaccatctcagcaacaccgttcctgattctgatatgctttttgtcgggaaccatatgctactttatggttcgcctccatcccggtttcgaacactatatcttcttcgtcttgaacttatacgccagtgtcaccgtggtcgagagcttaatgatggtcattgccagtgtaattcccaattttctcatgggtatcatcataggagctggaattcagggaatatttatgctggtgtctggatacttcagacttccgtacgacatcccaaagccattttggagataccccatgcagtacctcagcttccattactgggcactgcagggccaatgccaaaacgacatgaaaggcctcatatttgacaaccagtacccagatcaacccaagatccctggggactttatcctgaagtacatcttcgagatcaacgtggacaggtccaagtggattgacctgtcggttatcttcagcatgatcttcatctaccgcagcctgttcttcctcatgatcaaggtaaacgaggacgtgctgccatggatccgtggcaacatcgccaggaaaaggatgcagaacaaagccccgagctccaccttcggcaagacgccctccctacgaggctatgttgtggatccagagcttgggtccaacgagggctagaggacaaagctggttgttttgggtggtagcaggaataggcatttctctcccagctcttggtgttatattgtacgtatttaaaagatgagaggaactggtatcctacgttttggagccgaagctaatttgggtacaggtatacatacatgtaatgtgagcaaagcggcatgggaaagatgccgagtgaaacataactgattgttcaggattt

SEQ ID NO: 24186 - protein, 728 aa, Panicum virgatum
  misc_feature: Ceres CLONE 1844875
  misc_feature (111)..(300): Pfam Name: ABC_tran Pfam Description: ABC transporter
  misc_feature (413)..(625): Pfam Name: ABC2_membrane Pfam Description: ABC-2 type transporter
  misc_feature: SWISSPROT Homolog: EC 3.6.3.28 Phosphonate-transporting ATPase
MRPGGGGGGGDPQGGDGGATRRTAAAGQAMVELQANASAAAGGAAMVVGLSPLSETLWRDSKALPPGAGPAALIADVSARLTWKDLCVTVALGPGKTQTVLDSLTGYAEPGSLTALMGPSGSGKSTLLDALAGRLATNAFLSGNVLLNGRKTKLSFGAAAYVTQDDNLIGTLTVRETIGYSALLRLPDKMPREDKRALVEGTIIEMGLQDCADTVIGNWHLRGVSGGEKRRVSIALELLMRPRLLFLDEPTSGLDSSSAFFVTQTLRGLARDGRTVIASIHQPSSEVFELFDMLFLLSSGKTVYFGQASQACEFFASAGFPCPPLRNPSDHFLRCVNSDFDKVKATLKGSMKARIERSDDPLDRMTTSEAIRKLIASYSRSQYYYAARERVNDISRIKGTVLDSGGSQASFLMQACTLTKRSFINMSRDFGYYWLRLLIYLLVTVCIGTIYLDVGTKYTSILARAACSAFVFGFVTFMSIGGFPSFVEEMKVFQRERLNGHYGVAAFVISNTISATPFLILICFLSGTICYFMVRLHPGFEHYIFFVLNLYASVTVVESLMMVIASVIPNFLMGIIIGAGIQGIFMLVSGYFRLPYDIPKPFWRYPMQYLSFHYWALQGQCQNDMKGLIFDNQYPDQPKIPGDFILKYIFEINVDRSKWIDLSVIFSMIFIYRSLFFLMIKVNEDVLPWIRGNIARKRMQNKAPSSTFGKTPSLRGYVVDPELGSNEG

SEQ ID NO: 24187 - DNA, 2512 bp, Panicum virgatum
  misc_feature: Ceres CLONE 1844879
  misc_feature: Encodes the peptide sequence at SEQ ID NO. 24188
atcatcagttaccctccctccctccctccccgtgttttcgctaggtttgtggctgctctcccgttccctccgccgccgccctgccctgacctcgacgcgccgccctgtccctccgctcgcaccgtcgtggcgccactgcgtcaggtttattccatcgcatcgcgcgctgccagcgcggcgcggcacccgtcgtcgtcccttcctccttggcgaacggaaacaaagcgcgaacgacaagatctggggggtacggcggcgccggccgacatccacccgctggctgctgctaccagtggtctagctaatatataccgccatatcccccggctccctgccgcgtgcgcgtcggtgcccatccacggacctgaccctcctccagctaccagctcactcccactccactcgaccgcgcgctccaaggtcggttgggttccttggccactcgccagggaggcgccgccagcatgaagtacagcaaggaggacaagcccgagcgggcggcgggcggcgccggcgcggggggcagggcggtgccggtggcgctcctcgtcatcgtgctctgcgccttctccttctacctcggcggcgtctacagcacgggccgcagcctgctggattgcatccagccggcgccgactctcctcgccctcggcaccaccgccgcccagcaatcctccgccctggccctgccagcgccgtccaccgccgccgccgccgtgtcgttccccgagtgccccgccgacttccaggactacaccccctgcaccgacccccggcgctggcggcgctacggcaactaccgcctcagcttcatggagcgccactgcccgccgccgccggagcgccagcagtgcctcgtcccgccgcccaaggggtacaagccgcccatccgctggcccaagagcaaggaccactgctggtaccgcaacgtcccctacgactggatcaacagccagaagtccaaccagcactggctcgccaaggacggcgaccgctttcgcttccccggcggcggcaccatgttccccaacggcgtcggcgcctacgtcgacgccatgcgcgcgctcatcccggggatgcgcgacggcaccgtccgcaccgcgctcgacaccggctgcggcgtcgccagctggggcggcgacctcctcgcccgcagcatcctcgccgtctccctcgcgccgcgggacaaccacgaggcgcaggtgcagttcgctctagagcgcggcatcccggccatcctcggcatcatctccacgcagcgcctccccttcccctcggcggccttcgacatggcgcactgctcgcgctgcctcatcccctggaccgagttcggcggcctctacctcctcgagatccaccgcctcctccgccccggcggcttctgggtgctctccggcccgcccatcaactacgagaaccgctggcacggctggaataccaccgcgcaggcgcagaaggccgacctcgaccgcctcaagaagatgctcgccgccatgtgcttcaaactctacaacatcaagggcgacatcgccgtctggcagaagtcgcccgacgccgccgcctgctacgacaagctcacgcccatcaccacgccgcccaagtgcgacgacagcgtcgacccggacgccgcctggtacgtgcccatgcggccctgcgtcaccgcccccagcgccaggtacaagaagctggggctcaacgccacgcccaagtggccgcagcggctcgccgtcgcgccggagcgcatcaacgtcgtccccggcagcagcgccggcaccttcaagcaggacgacgccaggtggaagctcagggccaagcactacaagacgctgctgccggcgctcgggaccgacaagatcaggaacgtcatggacatgaacacggtctatgggggattcgcggccagcatcatcaaggaccccgtctgggtcatgaacgtcgtctcctcctacgggcccaactcgctcggcgtcgtctacgacagaggcctcatcggcgtcaaccacgactggtgtgaggcattctcgacatacccacgcacctatgatcttttgcatcttgatggcctgttcactgcagagtctcacaggtgcgagatgaagtttgtacttcttgagatggaccgcatccttcgccccaccggttatgcgataatcagggagagcacctacttcctggattctgtagaagccattgccaaaggaatgagatggagctgtgagaggcgtaaccctgaaaacaaggatgacaaggacaagatcctaatctgccagaagaagctttgggcaggaaagcagtgagagggaattgcttgatccaagtataaaaagaaagaattcttaacccggatgggtgctatgttgatcccctcgatggtatacggctcaaatgtgctgtgatctcagccacctaggcaaaggcgcttcaccatccggtacacatgaaacatgaacactctgatgtacaagaatgttcgaagttaagataaataagagtaaacctccgtataggatcc

SEQ ID NO: 24188 - protein, 610 aa, Panicum virgatum
  misc_feature: Ceres CLONE 1844879
  misc_feature (214)..(309): Pfam Name: Methyltransf_11 Pfam Description: Methyltransferase domain
  misc_feature: SWISSPROT Homolog: EC 2.1.1.41 Sterol 24-C-methyltransferase
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
MKYSKEDKPERAAGGAGAGGRAVPVALLVIVLCAFSFYLGGVYSTGRSLLDCIQPAPTLLALGTTAAQQSSALALPAPSTAAAAVSFPECPADFQDYTPCTDPRRWRRYGNYRLSFMERHCPPPPERQQCLVPPPKGYKPPIRWPKSKDHCWYRNVPYDWINSQKSNQHWLAKDGDRFRFPGGGTMFPNGVGAYVDAMRALIPGMRDGTVRTALDTGCGVASWGGDLLARSILAVSLAPRDNHEAQVQFALERGIPAILGIISTQRLPFPSAAFDMAHCSRCLIPWTEFGGLYLLEIHRLLRPGGFWVLSGPPINYENRWHGWNTTAQAQKADLDRLKKMLAAMCFKLYNIKGDIAVWQKSPDAAACYDKLTPITTPPKCDDSVDPDAAWYVPMRPCVTAPSARYKKLGLNATPKWPQRLAVAPERINVVPGSSAGTFKQDDARWKLRAKHYKTLLPALGTDKIRNVMDMNTVYGGFAASIIKDPVWVMNVVSSYGPNSLGVVYDRGLIGVNHDWCEAFSTYPRTYDLLHLDGLFTAESHRCEMKFVLLEMDRILRPTGYAIIRESTYFLDSVEAIAKGMRWSCERRNPENKDDKDKILICQKKLWAGKQ

SEQ ID NO: 24189 - DNA, 1264 bp, Panicum virgatum
  misc_feature: Ceres CLONE 1844891
  misc_feature: Encodes the peptide sequence at SEQ ID NO. 24190
aaaaagcacaaagctttagcgcatacaagggcaaccaagcttaacacaatcctcaacacacacacacacacacacacacctcgaaagctccagcagcgggacaagccagccagcctcgtcgtcatggctcccaacctcagcaaggccacgccggacctgctcggcgacgcggccgcccccgtcgagggcctcaaggcgccgtcgcgcttcacgctcaagggcaaggacctcgccgtcgacggccacccgttcctgctcgacgtgccggccaacatccgcctcatcccggcgtcggcgctggtgcccgtcgccgcggcgggcggcagcttcctcggcttcgacgcgccggcggccaagagccgccacgtggtgcccgtcggcaggctccgcggcacccggttcatgagcatcttccgcttcaaggtgtggtggacgacccactgggtaggcgacagcggccgcgacgtggagaacgagacgcagctgatggtgctcgaccgctccggcgccggccggccgtacgtgctgctgctccccatcgtcgagggcgccttccgcgcctgcctcgagtccggcaaggtggacgactacgtggacatggtggtcgagagcgggtcctcggcggtgcgcggcgccgtgttccggagctccctgtacctgcacgccggcgacgacccgttcgagctggtgagggaggccgtgcgggtggtccgcgcccacctcggcacgttccgcaccatggacgagaagaccccgccgccgatcgtggacaagttcgggtggtgcacgtgggacgccttctaccttaaggtccacccggagggcgtgtgggagggcgtccgccgcctttccgagggcggctgcccccccgggctggtgctcatcgacgacggctggcagtccatctgccacgacgacgacgacccggcgtccggcgccgagggcatgaaccgcacctccgccggcgagcagatgccctgccggctcatcaagttccaggagaaccacaagttccgggactacaagcagggcgggttgggcgccttcgtgcgggagatgaaggcggcgttcccgaccgtggagcaggtgtacgtgtggcacgcgttgtgcgggtactggggcggcctccgccccggcgtgcagggcctgccgccggccaaggtggtggcgcccaggctctccccgggcctgcagcgcaccatggaggacctcgccgtcgacaagatcgtcaacaacggcgtcgggctcgtggaccccaagcgcg

SEQ ID NO: 24190 - protein, 380 aa, Panicum virgatum
  misc_feature: Ceres CLONE 1844891
  misc_feature (29)..(380): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
MAPNLSKATPDLLGDAAAPVEGLKAPSRFTLKGKDLAVDGHPFLLDVPANIRLIPASALVPVAAAGGSFLGFDAPAAKSRHVVPVGRLRGTRFMSIFRFKVWWTTHWVGDSGRDVENETQLMVLDRSGAGRPYVLLLPIVEGAFRACLESGKVDDYVDMVVESGSSAVRGAVFRSSLYLHAGDDPFELVREAVRVVRAHLGTFRTMDEKTPPPIVDKFGWCTWDAFYLKVHPEGVWEGVRRLSEGGCPPGLVLIDDGWQSICHDDDDPASGAEGMNRTSAGEQMPCRLIKFQENHKFRDYKQGGLGAFVREMKAAFPTVEQVYVWHALCGYWGGLRPGVQGLPPAKVVAPRLSPGLQRTMEDLAVDKIVNNGVGLVDPKR

SEQ ID NO: 24191 - DNA, 754 bp, Panicum virgatum
  misc_feature: Ceres CLONE 1844891-R
  misc_feature: Encodes the peptide sequence at SEQ ID NO. 24192
cccccgaggcacgccggaacaagtgcttctccgagtactcggtgctcctcgcggcgcgcgcctcgccgggcgacgtcgagtggaggagcggcaagggccccggcgtcagcgtcaagggcgtctccctgttcgccgtgtacatggtcgaggccaggaggctgcagctcctgcgccccgacgagggcgtcgacctcaccctcgcgcccttcacctacgagctcctcgtcgtcgcccccgtccgcgtcatctcgccggagcgcgccatcaagttcgcgcccatcggcctcgccaatatgctcaacaccgccggcgccgtcctggccttcgagaccaagaaagactcgaacggcgtaaccgccgaggtggccgtcaagggcgccgggcagatggtggcgtactcgtcggcgacgcccaggctgtgcagggtggacggcgaggaggccgggttcgcctacaaggacggcttggtcaccgtcgacgtgccgtggtcggggtcctcgtccaagctctgtcgcgtcgagtatgtctactgatcgagccgggcgaaagactgccgcgtcacatgcgcctatcaggctggaataatcaagtgtgaagagactgaaagagcttagcaagttttacagctctaacggtttcatttttttattttgagttttattttgtaaggataaggattctgtgctgtgaattaatggagtgctttcttgtgaaatttctggttcgttatgcaatcgtgttggcttaatttccg

SEQ ID NO: 24192 - protein, 176 aa, Panicum virgatum
  misc_feature: Ceres CLONE 1844891-R
  misc_feature: SWISSPROT Homolog: EC 2.4.1.67 Galactinol--raffinose galactosyltransferase
PEARRNKCFSEYSVLLAARASPGDVEWRSGKGPGVSVKGVSLFAVYMVEARRLQLLRPDEGVDLTLAPFTYELLVVAPVRVISPERAIKFAPIGLANMLNTAGAVLAFETKKDSNGVTAEVAVKGAGQMVAYSSATPRLCRVDGEEAGFAYKDGLVTVDVPWSGSSSKLCRVEYVY

SEQ ID NO: 24193 - DNA, 663 bp, Panicum virgatum
  misc_feature: Ceres CLONE 1844894
  misc_feature: Encodes the peptide sequence at SEQ ID NO. 24194
acggattcgattcgattcgcttcggcttcgattgggcttttgtgtcctgatttgatcggtgccgcgcttggagctgcttggtttgggattccgctcggggatttctggggaacgagacaatggagaccgccgggaaggtgatcaagtgcaaagccgcggtggcatgggaggccgggaagccgctgtcgatcgaggaggtggaggtggcgccgccgcaggccatggaggtgcgcgtcaagatcctctacacctcgctctgccacacagacgtctacttctgggaggccaaggggcagactcccgtgttccctcggatcttcggtcatgaggctggagggtatgttctcttccccgacccaatttattattatatatatgttgctgggatgattttttttgttattgctgttggattcatggttattgttggtggtctttgtttatttagcttactagatgcaaagcaatttatttgtgtagcctggattctggtgaacatgtggaagagccataagaaatagtttaccttgtttgaaacggtatcagtatgattgaatattatctgtgtggatgtcagatgtttttgggctcctggcattagactttgatagttatgatcatttcatcagcaactttcttgactgattcagtatttttcagttg

SEQ ID NO: 24194 - protein, 133 aa, Panicum virgatum
  misc_feature: Ceres CLONE 1844894
  misc_feature (34)..(120): Pfam Name: ADH_N Pfam Description: Alcohol dehydrogenase GroES-like domain
  misc_feature: SWISSPROT Homolog: EC 1.1.1.1 Alcohol dehydrogenase
METAGKVIKCKAAVAWEAGKPLSIEEVEVAPPQAMEVRVKILYTSLCHTDVYFWEAKGQTPVFPRIFGHEAGGYVLFPDPIYYYIYVAGMIFFVIAVGFMVIVGGLCLFSLLDAKQFICVAWILVNMWKSHKK

SEQ ID NO: 24195 - DNA, 658 bp, Panicum virgatum
  misc_feature: Ceres CLONE 1844897
  misc_feature: Encodes the peptide sequence at SEQ ID NO. 24196
aaagcttgagttgagagcgctcgcgcgaaaccagccgagaggtctcgagaagcagcagccagattcccaagccactctccccccccccccccactctggtcgtctctgaattttcctccctcgcggggattttccccgggattcattccttgcccggccgggaacggcggcgctcacgaggggaaagaaaagctccgattttcccctgctgagctctcttccgattcccactatcttgagcagcctgcgcgcggccggccagcctcgccgcgggagtttttctgggctttttcctcggccagaattagccattccctggagctaaaggccgagctcggccggggctaaacttcccatcttctccgcggcggccgcgggggaattcattcttctccccgtcagtcgctgccgtatcgccggcggggcggcatggggctcggcttggtggcgcacctggtgcgcctgggcgtgctgggctccacctccgaccacgcctcggtggtgtccatcaacctgttcgtggcgctgctctgcgcctgcatcgtcctcggccacctcctcgaggagaaccggtgggtcaacgagtccatcaccgcgctcatcatcgggctgtgcaccggcgtggtgatcctgctgacgaccaaggggaagagctcgc

SEQ ID NO: 24196 - protein, 76 aa, Panicum virgatum
  misc_feature: Ceres CLONE 1844897
  misc_feature: The sequence is a functional homolog of SEQ ID NO 2 in US patent 7250560
  misc_feature: Useful for making plants with modulated water use efficiency
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
MGLGLVAHLVRLGVLGSTSDHASVVSINLFVALLCACIVLGHLLEENRWVNESITALIIGLCTGVVILLTTKGKSS

SEQ ID NO: 24197 - DNA, 1761 bp, Panicum virgatum
  misc_feature: Ceres CLONE 1844899
  misc_feature: Encodes the peptide sequence at SEQ ID NO. 24198
accatctcatcagactcctagcaaagcatccccctttcctcccctcccccgccaccccgcaatgaccggcctcctccacctccactccacgctgcttccctcggcgtccgcgctccgccgccgcgctggcgcgccagcgccctcctcgtcccgtcgccgatgccgggtggaggctaagatccgggagatttttatgccggcgctcagctccaccatgaccgagggcaagatcgtctcctggaccgccgccgagggcgaccgcctcgccaagggcgaccccgtcgtcgtagtcgagtccgacaaggcagacatggacgtcgagaccttccacgacggtttcctcgccgccgtcctcgtgcccgccggtgagtccgcgcccgttggctccgccatcgcgctcctcgccgagtccgaggaggagatcccggccgcccagtcacaggccgcctccttttcctcctccggcgccgcagcctcacctcctccaccgcaagaaaccgccgcccaagaagcttcccctcccacgccaccgcctccttccccagcaccgatcgcagtctctgctcccgcgccgccctcgccggcagcacaaggcggtgcgcgcgtggttgcgtcaccctacgcaaagaagctggcccaggacctcggcgtcgatcttttctctgtcacggggtcaggcccaggtgggcgaattgtggccaaggatgttgaggccgcgcttgctgcacccaagaaggcggtgccagtggctgctgcacggccggatgtgccattgggctccacagtgccattcacgacaatgcacggtgctgtgagcaagaatatggtggagagccttgccgtcccgacattcagagttgggtacaccatcacgactgatgctcttgatcagctctacaagaaaattaagttgaagggggtaacaataacagcactattggctaaggcgactgcaatggcgctagttcagcatcctgtggtgaactccagctgcagggatgggaagagcttcacatacagcagtagcatcaacattgctgtggcagtggccatagatggtgggctgattacgccggtgcttcaggatgccgataaggttgacatttattcgctgtcaaggaaatggaaggagttggtagataaggcgcgagcaaagcagctgcagccccatgagtataactcaggcacatttactctttcaaatcttggcatgtttggagttgatagatttgatgcaatcttgccacctggaactggagcaatcatggccgttggagcatcacaaccaactgttgttggtacaaaagatggtagaattgggatcaagaaccaaatgcaggtcaatgttaccgctgatcatcgggttatttatggagctgatcttgccgcttttctgcaaacactctccaagattattgaggatcctaaggaccttacgttttagatatacccatggattgtttttccctggacaatcacaattgggtgcttctcacttgtcagtagatgtgtagaatgtggtctggtcatgtggaatagtggatttaagctgtcaccagtgttagcatcaggtaactttctctgctggttaccttctcatcattggcttgttttaccggagctttcatggatagtccgaataggtgtgtaaggatgggtatatttatcattttaccggagctttcatggatagtccgattttgttgagctcatcaatgtaccataaccttgagatacaaagaatgaaatgtaccttgtacc

SEQ ID NO: 24198 - protein, 460 aa, Panicum virgatum
  misc_feature: Ceres CLONE 1844899
  misc_feature (236)..(460): Pfam Name: 2-oxoacid_dh Pfam Description: 2-oxoacid dehydrogenases acyltransferase (catalytic domain)
  misc_feature (180)..(218): Pfam Name: E3_binding Pfam Description: e3 binding domain
  misc_feature (41)..(114): Pfam Name: Biotin_lipoyl Pfam Description: Biotin-requiring enzyme
  misc_feature (177)..(455): SWISSPROT Homolog: EC 2.3.1.12 Dihydrolipoyllysine-residue acetyltransferase
  misc_feature (42)..(102): SWISSPROT Homolog: EC 1.2.4.1 Pyruvate dehydrogenase (acetyl-transferring)
  misc_feature: Useful for making plants with modulated nitrogen use efficiency
MTGLLHLHSTLLPSASALRRRAGAPAPSSSRRRCRVEAKIREIFMPALSSTMTEGKIVSWTAAEGDRLAKGDPVVVVESDKADMDVETFHDGFLAAVLVPAGESAPVGSAIALLAESEEEIPAAQSQAASFSSSGAAASPPPPQETAAQEASPPTPPPPSPAPIAVSAPAPPSPAAQGGARVVASPYAKKLAQDLGVDLFSVTGSGPGGRIVAKDVEAALAAPKKAVPVAAARPDVPLGSTVPFTTMHGAVSKNMVESLAVPTFRVGYTITTDALDQLYKKIKLKGVTITALLAKATAMALVQHPVVNSSCRDGKSFTYSSSINIAVAVAIDGGLITPVLQDADKVDIYSLSRKWKELVDKARAKQLQPHEYNSGTFTLSNLGMFGVDRFDAILPPGTGAIMAVGASQPTVVGTKDGRIGIKNQMQVNVTADHRVIYGADLAAFLQTLSKIIEDPKDLTF

SEQ ID NO: 24199 - DNA, 2021 bp, Panicum virgatum
  misc_feature: Ceres CLONE 1844900
  misc_feature: Encodes the peptide sequence at SEQ ID NO. 24200
agaggaactactccccatggccaccgctgaagccgcgcgtcctgccgccccggccggtttcggccgcgaccacgtcgtcgtgttcccgttcatggccaagggccacacgatcccgctcctccacctcgcctcggcgctcgccgcgcgccacggggacggcggcggcctccgcgtcacggtgctcaccacgccgggcaacctcgccttcgcgcgccgccgcgtcccggcgcacgtcagcctcgtcgcgctcccgttccccgcgcacccggagctgccacccggcgtcgagtccaccgacgcgctcccctcgcactcgctcttcccggcgttcctccgcgccacggcgatgctccgggaacccttcgcggggtacctggcctccctgcccgcgccgccgctggcgctcgtctccgacttcttcctagggttcacgcagcgcgtggccagcgacgccggcgtccgccgcatcacgttccacggcatgtcggccttctcgctggcgctctgcttctccctcgccacgcgctcgcccccggccgccgggagcgtcgaggacggcgccccgttccccgtcccggggttcccggagggcttcacgatcaccaaggacgaggtcccgcacgccgtggcgcaggcggccgacctcgacgaccccgtgacacggttcttgctcgaggaggtccgcgacggggactaccgcagctggggcgtcctggtgaacagcttcgacgcgctggacggggactacgccgcgatcctcgagtcgttctacctcccgggggcgcgtgcatggctcgtcggcccgctgttcctcgccgccggcgagtcgcaggaagaggacgacgacgacgacccggaagggtgcctcccgtggctggacgagcgggcgacgaagcggcccgggtcggtggtgtacgtgtcgttcggcacgcatgtccacgtcagcgccgcgcaactcgacgagctcgcgcacgggctggtgggctccggccacgccttcctctgggtcgtccggaccttcgacgcgtggtcgccgccggtggacgcggggcccgaggggaagatcgccaggggctgggtcccgcagcgccgcgtgctggcgcacccggcggtgggagggttcgtgagccactgcggctggaactccgtgctggagagcctcgccgcggggcggccgatgctggcgtggcccgtgatggtggagcaggccgcgaacgcgaagcacgtggcggacgtcctcggcgccggcgtccgcgcgggggtgaaggccggcgccaacgcgccgccggagctggtcggcagggcgcgggtggccgggaaggtccgggagctgatggacggcggcggcgaggccgggcgggggatgcgcgccagggccgagcgcgtcggggaggcggcgcgggcggccgtcggagacggcggcacgtcgcggctggcgctgcggcggctggtggacgagctgcagcggagctacggcggcggcgacggcgggcagcgggaggcggcggcaagcgccaaaccgagcgtgtgacagcggcccacagggtgatcaataaagagtcaaagacatcaacattagtcattagtgtgagcttttggttgtgttgttgtcctgatgtcacgtagtttcttcgatttcgatgggcttgtccccttgtcgttggctgaccgagcagttgatctgcctgtgtgttagtgcaggagcatctcccggcgagagatggaggactggaggtgtgaaactagcatttgtgtcgtctactatacggtcgaactccaacccaacgtcccgatgtttgcatcccatcgtttatagtcaatgaaaataaagatggatctacttgcatccgttgagctcgccacttgagaaggtgcagagggatgctgagctcaggtggacacgaagagcacgggagagccgcacgctgcagaaaacggattagctatagctagccagtagccatcatccaaggagtcatacgtgtacctagtagctaagttgtcagacaatcatattttcc

SEQ ID NO: 24200 - protein, 504 aa, Panicum virgatum
  misc_feature: Ceres CLONE 1844900
  misc_feature (18)..(486): Pfam Name: UDPGT Pfam Description: UDP-glucoronosyl and UDP-glucosyl transferase
  misc_feature: SWISSPROT Homolog: EC 2.4.1.238 Anthocyanin 3'-O-beta-glucosyltransferase
MATAEAARPAAPAGFGRDHVVVFPFMAKGHTIPLLHLASALAARHGDGGGLRVTVLTTPGNLAFARRRVPAHVSLVALPFPAHPELPPGVESTDALPSHSLFPAFLRATAMLREPFAGYLASLPAPPLALVSDFFLGFTQRVASDAGVRRITFHGMSAFSLALCFSLATRSPPAAGSVEDGAPFPVPGFPEGFTITKDEVPHAVAQAADLDDPVTRFLLEEVRDGDYRSWGVLVNSFDALDGDYAAILESFYLPGARAWLVGPLFLAAGESQEEDDDDDPEGCLPWLDERATKRPGSVVYVSFGTHVHVSAAQLDELAHGLVGSGHAFLWVVRTFDAWSPPVDAGPEGKIARGWVPQRRVLAHPAVGGFVSHCGWNSVLESLAAGRPMLAWPVMVEQAANAKHVADVLGAGVRAGVKAGANAPPELVGRARVAGKVRELMDGGGEAGRGMRARAERVGEAARAAVGDGGTSRLALRRLVDELQRSYGGGDGGQREAAASAKPSV

SEQ ID NO: 24201 - DNA, 468 bp, Panicum virgatum
  misc_feature: Ceres CLONE 1844922
  misc_feature: Encodes the peptide sequence at SEQ ID NO. 24202
gatttcttcgatctcctcgtgggcggtggcgcgtcgtgcgggcctgcgggcgagttccgctgctgctagatctcggaggagagggaggcggaggcgccgcgcatttcgtcgagctcgagcacgatgagggcgtggcgggtcggggcggttctgctggtcgtggccctcgcgctcgccgtgtcggcggcgcggctggacctcgatgacgacgacgactcggacgtgctggacgagctgctggccatcgacgaggaggcggagcggggcgggctggatgcgggtggcggcggcggcgggggcgcggcggaggcggtgcggcgggcgcagtcgatggtgctggcgctcgacaacgacaacgcgcgccgcgccgtggaggaccacgcggagctgctgctcctcgggtacgcgccctggtgcgagcgcagcgcgcagctcatgccacggttcgccgaggccgccgcggcgctg

SEQ ID NO: 24202 - protein, 114 aa, Panicum virgatum
  misc_feature: Ceres CLONE 1844922
  misc_feature: SWISSPROT Homolog: EC 5.3.4.1 Protein disulfide-isomerase
MRAWRVGAVLLVVALALAVSAARLDLDDDDDSDVLDELLAIDEEAERGGLDAGGGGGGGAAEAVRRAQSMVLALDNDNARRAVEDHAELLLLGYAPWCERSAQLMPRFAEAAAA

SEQ ID NO: 24203 - DNA, 1842 bp, Panicum virgatum
  misc_feature: Ceres CLONE 1857619
  misc_feature: Encodes the peptide sequence at SEQ ID NO. 24204
gatcgaagcagtagccagctggtgcagcagccagtacacgagcagcagccagcgagcgagcgtcatccatatctcgatcactgggtctgggagagatggatgcccttgctgggtactcgtccttcagccagctctcgctggtgataagcgtggtggccgtgtgctggaccatggtgtggcagaacctggagcacatccgcctgcagcagttcttcgcgcgcaacttcaaccgccgcgcgcggcggctcgcggcgatcgtcgaccccttcctctccgtcaccttcgaggagtacgagggcgggcgcatcaagagcagcgacgcctacaaggaggtcaggtcctacctcaccacggccagcacgcgcggcgtgcgccacctccgcgccgagtgcggtggcgagagggacgccaccgacaaggacaagctcgtgctcagcatggcccagggcgaggaggtggccgacgccttccacggcgccaccgtgtggtggtcggcctactccgtgcagccgccgcgcgacgccatccccttgttccgcgcgtctcgctccgagcgccggttctaccggctcgagttccacgagagcaaccgcgacctcgtgctcggcagctacctcccgcacgtgcgcaggcagggccgcgccatcatggtgcagaaccgccagcgtaggctctacaccaacatcaaccacgagggctacgacgacggctggtacaaagacgtttggacccatgtccccttcaaccaccccaagacgttcgacaagctcgccatggacccagcgaagaagaaggagatcatcgacgacctcaacatgttcaagaacagcaaggagtactacaaccgcatcggcaagccgtggaagcggggctacctcctgtacggcccgccgggcagcggcaagtccaccatggtcgcggccatggccaactacctccactacgacgtctacgacttcgagctcacgtccgtcaagaccaacaccgagctccggaagctgctcatcgagatcaaaagcaagtccatcattgtgttcgaggacatcgactgctcgctcgacctcaccggcaagcgcaagaccaaggaggaggaggacaaggacgaagacgaggagaaagacgcggacccgcaccgccccaagaaggacgccaagagcaaggtcaccctgtccggcctgctcaacttcatcgacgggctctggtcggcgtgcggcgaggagcgcctcatcgtgttcaccaccaaccacgtcgagaagctggacccggcgctgatccgtacggggcggatggacaagaagatcgagatgtcctactgtgacctcgagtccttgaggttcctggccaagatgcacctcgacgaggacgtcgaaggtcacgagctgttcggcgtcgccaaggcgttgctccaggaggtgaagaacatggtgcccgtcgacgtcggagagcacctcacgcggaagagcgtcgacgacgacgccgggtcgtgcctcgcgaggctggtgacggcgttggaaaaggccaaggaggaagctgccaagacggaagcggcaaaggctgaagctgccaaggtacaggcggcaaaggcttaagaagatgggaaggggatcgttgtgaaagctatggatgacaattaggctgctggcttcgtcctcctgttgtctctcctgactctcctgtgtatatgtgcatagattgcttgtcggtcttaggtacttagaaataagaccaagcttgctctggtcactcgctggctaagcaagtgcttgtttcggtagtgtgctcttattccaatgcaagaatcaggattgtattcaggtcagccatggaagtactattggtatc

SEQ ID NO: 24204 - protein, 497 aa, Panicum virgatum
  misc_feature: Ceres CLONE 1857619
  misc_feature (259)..(462): Pfam Name: AAA Pfam Description: ATPase family associated with various cellular activities (AAA)
MDALAGYSSFSQLSLVISVVAVCWTMVWQNLEHIRLQQFFARNFNRRARRLAAIVDPFLSVTFEEYEGGRIKSSDAYKEVRSYLTTASTRGVRHLRAECGGERDATDKDKLVLSMAQGEEVADAFHGATVWWSAYSVQPPRDAIPLFRASRSERRFYRLEFHESNRDLVLGSYLPHVRRQGRAIMVQNRQRRLYTNINHEGYDDGWYKDVWTHVPFNHPKTFDKLAMDPAKKKEIIDDLNMFKNSKEYYNRIGKPWKRGYLLYGPPGSGKSTMVAAMANYLHYDVYDFELTSVKTNTELRKLLIEIKSKSIIVFEDIDCSLDLTGKRKTKEEEDKDEDEEKDADPHRPKKDAKSKVTLSGLLNFIDGLWSACGEERLIVFTTNHVEKLDPALIRTGRMDKKIEMSYCDLESLRFLAKMHLDEDVEGHELFGVAKALLQEVKNMVPVDVGEHLTRKSVDDDAGSCLARLVTALEKAKEEAAKTEAAKAEAAKVQAAKA

SEQ ID NO: 24205 - DNA, 1918 bp, Panicum virgatum
  misc_feature: Ceres CLONE 1857630
  misc_feature: Encodes the peptide sequence at SEQ ID NO. 24206
aaaccaccggcttctcgtcgcggtcgtcgccttcgcggcgcttccacgcacgcgccacgacgactcgtccacggtctacccggccggcgttcggcgccgcacgcagcgctccccttccgccgcgtgccgccacagccgatcgagcaagctagctgggcacctggcccagccacagcccgttccggccggcgttccccgccccggcaaagccacagctgcacagatagcaacccagcagcgccggtatgcggccgcgccggctgcccccgtgcctggcagtgacggcggtttcagcggcgctgctgttcgtgctcctgctgctctgcgcctcctcctccccgcccctcttcgcctggcggtcctccgccgcgtcccgccccgcgccgccgccgccgccgccgcgggcggagtgggggcccggccgcccgccctccttcgcgtactggatctccggcacgggcggggacgcgcgccgcgtgctgcgccttctccgggcggtctaccacccgcgcaaccgctacctgctgcacctcgacgccggggcggccgccggggagcgggaggcgctggcgcaagcggtcaggtgggacgagcccgcgtggagggagttccggaacgtcgacgtcgtgggggaaggctacgcggtcgaccggaccgggtcgtcggcgctcgccgccgtgctgcacggggcggcggtcctgctcaggatcggggcccactgggactggctcgtcacgctcagcgcagaggactacccgctcgtcacgcaggacgatctcctttatgccttttcttctgtgccaagggacctcaactttattgatcacacaagtgagcttggatggaaaaggcatgaaagatttgaaaagattattgttgacccaagtctatatatggacagaaacactgaacctttcccttcaaaagaaataagacaaatacctgatgcattccagatattcacaggttctccttgggtaattctgagcaggaactttgctgaacactgtgtgcatggttgggacaacctaccccgcaaactactgatgtactttgccaacacagcttattccatggagtcgtacttccagactctcatctgcaactcttccgacttccggaacacaactgtcaatggcgatctaaggtactttgtctgggatgaccctccaggcctcgatccacttgttctcaatgaatcacactttgagaacatgttgaacagcagctctgcctttgcaaggcggtttgaggaggacacaccaatgctgaagaagatggatgatgaactactaaaccggtctcctgtccagttggttccaggggtatggtgtctgaacttgggcaaagaacagaacgggactgatgcggattcgtgctcaaaatggggtgatatcaatactgtcagacctggacgtgggggggagcggctcaggcagttcatttctgagatcagtcaggcaagagggtgccgctagctgaatcagtattggtgtctattgttcaggaggtaaagtttcaggtagagttttgtggagcaaatatcggctggagtgaggtacgtgatggaattacaatgatacggatttctcctacgcgttgaagaaaacagaaggcacatggagtcatatggaaatggccaaaaagtttcagattcaggtgatgggcaccggatactgcattgtccaaatattcaaggctgcatagtaagagcagtagtagtgtttatacagattaggtatactgtatactatccgtagctgctttgccctgtttttgatcgtgtaggtaggacacagaaataggatctgctcatataccttgtagcagcacctttgtatagatgatacattgagataactatacacgtctgtattatattgatactgataatacagctcttgggtgtgctcgtctc

SEQ ID NO: 24206 - protein, 410 aa, Panicum virgatum
  misc_feature: Ceres CLONE 1857630
  misc_feature (64)..(290): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MRPRRLPPCLAVTAVSAALLFVLLLLCASSSPPLFAWRSSAASRPAPPPPPPRAEWGPGRPPSFAYWISGTGGDARRVLRLLRAVYHPRNRYLLHLDAGAAAGEREALAQAVRWDEPAWREFRNVDVVGEGYAVDRTGSSALAAVLHGAAVLLRIGAHWDWLVTLSAEDYPLVTQDDLLYAFSSVPRDLNFIDHTSELGWKRHERFEKIIVDPSLYMDRNTEPFPSKEIRQIPDAFQIFTGSPWVILSRNFAEHCVHGWDNLPRKLLMYFANTAYSMESYFQTLICNSSDFRNTTVNGDLRYFVWDDPPGLDPLVLNESHFENMLNSSSAFARRFEEDTPMLKKMDDELLNRSPVQLVPGVWCLNLGKEQNGTDADSCSKWGDINTVRPGRGGERLRQFISEISQARGCR

SEQ ID NO: 24207 - DNA, 1339 bp, Panicum virgatum
  misc_feature: Ceres CLONE 1857650
  misc_feature: Encodes the peptide sequence at SEQ ID NO. 24208
agaagcttcggcaaaagcgatcgatcccagctcctcgtcgcgtcgcggcgcttctcatcccttctcttcatgcgccatcgccgccgcttcagcccctgcgacgccacccgcagataggaaggaacagggaggggacgacaggttggcgatgccttcgctctcctgccacaacctcctcgaactcgctgcggccgacgaggcgcccctgccgtcgcccacctcgccctcgtcgcccgccccgctgcgccgcgtgatcgtctcccaccgcctgccgctgcgcgcggcgcccgacccggccgcgcccttcgggttcgccttcaccgtcgactccggcaccgtcgcctaccagctccgctcggggctgcccgccaacgcgcccgtcctccacatcggcaccctcccggcggtcgcggcggaggcggcctccgatgagctgtccaactacctgctggcgaatttctcctgcctgccggtctacctgcccagcgacctccaccaccgcttctaccacggcttctgcaagcactacctctggccgctcctccattacctcctcccgctgaccccgtcgtcgctcggcggcctcccgttccagcggacgctctaccactcctttctctcggcgaacagggccttcgccgaccgcctcaccgaggtgctcacccccgacgaggacctcgtctggatccacgattaccacctcctggcgctccccaccttcctccgcaagcgattcccgcgcgccaaggtcggattcttcctccactcgccgttcccctcatccgagatcttccgcacaatccccgtgcgcgacgacctggtccgcgccctcctcaacgcggacctcgtcggcttccacaccttcgactacgcgcggcacttcctgtccgcgtgctcccggctgctcggcctggactaccagtccaagcgcggctacatcggcatcgagtactacggccgcaccgtcacggtcaagatactgcccgtcggaatcgacatggggcagctgagatcggtggtctcggcgccggagacgggggatgcggtgcgccgggtgaccgaggcgtacaaggggcggcgcctcatgatcggcgtcgacgacgtcgacctgttcaaggggatcggcctcaagttcctggccatggagcagctgctcggggaccacccggagctccgcggccgcgctgtgctcgtgcagatcgccaacccggcgcgcagcgaggggcgcgacgtgcagggcgtgcaggacgaggccagggccatcagcgcccgggtcaatgcgcggttcggcacccccggctacacgccgatcgtgctcctcgacggcccggtgacgccg

SEQ ID NO: 24208 - protein, 396 aa, Panicum virgatum
  misc_feature: Ceres CLONE 1857650
  misc_feature (32)..(396): Pfam Name: Glyco_transf_20 Pfam Description: Glycosyltransferase family 20
  misc_feature: SWISSPROT Homolog: EC 2.4.1.15 Alpha,alpha-trehalose-phosphate synthase (UDP-forming)
  misc_feature: Useful for making plants with altered carbohydrate content
MPSLSCHNLLELAAADEAPLPSPTSPSSPAPLRRVIVSHRLPLRAAPDPAAPFGFAFTVDSGTVAYQLRSGLPANAPVLHIGTLPAVAAEAASDELSNYLLANFSCLPVYLPSDLHHRFYHGFCKHYLWPLLHYLLPLTPSSLGGLPFQRTLYHSFLSANRAFADRLTEVLTPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETGDAVRRVTEAYKGRRLMIGVDDVDLFKGIGLKFLAMEQLLGDHPELRGRAVLVQIANPARSEGRDVQGVQDEARAISARVNARFGTPGYTPIVLLDGPVT

SEQ ID NO: 24209 - DNA, 745 bp, Panicum virgatum
  misc_feature: Ceres CLONE 1857650-R
  misc_feature: Encodes the peptide sequence at SEQ ID NO. 24210
atcgagcacaaggagagcgcctagtctggcaccaccaggaagcggatccggacttcggttcctgccaggccaaggaactgctcgaccatcttgagaacgtgctcgccaacgaacccgtggtggtgaagaggggccagcacatcgtcgaggttaacccccagggcatcagcaaaggcgtggtggtggagagcctcctgtcgtccatggtcaagacggggaaggcgccggactttgtgctgtgcatcggcgacgaccggtcggacgaggacatgttcgagagcatcgtgtgcccgtccaatgccagcgtgaagctcccggccaccagcgaggtgttcgcctgcaccgtgggcaagaagccgagcatggccaggtactacctggacgacacggtggacgtgattaaaatgctggagggcctggcgaacgcgccgtcgcagcggcccaggccggcggtgcagctccgggtctcgttcgagggctcgctgtgagacggaaacgaaaggggaattttactgcacaggaaggagtagtagtacactacacatcgaggacgaataaccaaccaatggtaacgaagatgattcagacgcgtggtttaggattagctgcagtagttacaggatcaacaggttttcttttttttgtttctttttttcattcttttacatttttacccccctctccggtcgtgcgcctgtatatgccccgtatgataatgcaagaatgtacgtgcccttgtatatgt

SEQ ID NO: 24210 - protein, 161 aa, Panicum virgatum
  misc_feature: Ceres CLONE 1857650-R
  misc_feature (1)..(130): Pfam Name: Trehalose_PPase Pfam Description: Trehalose-phosphatase
  misc_feature: SWISSPROT Homolog: EC 3.1.3.12 Trehalose-phosphatase
  misc_feature: Useful for making plants with altered carbohydrate content
RAQGERLVWHHQEADPDFGSCQAKELLDHLENVLANEPVVVKRGQHIVEVNPQGISKGVVVESLLSSMVKTGKAPDFVLCIGDDRSDEDMFESIVCPSNASVKLPATSEVFACTVGKKPSMARYYLDDTVDVIKMLEGLANAPSQRPRPAVQLRVSFEGSL

SEQ ID NO: 24211 - DNA, 633 bp, Panicum virgatum
  misc_feature: Ceres CLONE 1857656
  misc_feature: Encodes the peptide sequence at SEQ ID NO. 24212
accttgctcggctcccacctcctccgagatggctccggcggcctgattccggcgtggcgagaaaggatgaacagtggaaacagtgactgataatgggggaggcagaggaggaccgtgcggccggctgctccttctcgctcatgtgcctggaggacggcgccgacctcggcggcggcgtcgacgacgggaagctgctcctgctgtacggggaagctgaggaagaggaagaggagtacatgggccacctcgtgtccaaggagagcagcttctgcagctcgccttccccgtcctcgtcccctgcctcctctgacgccggcgccgagtcgccgccgtcgccggtgccctcctccgaggactggttccggcgcgcgcgccgggacaccgtcaagtggatcatcgagactcgagcttgctttggtttctcccaccgcacggcgtacctggccgtctcctacttcgaccgcttctgcctccaccgctgcttcgacaggtcggtgatgccgtgggcggcgcggctcctggcggtggcgtgcgtgtctctggcggcgaagatggaggagtaccgcgcgccggcgctgccggagttccgcgccgacgacgagtacgacttcagctgcgactccatccggcgga

SEQ ID NO: 24212 - protein, 180 aa, Panicum virgatum
  misc_feature: Ceres CLONE 1857656
  misc_feature (47)..(174): Pfam Name: Cyclin_N Pfam Description: Cyclin, N-terminal domain
MGEAEEDRAAGCSFSLMCLEDGADLGGGVDDGKLLLLYGEAEEEEEEYMGHLVSKESSFCSSPSPSSSPASSDAGAESPPSPVPSSEDWFRRARRDTVKWIIETRACFGFSHRTAYLAVSYFDRFCLHRCFDRSVMPWAARLLAVACVSLAAKMEEYRAPALPEFRADDEYDFSCDSIRR

SEQ ID NO: 24213 - DNA, 602 bp, Panicum virgatum
  misc_feature: Ceres CLONE 1857667
  misc_feature: Encodes the peptide sequence at SEQ ID NO. 24214
acaaaatacaacaactatcccccatcccctcacgaacacatctttgaatgaatttcatttcatcataatcgataactagcttttgcctttcgcacgccccagcccggaggacaaagctagccaaatggaaatgcagccactctccctgctggcctcatggactctcctcctcgtcctgctcctcctccccctcgtctgcttgctgtacctgagcccgcaggatcacggcaacaagcagcagcaccagcagacatcggacgacgacctcaagtcctacccgatcgtcggcaggttccctcacctggtcaagaacagccaccgcctcatcgaatggtcggtcgaggtcgccaagcggagcccgacgcagaccacggccttcaaggccctcggcctgcccggcgtcgtcatcaccgcccacccggacaacgtcgagcacatcgacaagacgagcttcgccatctaccccaagggcgactacatgtcgtcgacgctcgaggacttcctcggccgcggcatcttcaactccgacggcgagcagtggctgtggcagcgcaaggccaccagcttcgagttcagcaaccgctcgctacgcaagttcatcg

SEQ ID NO: 24214 - protein, 159 aa, Panicum virgatum
  misc_feature: Ceres CLONE 1857667
  misc_feature: SWISSPROT Homolog: EC 1.14.14.1 Unspecific monooxygenase
MEMQPLSLLASWTLLLVLLLLPLVCLLYLSPQDHGNKQQHQQTSDDDLKSYPIVGRFPHLVKNSHRLIEWSVEVAKRSPTQTTAFKALGLPGVVITAHPDNVEHIDKTSFAIYPKGDYMSSTLEDFLGRGIFNSDGEQWLWQRKATSFEFSNRSLRKFI

SEQ ID NO: 24215 - DNA, 2179 bp, Panicum virgatum
  misc_feature: Ceres CLONE 1857675
  misc_feature: Encodes the peptide sequence at SEQ ID NO. 24216
atcagcaagtgcacggccattcttgaggaaatcaaggatgccagcacgggccgcaatctccggaaagcacgatggcatggcctccggtcgccgctcaaacaccgctgcacagagctccctctcaacttccacgatatccccacgctcatcggctaatcaacggagcaggcgagcagcggtcaagccacccgttcgcgtcgaggcggtcgaggattaggcccagcttgtgcacaacggaggcagggatctgaggaggcacgacggacgccgggctggagctgtctgcgtccttcatggcaagcggcgccgagtgctccgcaaggtgccggccgaactcggcctcgagcatgccgagggcggattccaggagccctgcgtcgaggctggcgaggtcggcgacgaagcgggggtcggcgaggtcgcgctccctgaggtaggcgacgatgtcggcgagcctctgcgctgcgagaccgcagttgtcggcgaacaggcggagcgcggcctcgagctgcgcgagcacggcgaggtaccccgggaggtccccggcgagcgagccgcgcgcgaggagtgcgacctcgagcccgtgcacagcgtcgaagaccttgagcacggcggcggcggaccgagcgcgcgttcgatgtcgcggtcggccaccgcgagcgcctcgtgagacgcatggattgggcgcgccgaggcctccatcgcggggaggcgtgcccggatcccctccacccgcgccgcgtcatgcgccagcgcccggcccagcgtgcgcgacaggtccaccctggcgcgcagcgcctagcgcgccgccagcagccgctcctccgccgcctcgtcgctgtcgcgcgggtgtgctggtccgccctcgtgcggcgcccctcctggcggcgcgcgcgacgggggacggggggtgcgggcgggcctggaggtgaggtgtggacgtgtggttgggagttcgagataggttccagggtagaaacgaaaaaatgcatacatccgagtttaattgtgctttcacgtttcaagcggaatataccgcatctcacaccccctgagctcagctccaagcagagtcttctccacctcctgtggttagagcgagaggccaggccgtgaaaatgccgatcagcaggatcgccgtcgggagccaccaggaggtgtaccacccgggcgccctcaaggcggcgttcgccgagttcatctccacccttatcttcgtcttcgccggccagggctccggcatggccttcagcaagctgtccgccggcggcgctacgacccccgctggcctgatctcggcggcggtggcgcacgccttcgccctgttcgtggccgtgtcagtcggcgccaacatctccggcggccacgtgaacccggccgttaccttcggcgccttcgtcggcggcaacatcaccctgttccgcggcctcctgtactgggtcgcccagctcctgggctccaccgtggcgtgcctcctcctccgcttctcgaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcatcggcggcggcctcgccggcgtcatctacgaggtgctcttcatctcccacacccacgagcagctccccaccaccgactactgagctgagggctgaggcttcggtagccgccgccgccgccgccaccgaagacgttcgcgcgcagccgccggttcctccgtccgtttgatcagttccgcctcgccgccgtttgagttagtttttttccctcgcaccgcgtgctgcttgcatcgaccaccgccatgtaccatgaacccgtcgaactctccgccgccgctgcgccgctcgccatggtttgcttcgatcagtcgcatcaagttggaactgtaaccgccaccgtgaattccggaccccgtttgcatgcttctgtaaaatttgtgaatttgccggtg

SEQ ID NO: 24216 - protein, 250 aa, Panicum virgatum; identical to SEQ ID NO: 19112
  misc_feature: Ceres CLONE 1857675
  misc_feature (13)..(233): Pfam Name: MIP Pfam Description: Major intrinsic protein

SEQ ID NO: 24217 - DNA, 503 bp, Panicum virgatum
  misc_feature: Ceres CLONE 1857685
  misc_feature: Encodes the peptide sequence at SEQ ID NO. 24218
cgcgcaacgctcgtccctcaactactcgaaagcactctatctccaaccacacctgcgcgtggacgacacaaatctccttctccctcccgtcttctccaccgatctgctcggctcctcccgcccgacgggcttagtggggaacgctagcgccggatgtccgcggcggccacggaagtggcgaaccccctagcggggctgtaggaccacctcacgctcgcgtgggactacccgctcgagggcctctacggcacctccgtcatcttcttcgacggcaccatcacccagatgaacaagcatccaactactctggacgatgctctggttcgtacgacatggatgaactgcaacaaagcaatctctgaagaagtggacattgtagaatacttagatgcccaattaaagtcccttaaagaagctcctggggtgaggtggtcctcatcacctcctattctctcgaacaaatcatttcatttccaaccgttggatgaatatccaacttcctc

SEQ ID NO: 24218 - protein, 72 aa, Panicum virgatum
  misc_feature: Ceres CLONE 1857685
  misc_feature: SWISSPROT Homolog: EC 3.6.4.3 Microtubule-severing ATPase
MNKHPTTLDDALVRTTWMNCNKAISEEVDIVEYLDAQLKSLKEAPGVRWSSSPPILSNKSFHFQPLDEYPTS

SEQ ID NO: 24219 - DNA, 1859 bp, Panicum virgatum
  misc_feature: Ceres CLONE 1857691
  misc_feature: Encodes the peptide sequence at SEQ ID NO. 24220
atccttccttccgtcgacactcgcagccgccgccacaggcgaggcgactaacctaacctcctgctcctcccgccgccgcgcgccgccggctcctcccgtcctctcgcgccagcgctcgaggcctgccgtgactgtcggccggacctccccttcgtcacctggggggctgaaccgggcacgcgccgccccgtccgcaccgctgcctgagcctagagcatcgttgcagattctggggattctccactccctgctacaactccgtccctgtcagcaggatgccacgccaatccgctatctcgctagtgagagatcgggcgaaggtgggggcgctgaagcgtcttactctgagctcgtccaagacagccgggaggaactcagcggggcgcatcacctctttccaccgtggcggaggggccaagaggttgcagaggaaagtcgatgtcaagcgggggacctcctctatgggcattgttgagcggatcgagtatgacccgaaccgctcctctagcattgctctggtgcgatgggtccaaggggtacacttccgtggccacaggattccacaagagcccagtatcaagcctcagatcctagaatctaccacggcagatgtctccggtcggttttcccttgcaacattgtctggcagagagtataaaggaaaggaagcttcttctgcactgtactcttctctgggcaatggagttattccatctgtgagctctggtgcatcattgagcttaccgaggatagctttagctggtgccaagcccgctttcttcgctcaagtcagaggaaatgaagaagggaaacagacattttctctttctggaattcaaaaatgggcaacagatgatgcgctttgggcacacagaatgaagcgtcaagctgctctctcgtggcagaatgacctgaagaagaaatctttgcctttgacacaagctaaccgcttcactagcttggccgcaaagtccattggtatgagtaaagagccaaaaagaaaggttgattgtgtaccagtatcttatatattggccagtcaccaattcctgccaggtagcaaagtgatgaactatgattcctcgaaaccttctaagagttcagcctcttcgttcggttcctcagctaatcagtatgatatcattgacctcaactcaaaggttggaaactgtataccattagccaatgcacggattggaacgtgggtgcatgatattgaatgtcgtcctggacagggtgggaaaatggttcgggcagctggtacatatgctaaggtagtccaggagccaggtgcacattgtgttctgcgccttccttcaggtgctgagaagaccgtcgattcaaaatgccgtgctacaattggtatagtctccaatccgagcaatggtacacgcaagctgagaaaagcagggcatagccggtggttaggcaggcgcccagttgtccgtggtgttgctatgaaccctgtggatcatcctcatggtggaggcgaggggcgtaccaaaggaggtaggccttcagtttctccctggggaaagcccactaaaggcgggtaccggtcaccaagtgtggccagccgtaaagcttagtgtgctggaacaaagctcttgctggagtggcctttcttttttttctttgttatggttgcgaaaataaagaacaggtgttggtggcaggggggaattataatcatcctttggttgtgatgtgctacttaaactgattagtggatttctttttcttctgtaacaacttgtggcacatttggtttttgttccattggtctggttggtgaagggatgttctaatctttctgaccaaggcttgtttcagaaacaagatactcatattggtacatt

SEQ ID NO: 24220 - protein, 437 aa, Panicum virgatum
  misc_feature: Ceres CLONE 1857691
  misc_feature (294)..(422): Pfam Name: Ribosomal_L2_C Pfam Description: Ribosomal Proteins L2, C-terminal domain
  misc_feature (31)..(108): Pfam Name: Ribosomal_L2 Pfam Description: Ribosomal Proteins L2, RNA binding domain
MPRQSAISLVRDRAKVGALKRLTLSSSKTAGRNSAGRITSFHRGGGAKRLQRKVDVKRGTSSMGIVERIEYDPNRSSSIALVRWVQGVHFRGHRIPQEPSIKPQILESTTADVSGRFSLATLSGREYKGKEASSALYSSLGNGVIPSVSSGASLSLPRIALAGAKPAFFAQVRGNEEGKQTFSLSGIQKWATDDALWAHRMKRQAALSWQNDLKKKSLPLTQANRFTSLAAKSIGMSKEPKRKVDCVPVSYILASHQFLPGSKVMNYDSSKPSKSSASSFGSSANQYDIIDLNSKVGNCIPLANARIGTWVHDIECRPGQGGKMVRAAGTYAKVVQEPGAHCVLRLPSGAEKTVDSKCRATIGIVSNPSNGTRKLRKAGHSRWLGRRPVVRGVAMNPVDHPHGGGEGRTKGGRPSVSPWGKPTKGGYRSPSVASRKA

SEQ ID NO: 24221 - DNA, 715 bp, Panicum virgatum
  misc_feature: Ceres CLONE 1857700
  misc_feature: Encodes the peptide sequence at SEQ ID NO. 24222
agggggggtcaggggggaggtgacaggcgaggggagccatggggatggacggcggcggcgggaagctgccgtacagctacgccggcgtcggccaccaggacggcaagctcgtcaagagcttcagccgcgtggagccgcgcaagttcgggatggggctcgtcgccggcttcctcctcgtcacctgcgcctacttctctaccgccaagttcgacgccatccacatcgccatggtcagccccatttccacggacgcggctgggattggctcgctggcgaccgccgccgccgacacctccaagcagcaattagatttgggcgtgcaggaccggaacgcgctgtcgaaggaggggagcagggccgaggtgctcgagaaagacgacggcaatgcttcctcctcgggaccagattccggccgcaatgcgccgctggaggacacgaggagagacgagacctttgtggggggcagcggtgacgcgggcgccggcgttgatgcgtcctccgcggcggccacgaatcctgccggcgagggtgaggttcctgccaaggacgatgacgccacggccgccgttcttcctcccgtgtcgttagaggaagccgcgaacggcacgcaagaatcacgtgttcttgaggacgcggagctgcaattttcagaagctgttgctgaccctccatccaagaagagcaacgactccgccgccgccgccgctgcaagcgg

SEQ ID NO: 24222 - protein, 225 aa, Panicum virgatum
  misc_feature: Ceres CLONE 1857700
  misc_feature: Useful for making plants with altered carbohydrate content
MGMDGGGGKLPYSYAGVGHQDGKLVKSFSRVEPRKFGMGLVAGFLLVTCAYFSTAKFDAIHIAMVSPISTDAAGIGSLATAAADTSKQQLDLGVQDRNALSKEGSRAEVLEKDDGNASSSGPDSGRNAPLEDTRRDETFVGGSGDAGAGVDASSAAATNPAGEGEVPAKDDDATAAVLPPVSLEEAANGTQESRVLEDAELQFSEAVADPPSKKSNDSAAAAAAS

SEQ ID NO: 24223 - DNA, 509 bp, Panicum virgatum
  misc_feature: Ceres CLONE 1857721
  misc_feature: Encodes the peptide sequence at SEQ ID NO. 24224
cagtccccaggtgcacccgccacaaaccggcagagagcaagagccgtcacctgcggcatcctcctcccgacgccgccaccgccttcgcttcctcagcggttaatcttcacctgctgccatgggtaaagagaagaccgacatccacatgggggccactggccacgtcgactctggctagtcaagctccaccggccacctgatctaccagcttggaggcatccacaatcgtgtgatccagaggttccagaacgaagctgcggagatgaactcgaggtgcctcacgtacgcgagggtgtttgagaaggtcaagggcgagagtgagacaggtatcaccattgatatcaccctgtggaagttcgagaccaccacgtactactgcacggtgctggaggcccctggagaccgtgacttcatcaacaacatgatcacgggtacataccagactgactgtgctgtccttatcatcgactcctccaatggcggttttgaggaaggtatctacaacgatg

SEQ ID NO: 24224 - protein, 82 aa, Panicum virgatum
  misc_feature: Ceres CLONE 1857721
  misc_feature: SWISSPROT Homolog: EC 2.7.7.4 Sulfate adenylyltransferase
MNSRCLTYARVFEKVKGESETGITIDITLWKFETTTYYCTVLEAPGDRDFINNMITGTYQTDCAVLIIDSSNGGFEEGIYND

SEQ ID NO: 24225 - DNA, 675 bp, Panicum virgatum
  misc_feature: Ceres CLONE 1857726
  misc_feature: Encodes the peptide sequence at SEQ ID NO. 24226
gccgaccacctccgcaccgcaccgcattgggttttggaccccggccgagcggcgtgtcgctgatctctcgcgcggcgcggcgatgtggcgttcggtggcgcggcggtcgtcgcaggtccggcggctcctgtcgacgtccgcacccccggcggggccgctcgccaccgtgccggcgccctgcatcgtgcagaagcgcgggaacgacatcctcaacgacccatggtacaacaaggacacggcgttccccttgacggagcgcgaccgcctcggcctccgcggcctgctcccgccgcgggtcatgtccttcgagcagcagtacgagcggttcataaactcgtaccggtcgttggagaagaacacgcggggcgagccggactccatcgtcgcgctggccaagtggaggatcctcaacaggctgcacgaccggaacgagacattgtacttcagggtgctaatcgacaatatcaaggatcttgcgccggtaatatacactcccactgtcggcttggtctgtgagaattacagtggcctgttcagacggcctcgtgggatgtatttcaccgcaaaggataagggggagatgatgtcgatgatttacaattggccacaagagaaggttgatatgatagttgtgactgatgggagtcgcattctaggcttaggtgaccttggtgt

SEQ ID NO: 24226 - protein, 197 aa, Panicum virgatum
  misc_feature: Ceres CLONE 1857726
  misc_feature (113)..(197): Pfam Name: malic Pfam Description: Malic enzyme, N-terminal domain
  misc_feature: SWISSPROT Homolog: EC 1.1.1.39 Malate dehydrogenase (decarboxylating)
MWRSVARRSSQVRRLLSTSAPPAGPLATVPAPCIVQKRGNDILNDPWYNKDTAFPLTERDRLGLRGLLPPRVMSFEQQYERFINSYRSLEKNTRGEPDSIVALAKWRILNRLHDRNETLYFRVLIDNIKDLAPVIYTPTVGLVCENYSGLFRRPRGMYFTAKDKGEMMSMIYNWPQEKVDMIVVTDGSRILGLGDLG

SEQ ID NO: 24227 - DNA, 564 bp, Panicum virgatum
  misc_feature: Ceres CLONE 1857735
  misc_feature: Encodes the peptide sequence at SEQ ID NO. 24228
  misc_feature (148)..(148): n is a, c, t, g, unknown, or other
ccgacgccgcgatgccgatctgcacgccgtcgtcggactcctcggcctcgtcggcctccggcggccgcgcgtggatagtccacgggctggcgctcggcgtggcggcggcggcgcccgcgctcggctcgctcgtgttcctgcggccgancgggttccgcagccgcgcggtggggatcatacccgcgcgcttcgcctcctcgcgcttcgagggcaagccgctcgcgcacatcctcggcaagcccatgatccaggtccgccccctgcttaccttgtcttatcgcgtccgacagagagagagcgaggggagccttgaggtagaaaatcatactgggggaagttgtaccggcaagtcgcggtttgggatagcgaagggaggtcgaatcgatttgtgctgtttcatcacctggatttaggctgaagtgtcaggtgatcatgtcggtgtcgtgcataacatttcagtgtcagtgtgtgcaagatgttcttttggttacctatatactatggaattgccgtatcatgttcgtctcgtccggccattcggtaacctagacccccgctctatga

SEQ ID NO: 24228 - protein, 133 aa, Panicum virgatum
  misc_feature: Ceres CLONE 1857735
  misc_feature: SWISSPROT Homolog: EC 2.7.7.38 3-deoxy-manno-octulosonate cytidylyltransferase
  misc_feature (46)..(46): Xaa is any aa, unknown, or other
MPICTPSSDSSASSASGGRAWIVHGLALGVAAAAPALGSLVFLRPXGFRSRAVGIIPARFASSRFEGKPLAHILGKPMIQVRPLLTLSYRVRQRESEGSLEVENHTGGSCTGKSRFGIAKGGRIDLCCFITWI

SEQ ID NO: 24229 - DNA, 2320 bp, Panicum virgatum
  misc_feature: Ceres CLONE 1857749
  misc_feature: Encodes the peptide sequence at SEQ ID NO. 24230
gaatctccgccaattcgcgcatctcctccaacagattgccgcaggtacttccgctatccgttcctctcctcctcagctcccgatcgagctgcgctttgcggcctgcggcggcgtgtagtgccagatcgagcctttttcgtcgggggaggcgtgacctgcttcgggagcacagctgcacatctcactcccaaaccacaccggcgccgccgccgatcctccctctcccgaggataacacatctccaggcgcgcttcttgcggccgagctgccggccggcggcgcgcttcctgcggctgagcgggctgtggcctgctgctgccgggcggcccaggagtttttccactgcccctgctgccggtgccccggggggcggcaagctggtaggcttccctctcccccgtcgccccactctctcagttctagatttggccggcggaacaccaaatcgcgctcgtaccgcaggcggcatcgatgggggaagatccgggtgcggggtcgtgcagccacgcgccaggggaggcgtctatgggacgacggctcccgctccctctcctaggtcggatgagggtgccgttggagcacgttttctgcgtttcggccatcaaacctaggaaaggggttcggataagggtttttgttggagttgctcttaggtttgagatgctgtggttttgtgaaggaaaactcgaatcattcgtgaggaaaggttggggttctagctgtcctgcgccgcgagtcacattttagtgcaaattttagtggctgatgcttcatttcttgcgtctgttctaggacattcctgatgctgtcccttttcgtgccgatcttgccgcggtaattcacacagctactggattgattcaagtgtattaagttcttgcacagtggttggtcttggactcttctgttcctgctcaagagtcaagaccaacctgactgctggcctgaagtcaaagatgagtgcagacccaagtacccaagattcgatggaggaggaagccctcaaagcaaagcttgcagcagagcgcaagttccatgcacggaacatcaagggtgcccggaggtcagcgatcaaggcacatgacctgtgtccaacacttgagggcatatcccagatgatcacgacgcttgacgttcaccttgcgtctgagtcgaagattgatggggagagtgattggtacaggatactgtctctcactgcctgggctgatgaggaggaggtgaagaaacagtacagaaagctagctctccagttgcacccagacaagaacaagtcggttggtgcagaggctgccttcaaacttatctcggaagcatggagtgtgttgtctgacaagagcaagaagatgctgtatgatcagaagaggagagatcattcagcaacgaatggcaccaatggattgtatgcttatgatacgaaggccaataagagagcacggaaaaatgctgcagctgctgcttcagccgcagttgaggctactactcgtcctgcaggggctgacacattctggacatcatgcaaccgctgtaggatgcagtatgagtacttgagaatttatctgaaccacaaccttctgtgcccaaactgtcaccatgcattcatggctgttgaaactggatttcccagcaatggaaccagtacgtcattcacctggacgacaaaggcgcagcagcaaaagaaccacactactgttgatcattcatatcagtcagcaagcagaacctcaagctttccaggcacaggacatggagcataccaacaagagaatacttatgagtcgtacgatagccaaagtttccagttcaatcagtaccccaagacaacaggtgctgctgctgcaaatggtcacaggacacagatcttagagaaatcaaaaagaaaacatgaggagaactacatatacaattacttttcaagtggcaatgagtatccatcagggtgcggaaggcattcaaagaggaggcggaatattaataatggatatgcctatgcttctgtggactgtgatggggagactctggctgcaactgcagctatgactgtgattgctgatgcaggaagggttaatggtacaccaggggaaaagtttagatctgcagtaagtggaagaaaagctaatgtcttgagagagatattccaacttgacacccgagctcttcttctcgagaaagccaaggcagcagttcgtgaaaaattacaaggcttgaatattttatcttctagtcggtttgcagagaaaaggaaagcagatagaagagagaagcatgtcgacaacgatgtaaaggttaatggcatctaccctgacaatccaatcaacaa

SEQ ID NO: 24230 - protein, 444 aa, Panicum virgatum
  misc_feature: Ceres CLONE 1857749
  misc_feature (63)..(124): Pfam Name: DnaJ Pfam Description: DnaJ domain
MEEEALKAKLAAERKFHARNIKGARRSAIKAHDLCPTLEGISQMITTLDVHLASESKIDGESDWYRILSLTAWADEEEVKKQYRKLALQLHPDKNKSVGAEAAFKLISEAWSVLSDKSKKMLYDQKRRDHSATNGTNGLYAYDTKANKRARKNAAAAASAAVEATTRPAGADTFWTSCNRCRMQYEYLRIYLNHNLLCPNCHHAFMAVETGFPSNGTSTSFTWTTKAQQQKNHTTVDHSYQSASRTSSFPGTGHGAYQQENTYESYDSQSFQFNQYPKTTGAAAANGHRTQILEKSKRKHEENYIYNYFSSGNEYPSGCGRHSKRRRNINNGYAYASVDCDGETLAATAAMTVIADAGRVNGTPGEKFRSAVSGRKANVLREIFQLDTRALLLEKAKAAVREKLQGLNILSSSRFAEKRKADRREKHVDNDVKVNGIYPDNPIN

SEQ ID NO: 24231 - DNA, 1998 bp, Panicum virgatum
  misc_feature: Ceres CLONE 1857751
  misc_feature: Encodes the peptide sequence at SEQ ID NO. 24232
gaaatcagccaatcaggcaatttatttttgggagctgaacgtcaatcaatccaccacgtccattccgctctcgacccgcaccgccccgctccgtgcccagggccgcgccgtctctccgtccccggcgtcgtgccgacgatgcctcctccctgacgacgccgcctccccccgatgccctccgccccaactcgcggccctcgaccccaacgtgcggtgccgctctgccctgcaggaggccagcgaacggcggccccgtaggcgctccatggcgggtccgcgcgccgcacaggggctacacagcgggcggcggcgggccggtgccgccggcgcgctgctccgcctccgcgaggcgcgggtggacggacctccagttcttcgccaggtgcgagtcgtcgctccccccattcctctcttactgtctattcctctcctttcttgcttgttctggtctgcatcgattgaaacggtaactgatctcaacgattccaaatttctgctcatccgaagagagaccatgtacatgaatcccttcatggactgattttttaggtcgttaactgtgatgatttggataattgattctttacttgtggtcttctcatgtgcaacgctaaatggattacataccataatatttgtccaaacatagattggccaagagaacaagcatgttgaatatgtaggaccaataaatactttaatgcttgaacattaaaattcttcagccatctatttctcgggtaaaatttgaatttgtgtgctgctatttgttacattgctgatttcttctgtgcctagctgaatcatgttcacttcagttcaagagagtgttctctctttgtttttataatcctcctatttcttgtacagtactgaacaatataaattctctttttttattcagttcaagagagtatttccttttgtacaagataataatttattggtaatgagaaggagattaagaggtttagggataggttgcattatgcaaatatatccgatattgctaagaaggaaatgatcaacaagaagaatatgaatcgtagtgtctggaaaggaagtgtcatcaagtcacttaaaagtaagatattttatcaagttgggttgctagcatccggacaatcaatagttacgaaagattgcagtggtccggttacaaggagtgcagtaaaagctgactccgttatctgggagcatgatgacacggacgatgtgcaagagggttattatttattcatcaaatttttataaaaacatgttttataaaaatagtaaacatttcatctgcagtgtttctgcagtgctaaccgctgcttgtgtagctttttttttttgttactgtatgggcgtgctcacatgtattttgtgaaattcccttttgatcaatgattgtaccgggaaaacagattctctgtgactaattgaaaaatgtgaggtgcgatgagcacagatgaggtcagcgaaggactgggattgcatgatctcaggaacagaacatggcacatacaggggacctgtgcactccgttttgagggcctatgtgatggccttgactggcttgcatccaccctgaagtagctgcaagaatcaggccatgcaacttcagttgctggcccttccatctaattcaacaaaagtgaactcggtgcctcaaccaattgacacctcatgccgcggcggcctgttgatctgctaaaagcccacaggagctccaggatatggtgtggctgccatgtgcccacagatggaattcgtttgctgcatatgagccaatccacgctgcgtaccgaaaaaacttggaacaaaaaccttgttgtatttcagttcactcagcgtggaatactcatgtcgtctttccttatactgttggatttctttgtaagtttcaagattgttgccaaaacaacttaaattaaatggcctaagtccctgtgtggcagagctcgagctgtcgaggttaattggatattttacttggtaatatggtttcaagtt

SEQ ID NO: 24232 - protein, 45 aa, Panicum virgatum
  misc_feature: Ceres CLONE 1857751
  misc_feature: Useful for making plants with altered alkaloid content
  misc_feature: Useful for making plants with altered lignin content
  misc_feature: Useful for making plants with modulated nitrogen use efficiency
MSTDEVSEGLGLHDLRNRTWHIQGTCALRFEGLCDGLDWLASTLK

SEQ ID NO: 24233 - DNA, 1674 bp, Panicum virgatum
  misc_feature: Ceres CLONE 1857775
  misc_feature: Encodes the peptide sequence at SEQ ID NO. 24234
ctccaaaatcgtcgcgtttcgtatcgtgtcgtgccgctcttctcgccttccctcctcctcctactcttcctccacctactgctccggcttgatcggggagctcgccggatccgctagggggaatttcgcggggccctcgagcgcggcgatgggcagcttgggaggtagcggcggcgccggggccggcggcaaggtcgggcttccggcgctggatgtggcgctcgcgttccctcaggccacgccggcgtcgctcttcccgcccgccgtgtcggactattaccagtttgatgatttgctgactgatgaagagaaggctctcaggaagaaggtccgaggcattatggaaaaggaaattgcgcccgttatgactgaatactgggagaaggcagaattcccatttcatgccattcccaaccttgcaactcttggcttagctggtggtacaataaaggggtatgggtgcccaggactgtcacttacagctagtgctatttgcatagcagaagttgcacgtgtcgatgcgagctgctccacatttattttagtacactcctctttggctatgtccacgattgccctttgtggttcggaggctcaaaagcataaatacttgccttcacttgcccagttcaagactgttggttgttgggcattgacagagccagattatggaagtgatgcaagctccttaaggactgcagcaaccaaggtacctggtggttggcttttggatggccaaaagcgttggataggtaacagcacttttgcagatgtgctcatcattttagctaggaatgcagatacaaaccaactaaacggatttattgtgaagaaaggagctcccggtctaaaagccacaaaaattgaaaacaaaattggactcagaatggttcaaaatggagacataattcttaataaagtatttgtccctgaggaagacagattaacaggtatcaattcatttcaggatataaacaaggttctcgctatgtctcgcattatggtggcatggcaaccgataggcatatcaatgggagtttttgacatgtgccataggtacttgaaagaaaggaaacaatttggggccccactggcagcttttcagctcaaccaagagaagcttgtacgaatgcttggcaacattcaggccatgcttcttattggctggcgactatgcaagttgtatgagtcgggcaaaatgacgccaggccatgctagtttaggcaaggttagtaaactgtaatataggcatatagctagcgatcatttcctcatcttgggtcccacaaagattgcatcattatttgtatcttgtacaatctactgagaagtgataacattgatgcaggcatggacgtccaggaaggcgagggaggtagtttctcttggccgggagctattgggcggcaatggcattttggctgattttctggttgccaaggcattctgtgatttggagccgattttttcgtacgagggcacgtatgacattaacagcttggtgacgggcagagagatcaccgggatcgctagcttcaaacctgctgtgttaacgaaatcacgcttgtgaaattctcctagttttctcttacagaggaagccacagtgaacatgatagacacgcatcttgtataaattctcatgacgggaataagagcaactgaagattatatc

SEQ ID NO: 24234 - protein, 364 aa, Panicum virgatum
  misc_feature: Ceres CLONE 1857775
  misc_feature (166)..(218): Pfam Name: Acyl-CoA_dh_M Pfam Description: Acyl-CoA dehydrogenase, middle domain
  misc_feature (51)..(162): Pfam Name: Acyl-CoA_dh_N Pfam Description: Acyl-CoA dehydrogenase, N-terminal domain
  misc_feature: SWISSPROT Homolog: EC 1.3.3.6 Acyl-CoA oxidase
MGSLGGSGGAGAGGKVGLPALDVALAFPQATPASLFPPAVSDYYQFDDLLTDEEKALRKKVRGIMEKEIAPVMTEYWEKAEFPFHAIPNLATLGLAGGTIKGYGCPGLSLTASAICIAEVARVDASCSTFILVHSSLAMSTIALCGSEAQKHKYLPSLAQFKTVGCWALTEPDYGSDASSLRTAATKVPGGWLLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVFDMCHRYLKERKQFGAPLAAFQLNQEKLVRMLGNIQAMLLIGWRLCKLYESGKMTPGHASLGKVSKL

SEQ ID NO: 24235 - DNA, 2316 bp, Panicum virgatum
  misc_feature: Ceres CLONE 1857776
  misc_feature: Encodes the peptide sequence at SEQ ID NO. 24236
actccccccaccccccattcctcgaatttttattttgaaaaagagaaggagaagactccgcagcgcggcggaggggatcctcgccgcccgcgtcggtcggcagcggcggcgatcctgcgccggcttcagcacgccccgtcgatccggcccgctcggcctccaggttgcagcttaaggtctgtggaagatggggacctcttccggcgctaatttccaccagcagccgccgtcagcccaggggatgctgccgccgaggcacggctcgcgcccctcggggccgcagacctcgctctcgctggcctcgtccgagcaggtgggctcgccggacatgcaggagcctggctccaactccgacccagggcacgactccgccaccgagagcgccagctccagggacacgtggcctgctgagccaaaccagagcaacggtggcactgcggctgctggtatcgtgagtaaggccgtggagaaggagaaggaggtcgcgaatggcgtctccaagctgcaggttatccgcggaccctcctcccgtgtgggcgggatgcttctgagggaggttgcgcgggagagggtcgatttggtcgctgagaagatgaaggtgatgccggaggagcacttggaggagatcaagaatgagctcaggtcaattctggagggcacggggggttctcagcacatcgaggagttcttgtacctgcagaagcttgtacaggacaggactgatttgacaccatccatgctttcactggcacaccatgtgcagctggagatccttgttgcgatcaagactgggatacaggcttttctgcacccaagtgttaccatcccgcagggccgcctagtggaggtcttcttgtacaagaggtgccggaacattgcttgccagagtgctctccctgctgaggactgcaggtgcaatgtgtgtgctagcaggaatggattttgcaacctctgcatgtgtgtcatttgcaacaagtttgatttcgaagtcaacacatgccgctggattgggtgtgatttctgctctcactggacacatacggattgtgcaatccacaatggtcagattgcaatggggcaatcagtgaagagcagcattggccatcttgagatgctttttaggtgccgggcttgccagaggacctcagagctgctgggctgggttaaggatgtcttccaacaatgcgctcctggttgggacagggatgcattgttacgagagcttgagtttgtttgtaagatattccgtttaagtgacgaccaaaagggtagggtgttgttcaggaaatgtgtggatctgattgaaaggttgaggaacacccctgctgattccatcaattctagggtgatactacaggcgctccaagagcttgagatggactccccaaagatctctgaaaatgaggatgcaggacgcctgatcacaccccaggaggcctgcaaccgcatagcagaggtagtccaagaagccgtaaaaaagatggagcttgttgcggaagaaaaaatgcgcctctacaagaaggcccggctggccgtggatgcatgtgatcgcgagctggaggagaagctccgtgaggtgcaggagctgaaggcggagcgtctgcgcaagaagcagcaggtggaggagcttgagagcatggtgcggctgaagcaggcggaggcagagatgttccagctgaaggcgagcgaggcccggcaggaggcggagcggctgcagagcattgcactagccaagtccaagacggcggagcaggactacgcgagcatctacctgaagcggcgcctggaggaggcggaggcggagaagcagttcctgttcgagaagatcaagctgcaggagaaccagaagcccgggccgccgcaccaggcgagcagcagcgccggcggggaccccgcgcagacgatgatgctgtccaagatccaggacctgctcaagaacgtccgcagcatgccggccaagtcggaggggcactgagccggtcggaacaagagcagcgcatcacatcgccgctcggatcagatcggtaacggtaactgtatgtgtgatgccgcgctgatgcatgcattgctgattgctgataccttggtcagtgtaaagagctagcagaggggtaatgtgtggatggtgtcgtagtaatgccatcattagctgtgctggttggtgcttatgatgtgccgtcgtagttttgttattcggaaaactgttagaagttaaaagagtcgggcagatatgaaacaggtggagcaaacagtgatggttctatgtttacattttcattgaccaaaccaaacatattgtatgctttgcgagtatat

SEQ ID NO: 24236 - protein, 577 aa, Panicum virgatum
  misc_feature: Ceres CLONE 1857776
  misc_feature (239)..(301): Pfam Name: PHD Pfam Description: PHD-finger
MLPPRHGSRPSGPQTSLSLASSEQVGSPDMQEPGSNSDPGHDSATESASSRDTWPAEPNQSNGGTAAAGIVSKAVEKEKEVANGVSKLQVIRGPSSRVGGMLLREVARERVDLVAEKMKVMPEEHLEEIKNELRSILEGTGGSQHIEEFLYLQKLVQDRTDLTPSMLSLAHHVQLEILVAIKTGIQAFLHPSVTIPQGRLVEVFLYKRCRNIACQSALPAEDCRCNVCASRNGFCNLCMCVICNKFDFEVNTCRWIGCDFCSHWTHTDCAIHNGQIAMGQSVKSSIGHLEMLFRCRACQRTSELLGWVKDVFQQCAPGWDRDALLRELEFVCKIFRLSDDQKGRVLFRKCVDLIERLRNTPADSINSRVILQALQELEMDSPKISENEDAGRLITPQEACNRIAEVVQEAVKKMELVAEEKMRLYKKARLAVDACDRELEEKLREVQELKAERLRKKQQVEELESMVRLKQAEAEMFQLKASEARQEAERLQSIALAKSKTAEQDYASIYLKRRLEEAEAEKQFLFEKIKLQENQKPGPPHQASSSAGGDPAQTMMLSKIQDLLKNVRSMPAKSEGH

SEQ ID NO: 24237 - DNA, 1200 bp, Panicum virgatum
  misc_feature: Ceres CLONE 1857795
  misc_feature: Encodes the peptide sequence at SEQ ID NO. 24238
aagccacggcccaatcgccggctgacactctcaagaacctgcctccccctctggatcgctatcccttttctagtgctcagggaaagctagctcgagagctgggagaaggaaaaacaaatcctcagagaggttgagcaagaaccgaggcggattgctttttgtcctcctagcctaccgcgagagatcaagaagaggcgctatccagtgatctgagctgagctacggccaggaaggaggagaggagaagaacaggagatgatgcgcgaagcgtatatggaggtgctcccgccgatggaccacatagcctcgcagaggaacggctggtatcatcatccggctttgcgcatctggacggcggaggagaacaagcagttcgagcgggcgctcgccgggctcgacctgcgctgcccggactgggagcaggtggcgcgggccatccccggcagaacggtccgcgaggtcgtccatcacttcaagagcctcgaggtcgacgtccagcagatcgagaacggcatggtgcccttcccgttctacggcggcggcggcggctcgttcaccctgcagtgggacggcaatggctgcgggggccccggggacttcaggcacgggtaccgcttcggcggaggctgcgggaagcggcaccccggccgcacgccggagcaggagaggaagaagggcgtgccatggaccgaggaggagcacaagttgtttctcttgggcctcaagaagcatggcaaaggggattggaggaacatatcccgtaacttcgttcagaccaggacacctactcaagtggccagtcacgcacagaagtacttcatcaggctcaactccggaggcaaggataagaggagatcaagcattcatgacatcaccatggttaacctgacggatgaccggcctccctcgccatcacaatcctctctgatcaccaaccagtcgaacgcatcagctccaccctcagcagtaggccagttctcattgacagcggacgccaagcagaatggcactgcgaatttgcccttcaattcaccaagccggactcctgtgatgccaactttcgcgatgggtttgcaagatcaaggtctgcagtgtggccctctacatgatcagctggttggcaacccgagcatgctgttttaggagcaatccactctgcaccagggatcagatgtctagtgtataatacggtttttctgt

SEQ ID NO: 24238 - protein, 295 aa, Panicum virgatum
  misc_feature: Ceres CLONE 1857795
  misc_feature (141)..(188): Pfam Name: Myb_DNA-binding Pfam Description: Myb-like DNA-binding domain
  misc_feature (29)..(77): Pfam Name: Myb_DNA-binding Pfam Description: Myb-like DNA-binding domain
  misc_feature: The sequence is a functional homolog of SEQ ID NO 1897 in the 11/479,226 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
MMREAYMEVLPPMDHIASQRNGWYHHPALRIWTAEENKQFERALAGLDLRCPDWEQVARAIPGRTVREVVHHFKSLEVDVQQIENGMVPFPFYGGGGGSFTLQWDGNGCGGPGDFRHGYRFGGGCGKRHPGRTPEQERKKGVPWTEEEHKLFLLGLKKHGKGDWRNISRNFVQTRTPTQVASHAQKYFIRLNSGGKDKRRSSIHDITMVNLTDDRPPSPSQSSLITNQSNASAPPSAVGQFSLTADAKQNGTANLPFNSPSRTPVMPTFAMGLQDQGLQCGPLHDQLVGNPSMLF

SEQ ID NO: 24239 - DNA, 1326 bp, Panicum virgatum
  misc_feature: Ceres CLONE 1857799
  misc_feature: Encodes the peptide sequence at SEQ ID NO. 24240
ccgcacgggacgcgcgtgcgcgcatcgccgcggcgcgcgcgaccgcccccttcggctccgcgacaggcttttgctcccccaggtcggctcggctcggctcggttcggttccgccgccaccgcggcgctcccggatctcggcgaccgcttctcgtccagggattagcagacaaagatggcgacctacgagcccaagaacattctcataaccggtgctgctggtttcattgcatgcatgtggcaaaccgcctggttaggagctatccacactacaagattgttgtcctcgacaagcttgactactgctccaacctaaagaacctcaacccttcgcggccttcaccaaatttcaagtttgtcaagggtgacattgcaagtgctgatctggtcaactaccttctgatcacagagtcaattgacaccatcatgcattttgctgctcagactcatgtggataattcctttggcaattcatttgagttcacaaagaacaatatatatggtacccacgtcctgctggaggcttgcaaggttactggtcagatcaggaggtttattcatgtcagtactgatgaggtgtatggagaaactgatgaggatgctgtggttggtaaccacgaggcctcacaactgcttccaacaaatccttattcagctacaaaagctggggctgaaatgcttgtgatggcatatggaaggtcttatggtcttcctgtgattaccactcgtggtaacaatgtgtatgggccaaatcagttccctgagaaactcattcccaaattcattcttttggccatgagaggtctgcctcttcctattcatggagatggttccaatgtcaggagctacctgtactgtgaggatgtggctgaagcttttgaggtggttcttcacaaaggagaggttggacatgtgtataacattggtactgtgaaggagaggagggtgattgatgtggccaaggacatatgcaggctctttggcttggatactgagaaagtcatcaggtttgttgacaacaggcccttcaatgaccagaggtacttcttggatgatcagaagctgaagagattgggatgggcagagcgcacaccatgggaagagggattgaagaaaacaatcgagtggtataccaccaatcccgattactggggagatgtttctggtgcgctgctccctcatccaaggatgctgatgactcctggtgttgatgaaagacataactggactgaggaaaccaagtatctatcttcttcaccattggaagctagcacaacagctcctgcaaccagtacccaaagcaccaccgatgcccctcaaaagcatc

SEQ ID NO: 24240 - protein, 365 aa, Panicum virgatum
  misc_feature: Ceres CLONE 1857799
  misc_feature (2)..(232): Pfam Name: Epimerase Pfam Description: NAD dependent epimerase/dehydratase family
  misc_feature: SWISSPROT Homolog: EC 4.2.1.46 dTDP-glucose 4,6-dehydratase
  misc_feature: Useful for making plants with altered cell wall content and/or composition
  misc_feature: Useful for making plants with altered carbohydrate content
MHVANRLVRSYPHYKIVVLDKLDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVDNRPFNDQRYFLDDQKLKRLGWAERTPWEEGLKKTIEWYTTNPDYWGDVSGALLPHPRMLMTPGVDERHNWTEETKYLSSSPLEASTTAPATSTQSTTDAPQKH

SEQ ID NO: 24241 - DNA, 753 bp, Panicum virgatum
  misc_feature: Ceres CLONE 1857799-R
  misc_feature: Encodes the peptide sequence at SEQ ID NO. 24242
atttgagtacgatgctaagcaccctgaagggtctggaatcggctttaaagaggaagacacacccaactttgcaggttccttttattccaaaactaaagcaatggtggaagaactattgaaggactatgataatgtctgtactcttagggtaaggatgcctatatcatcagacctaagcaaccctcgtaacttcatcacaaagatagctcgttacgacaaggtggtgaacattcccaacagcatgacaattttggatgagcttctgcctatctccatcgagatggcgaagcgggactgcaggggcatatggaacttcaccaaccctggtgttgtcagccacaacgagattctggagatgtacaaaaagtacatcaatcccgacttcaagtggaccaacttcacacttgaagagcaggccaaggtcatagttgcacctaggagcaacaatgagatggacgcatcgaaattgaaggctgagttccctgagctgctatccatcaaggattcgttgatcaagtacgtctttgagccaaacaggaaggtcccttctaactgaggatttatacggggttgttgaggtcctttgtattggttattgttggacacaaaattagttaatgttgcatggtggttcgtagttgtggtcaattctttagggagaatggcaggcgtacctcctttctttgtcattctgttgttacggatcatgtttttacagaacacgtagaacactatgagttagcttattccctt

SEQ ID NO: 24242 - protein, 184 aa, Panicum virgatum
  misc_feature: Ceres CLONE 1857799-R
  misc_feature: Useful for making plants with altered carbohydrate content
  misc_feature: Useful for making plants with altered cell wall content and/or composition
FEYDAKHPEGSGIGFKEEDTPNFAGSFYSKTKAMVEELLKDYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVAPRSNNEMDASKLKAEFPELLSIKDSLIKYVFEPNRKVPSN

SEQ ID NO: 24243 - DNA, 2498 bp, Panicum virgatum
  misc_feature: Ceres CLONE 1857807
  misc_feature: Encodes the peptide sequence at SEQ ID NO. 24244
tctctgtctctctctctctctctcgcgagggcaggaaaggaggaagcgtggggaaggcgaggaggcgggcgacgcgactccactctccctcacaggcacccaaagctgccgccgcttctcgcgccgccagctccgcagttagagcattaagggtcgccttggatgcctgaggccgacccagcacctgcaatggaggagaaggccgtcgcaaatggcacagcagctgatgatgttgctgccccggataacaaggatagcaccaataaggaagaagctgtcaagagcatggagcctgcagtagtgaataaggatgctgaagaacagaacaaaggctcagaaaatggcactgtggtcccgtcagatggagatgccaagatggcagaggctgagagtgaaaaggaaggtgatgcagccgcaacaaaggaggtggattctgaggatgtcaaaatggatgcagatgcaaacgaagataccgatgccaagaaagaaggtgaagatgtcaagatgactgaggccgaggaaggaaatgcggaggtcaaagataaagaagaaaaggaagatgaaattgacaacacaaacgtggataagctggatgaatcaaaggagcaagagaatgaaggttcggcagagcaagaggaaaacaaaggaaaagaaacagaagagcatacacaactggaaggaaccaaacagttagatgcaaaagaagagaaagatggtgctgatgagaagcaacaggaagaggaagcagaagaaaagggctctgctgataagaaagatgaagctgacaacttggaagagaacaaggaggagactccgaagaacaagaaagtaaggagtgccagggatagaagccagggaaaggagaagaaacaggatgggtccaaatccagggaagctaaaagtttgctggagaccccaagcccatatggtactgaccgtcctcaacgtgagaggaaaacagtggagaggttggttgaggtgattgagaaggaaccaaacaggaacttggttgagaagggacgtgggactcctctgaaggatataccaaatgtggcacacagaatatcgaggaagaaacctggtgatcttaaatttcttcacaatcttctttttgggaggaagggcaagagcgtcgactttaaaggacatatactccagttctctggatttgtttggcatgagagtgatgaaaagcagagggccaaggcaaaggataagcttgacaaatgtgtaaaagacatgctgttggacctctgttggatgcttgctattccagttccaaaatcaaaccttagaaaggaagatattgtgtcaaagctgctggacttcattgctgaacctcactctgcagctgattctgggctgtctgatgatcagggatcaaattctaggaaacgcaagagaggaggtgaaagcgcaagtaagactcctgatggcacacctagtaggtcgagaaagaaatttggcaatgattccagttcaggtaaaaggcagaagaaagctctcaagtatgatactgatgaagatgaggatggtgatgaatccatgaagtctgacagtgaggaaaacagagatgaagatgcagaagaacaagaagacgactatgactctgggaaagagaaggcaaggaaaaagttcccaaaagtacaagaatcttcaagcaaaaagaagatagacagagggagtggctataaaacaggttatccaaagacaattagcaaaagtccagtaaaaaaagcatcatccaagatttctgaggaaaaagaaagccccgataacagtgcaaaggtcttttctaggaagaggaaacctacagaaaagggtgacaaggatatcacagaaaaaaagtcagcaggtaaaaaggtgacaaaaggtaaaggtgaatcagccggagcggatcttcccagcaaggacgaactgaggaagaccattactgcaatcctcaaaaaagttgacttcaacaaggcaactttcagtgacattcttaagaagctcgacaaccactacaaaatggatctggctccaaagaaagaagccattaaagttatgatccaagatgagttaaccaggatgtcagaggagacagacgaggatgaagacacaaatgaagatgccgggaagaaacagcagcagtctcaagcgaaggaggtcgaggcttgaggattcctggaaccccgtagctgtagtacccgctgttaattatcctgtacttaacatgcatgccttgccttgtacaggcatcctatgttcattatcgccgccaacttgagaacccaacctttgattgtgtatgttaagacatgatgtgtaggcagccctgagcccccacacctttttagctgactgattggagaggtactcctaggtaacttgtctctagatttgcaaatggtgtctgaaactctgcatttgctttggcagagcatgtactgaagtagtttgtgataggtttgaataacacatggacgggcgtgttaggttgtaattgtcattgtttc

SEQ ID NO: 24244 - protein, 656 aa, Panicum virgatum
  misc_feature: Ceres CLONE 1857807
  misc_feature (573)..(626): Pfam Name: DEK_C Pfam Description: DEK C terminal domain
MEEKAVANGTAADDVAAPDNKDSTNKEEAVKSMEPAVVNKDAEEQNKGSENGTVVPSDGDAKMAEAESEKEGDAAATKEVDSEDVKMDADANEDTDAKKEGEDVKMTEAEEGNAEVKDKEEKEDEIDNTNVDKLDESKEQENEGSAEQEENKGKETEEHTQLEGTKQLDAKEEKDGADEKQQEEEAEEKGSADKKDEADNLEENKEETPKNKKVRSARDRSQGKEKKQDGSKSREAKSLLETPSPYGTDRPQRERKTVERLVEVIEKEPNRNLVEKGRGTPLKDIPNVAHRISRKKPGDLKFLHNLLFGRKGKSVDFKGHILQFSGFVWHESDEKQRAKAKDKLDKCVKDMLLDLCWMLAIPVPKSNLRKEDIVSKLLDFIAEPHSAADSGLSDDQGSNSRKRKRGGESASKTPDGTPSRSRKKFGNDSSSGKRQKKALKYDTDEDEDGDESMKSDSEENRDEDAEEQEDDYDSGKEKARKKFPKVQESSSKKKIDRGSGYKTGYPKTISKSPVKKASSKISEEKESPDNSAKVFSRKRKPTEKGDKDITEKKSAGKKVTKGKGESAGADLPSKDELRKTITAILKKVDFNKATFSDILKKLDNHYKMDLAPKKEAIKVMIQDELTRMSEETDEDEDTNEDAGKKQQQSQAKEVEA

SEQ ID NO: 24245 - DNA, 1990 bp, Panicum virgatum
  misc_feature: Ceres CLONE 1857814
  misc_feature: Encodes the peptide sequence at SEQ ID NO. 24246
aaaattcgcctctcgccgctctccgggggtcctcgcgacctcatcccttgctcccccgatcaccacgcgaaccctcgaagcctcaccgcacggcggaacgcttcgccaaggcccccgcccaccgggacacctcaccttggaatcttctcccgtggccgtagcgcgctgcccttgccccccctctcctcgacaagtgccggcggcgcggatctatgcggacccggaatttgtattttccctcgctggggatggaggtgcaggtactcgatttgtcgtcagactccgaggatgaggtgtcggcgcactcgcctcagcacaagcgtcccgcgcggcaggagggtccaggtgctgatcgcgggttaggaaacacaggcgtggacagcctctctaggcaagagggcgaagcgaggttgctgcatgagcccagcgacgcggtgaagaaagggaaagagaaggttggcgaggggaagagcgcgtgggctgcggggcctccgaaactcggtggagaatcgctcggtgcttctgggacagatccttggagcgcactggtaagcaagtgtaaggctggagacggtggagatgttggagctcggtgttggggtgattggggtgatcagcttcgcaactcagtccctgtgctccagcaaagatcggaggagtttcccaatggttgtgccgcatcaggtgatcactggaatggtattcttggtgcaataccttctgatcctgccaacacactgtggtacccgtggaatgctggcaagagagaaaatgaggttggaatgctatctcaagactctctggatgctcgtgaagtttctggatgtgatgactttcttatggaagaaagtagctcagcatggctttcgaggatcaaagggctgaacttcccatttcctgatgagcgtcagttgagaaccaagcaagttgaggatgacgaggtgtttgcccgaatgcttcaggagcagctcaatcaggaacagccaggctctcagcattctgaagcggttgatatgacaatagcctggacattacatgagcaagatgctcagagtgccatatttgctgcaagagaagggcagtctagttctaaccaaagggacagatcaatggcacacttgtattcatttggccggcactcacctgctcaaggttttgcttcttgggcatccaatcgtactcagcttccaatgtcaaccagaagaactttgccaagaaacactaactgtcctcaagcggtacaacgtgatatgctcatctctcagttgaccagggggtgcttcagagaagacatggatctagaaacgagaatggctgtactggactcactttctgaagcatttgataactgtggggagacattttctccagattctgatgatgatgattatgagaccctcataccacttgatgccaacaaccatcacagaggtgcttctgatgatcaaataaacagcctgccgctgtcactagttgagggtgatatttgttcagacgaaccctgccctatatgcttggactgccctgctggtggggactccatccggcatctgccatgcttgcacaagtttcacaaagagtgcatcgacagatggcttggtatgaggatattgtgccctgtttgcaagtcaactgtgttctcgtagtagactgtatcatccgttatgttttttccagtagcatgaaggtagattagctgaccaataggaagcactggtactactggtactgcggcaatgtgtacattctgttgttgccctgtgctctcttctgctcgtggttctctgaagtggtgtggagcgttttattgctgtgagaagacactggaaaactcctatttcctgttgtatataggtaccctttttaggtgtcatgacatgcatagaaacacctacggtacttcagttttgggcgctgccatgggtgtgaagggctgatattgcactatgtaatttgcgttctaacttccaattacaaatgaagttaattt

SEQ ID NO: 24246 - protein, 477 aa, Panicum virgatum
  misc_feature: Ceres CLONE 1857814
  misc_feature (431)..(471): Pfam Name: zf-C3HC4 Pfam Description: Zinc finger, C3HC4 type (RING finger)
MRTRNLYFPSLGMEVQVLDLSSDSEDEVSAHSPQHKRPARQEGPGADRGLGNTGVDSLSRQEGEARLLHEPSDAVKKGKEKVGEGKSAWAAGPPKLGGESLGASGTDPWSALVSKCKAGDGGDVGARCWGDWGDQLRNSVPVLQQRSEEFPNGCAASGDHWNGILGAIPSDPANTLWYPWNAGKRENEVGMLSQDSLDAREVSGCDDFLMEESSSAWLSRIKGLNFPFPDERQLRTKQVEDDEVFARMLQEQLNQEQPGSQHSEAVDMTIAWTLHEQDAQSAIFAAREGQSSSNQRDRSMAHLYSFGRHSPAQGFASWASNRTQLPMSTRRTLPRNTNCPQAVQRDMLISQLTRGCFREDMDLETRMAVLDSLSEAFDNCGETFSPDSDDDDYETLIPLDANNHHRGASDDQINSLPLSLVEGDICSDEPCPICLDCPAGGDSIRHLPCLHKFHKECIDRWLGMRILCPVCKSTVFS

SEQ ID NO: 24247 - DNA, 720 bp, Panicum virgatum
  misc_feature: Ceres CLONE 1857822
  misc_feature: Encodes the peptide sequence at SEQ ID NO. 24248
accaccgcttcgccctctcctctcctccctctcccccaccgtgagctcgccgcccgctcctcgccgcggatcgcccccgctactccggtaaccgccttgccactcaccgccctgtgtctcctcggtagagccccctcccctcccctctccctccccggtacggtcctctcagatccgcccggcattgctcgcccggcgatccgatctcgcattcgcgcgctcccgccgcggatccggccggatctcgcggaagtgggccgcgggttcctttgaaatgctgtagatctgcctgttccggcgcgtgatccggtggcatctcgggcgtttcggtaacgaaatggcccgatctccggcggcttcgcggaatgccatgtttttgttcgttaattgctggtttggaaagttttttttctgctatcttattgggaggaaaaaaatagaggcaggtagttctattgattgcctttagaacagaagattttgaatgtagagccaaaaaaaagggaacaaatcatccatagctttgcaatttgcctgtttgtttatttaattcctgcttgatttgacaaaatgtggcattcgtgcgagcttccctgtaggtaaaaaatggctgacgctgaggatatccagcccctcgtctgcgacaatggaactggtatggtgaaggcggtgttcgctggagacgatgcgcccagggccgtcttccccagcatcgtgggg

SEQ ID NO: 24248 - protein, 37 aa, Panicum virgatum
  misc_feature: Ceres CLONE 1857822
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MADAEDIQPLVCDNGTGMVKAVFAGDDAPRAVFPSIV

SEQ ID NO: 24249 - DNA, 743 bp, Panicum virgatum
  misc_feature: Ceres CLONE 1857822-R
  misc_feature: Encodes the peptide sequence at SEQ ID NO. 24250
acatgaaggagaagcttgcctacattgccctggactacgaccaggagatggagactgctaagaccagctcctctgttgagaagagctacgagcttcctgatgggcaggtcatcaccattggtgctgagcgcttccgctgccctgaggtcctcttccagccatccttcattgggatggaagctgctggtatccacgagactacctacaactccatcatgaagtgcgacgtggatattaggaaggatctatacggcaacattgtcctctctggtggtaccaccatgttccctggaattgctgacaggatgagcaaggaaatcactgccttggctcctagcagcatgaagatcaaggtggttgctcctccagaaaggaagtacagtgtctggattggaggatccatcttggcttccctcagcaccttccagcagatgtggatcgccaaggctgagtacgacgagtccggcccatccattgtgcacaggaaatgcttctaattcttcgggcccaagaaatgcaagccgagaggagccattatcgccagcctccagccctgtttctttctctttttgttgctgtttcttcattagcgtggacaaagttttcggcgggtctatcgtgatcgttttcttctattcatcaagactgtaatatctattgctacctatgcttctcacttgtgattttgaacacatatgttcggtttattcaattttattgagatgcctgatgaggcaactagc

SEQ ID NO: 24250 - protein, 164 aa, Panicum virgatum
  misc_feature: Ceres CLONE 1857822-R
  misc_feature (1)..(164): Pfam Name: Actin Pfam Description: Actin
  misc_feature: Useful for making plants with modulated biomass
  misc_feature: Useful for making plants with modulated flowering time
MKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 24251 - DNA, 654 bp, Panicum virgatum
  misc_feature: Ceres CLONE 1857834
  misc_feature: Encodes the peptide sequence at SEQ ID NO. 24252
cccaaaccccgacccgctccactacggcctcacgctcagccacccggacccgcgcctcgacggcctcctcgcgacctacaccaggttctccgtccattccgtgattgggaccaaggaattggagaacagggtgcgcgacgaggtcaaggcagccgcgtactggacggcggtggcgccgaatgtggaggagtacggcggtaaggtggcgagggccatcgccacgggcgccgagcacctggccaaggggatactgtggtgcggggaggtcacggtggacaggcttcattggggaaacgaggtcctcaagaagagaatgcagcctggcgacgccaacgccgagatcagccccgagatgctcaggcggattaaaagggctaagaaggtgacccgaatatctgagaaagtggcaactggaattttgtccggcgttgtgaaggtcactggctatttcacaagctcattggccaactcaaaagctggcaagaaatttttcaacctgttgcctggagaaattgttcttgcttcgcttgaaggatttggtatgtgttgtttactatatcgatggtatctttgttaacatttatggtaagatcatgtgtctttgtggcactactgaatgttatatgtagatatgtacgtggtgacatcaatggg

SEQ ID NO: 24252 - protein, 191 aa, Panicum virgatum
  misc_feature: Ceres CLONE 1857834
  misc_feature (1)..(191): Pfam Name: Senescence Pfam Description: Senescence-associated protein
PNPDPLHYGLTLSHPDPRLDGLLATYTRFSVHSVIGTKELENRVRDEVKAAAYWTAVAPNVEEYGGKVARAIATGAEHLAKGILWCGEVTVDRLHWGNEVLKKRMQPGDANAEISPEMLRRIKRAKKVTRISEKVATGILSGVVKVTGYFTSSLANSKAGKKFFNLLPGEIVLASLEGFGMCCLLYRWYLC

SEQ ID NO: 24253 - DNA, 704 bp, Panicum virgatum
  misc_feature: Ceres CLONE 1857842
  misc_feature: Encodes the peptide sequence at SEQ ID NO. 24254
acttctcccgctcctcgctaaatccacccgtgctccgtgttcaaattcctcatcctgaccccgtacgcacgccccgggaattaggttgggctgggggccaagccaatccgatcggatcggggccggttccggcgccgccgctgggtgacctcctcccggtcgctcgcctgctcggctcgatcggccggggacggcggcggccaaatctgcaatggagggcaacaaggacaacccggccaattgcttgcgcatcggcgggggcgcgctcaaggccggcaaccgcgcgcgcgccgtcaagttcctctcgaaggccaagcgcctcgacccgtccctccccatcaacaacctcctcgctccgctcctcagcccccagaacaactcccccgcttcctcgtcatcatcgccgccgccgcccccaccgccacaaccttcagcagggccagcgggagcaggagcagctgaggctgacgggctgaaaaaaaggaaacaaaagggcaaaaggagggaggaggaggaaaaggcaactggcgctgcaaaagagtacacggtggagcagctcgaggttgtgcgccaggtcaaaaagcactccagggactactaccaaatcctgggcctcaagaaggactgcaccgtcaaggacgtgcgcaaggcctaccgcaagctctcgctcaaggtgcaccctgacaagaacaaggcccctggcg

SEQ ID NO: 24254 - protein, 164 aa, Panicum virgatum
  misc_feature: Ceres CLONE 1857842
  misc_feature (128)..(164): Pfam Name: DnaJ Pfam Description: DnaJ domain
MEGNKDNPANCLRIGGGALKAGNRARAVKFLSKAKRLDPSLPINNLLAPLLSPQNNSPASSSSSPPPPPPPQPSAGPAGAGAAEADGLKKRKQKGKRREEEEKATGAAKEYTVEQLEVVRQVKKHSRDYYQILGLKKDCTVKDVRKAYRKLSLKVHPDKNKAPG

SEQ ID NO: 24255 - DNA, 1283 bp, Panicum virgatum
  misc_feature: Ceres CLONE 1857851
  misc_feature: Encodes the peptide sequence at SEQ ID NO. 24256
aaaaacccaaaagcccccccgaaccagaaaaaatcgcccccgccccgcccccgcttgccgtgtctccgcttccgcatccccaagcggagctctcgctttcggcgcgcgctcccgtccggcctccagggcgccccatgagctgaggccgccgccgatgggcccgcccccctccgcgcaggaccccgcgccgtcgccgtcgggcggcagcggctccggctcctccaggcgccgcctccgccggctcgaccgccgcaacgcgtccaagaacatcggctacgacgccaccaacttctgccagttcccgccgtccccgcagccggcctccgcgccggcgtcggggccggcctcgctcgccggctccgtggcctgctccctcgacctcgtcaacagcttccgcatcggcggcagcggcgacggcggcggggacgtccagctcctctgccagagcctcggcctctccggccccgacgacttcgccatctcgctcgccgactggcaggcgcacaaggccgtgcgctcctcggcctccgcctccgcatccccttcgtccgcgcggcacaaacccgaaccccccgcgcgggactccccgctccgccacgagggtgccgaggagcccacccggccagcggacgccgaccacgagctaccggcgaaggagccggccgcgaggaacgccccaatcgaagctctggagcggccggcacggctggatccgctcgagtccacccgcccggatgtgaagagggcagttggggagggaggaatcaagggcttgcgcccgccgccggtgctcaagccgccccccacgatggcgctgccggctgtctgcggggcgggatccacgtgggacatcctgcggtcgttcgcgccggatgagaaagagcacgcccctgcgagcagatctggccgaggttttgcacaccaggatgcggaggaggacgaggatgcggcggtagcgttgacgctggaggatctcaggcttggcgagtcgtccgagggcttcactggcacttcttcgctatccaccacgaacgatgacgagacttgcagcacgaccacagagtccatgttctacatctcaccgaacggccggttcaggaagaagattcggtcatggaaccgaggggtgctgctggggagtggctcgtttgggacggtgtatgaaggcatcagcgatgagggtggcttctttgccgttaaagaagtaagcttatatgatcaagggagcaacgcgaagcagtgtatctttcagcttgagcaggaaattgcacttctgagccagt

SEQ ID NO: 24256 - protein, 376 aa, Panicum virgatum
  misc_feature: Ceres CLONE 1857851
  misc_feature: SWISSPROT Homolog: EC 2.7.11.25 Mitogen-activated protein kinase kinase kinase
MGPPPSAQDPAPSPSGGSGSGSSRRRLRRLDRRNASKNIGYDATNFCQFPPSPQPASAPASGPASLAGSVACSLDLVNSFRIGGSGDGGGDVQLLCQSLGLSGPDDFAISLADWQAHKAVRSSASASASPSSARHKPEPPARDSPLRHEGAEEPTRPADADHELPAKEPAARNAPIEALERPARLDPLESTRPDVKRAVGEGGIKGLRPPPVLKPPPTMALPAVCGAGSTWDILRSFAPDEKEHAPASRSGRGFAHQDAEEDEDAAVALTLEDLRLGESSEGFTGTSSLSTTNDDETCSTTTESMFYISPNGRFRKKIRSWNRGVLLGSGSFGTVYEGISDEGGFFAVKEVSLYDQGSNAKQCIFQLEQEIALLSQ

SEQ ID NO: 24257 - DNA, 734 bp, Panicum virgatum
  misc_feature: Ceres CLONE 1857851-R
  misc_feature: Encodes the peptide sequence at SEQ ID NO. 24258
attcagtgcgatcaaatcatgcaaaggaactgtttattggatggcaccggaggttgtcaatccaaagaagacatatggacctgctgctgacatatggagtcttggttgcactgtcctggagatgttgacacagaaaattccctatcctgatctggaatggacacaagctttatacaggattggtaaaggggaagcgccagcaattcctagtggtctttcaaaggatgcccgtgattttataagccagtgtgtaaaacccaatcccgaagacagaccttcagcatcgaaactgttggagcatccattcgttaacaggtcaataaggtcggtacggtctatgaggacatcttcacgctcaaattcgtctacacgtggcatcaactgatgagcggggatcatttatagcacagtggcagaatgatattagtcaccgcgaatcatgcggagctggctgaaagggagggtggtttgcctggagcttgtattgtaaacgctcaacagcatcctcatcaaccgtgttatttttccattagttgattctttgacatacgtttgagggaagaaagatgtcctcgtgattcagccgccggctaatattcttctgccgggaggagttagaacagtgaatgcgcatttgagcgcatgagttgtagtgggaacgggcgatgtaaatatgtcagcgtgtccatgtgggtatttgtcttgatatgttgctatgagaaaaagaaaaatag

SEQ ID NO: 24258 - protein, 127 aa, Panicum virgatum
  misc_feature: Ceres CLONE 1857851-R
  misc_feature: SWISSPROT Homolog: EC 2.7.11.25 Mitogen-activated protein kinase kinase kinase
FSAIKSCKGTVYWMAPEVVNPKKTYGPAADIWSLGCTVLEMLTQKIPYPDLEWTQALYRIGKGEAPAIPSGLSKDARDFISQCVKPNPEDRPSASKLLEHPFVNRSIRSVRSMRTSSRSNSSTRGIN

SEQ ID NO: 24259 - DNA, 691 bp, Panicum virgatum
  misc_feature: Ceres CLONE 1857865
  misc_feature: Encodes the peptide sequence at SEQ ID NO. 24260
ttctgcaagcgcgccgcccctcaccgccggcttctgcccctcctccacccctgccgccgccccgcagttggagacgctcgcctcgccggaaatcatgtaccgcgccgcggggagccacctgcgctccctgaagcatctcggtgctaccaggcttgctagtacaagtgttgtgaagcagccccaaggtggtcttttcagctggcttcttgggggaaattcaagccaacttcctcccctagatgttccgctaccaggcattactattcccccacctctaccagactttgtagaaccatctaagacaaaaatcactactcttccaaatggcatcaagattgcctcggaaatgtcaccgagcccagcagtctcagtgggtctgtatattgactgtggttccatttatgaaacacccgtttcatctggagtctcccatctattggagagaatggccttcaagagcacagtaaatcgtagtcacttgcggctagttcgtgaggtagaagccattggaggaaatgtctccgcatcagcttcccgtgagcaaatgagctatacctacgatgcattgaagaactatacaccagaaatggttgaagttctcattgacagtgtgaggaatccagcatttcttgaatgggaggtcaaggagcagctccagaagatcaaatctgaaatagctgaagtgtctgtt

SEQ ID NO: 24260 - protein, 198 aa, Panicum virgatum
  misc_feature: Ceres CLONE 1857865
  misc_feature (80)..(196): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHLGATRLASTSVVKQPQGGLFSWLLGGNSSQLPPLDVPLPGITIPPPLPDFVEPSKTKITTLPNGIKIASEMSPSPAVSVGLYIDCGSIYETPVSSGVSHLLERMAFKSTVNRSHLRLVREVEAIGGNVSASASREQMSYTYDALKNYTPEMVEVLIDSVRNPAFLEWEVKEQLQKIKSEIAEVS

SEQ ID NO: 24261 - DNA, 1789 bp, Panicum virgatum
  misc_feature: Ceres CLONE 1857877
  misc_feature: Encodes the peptide sequence at SEQ ID NO. 24262
aaaaacggtggcaggtggacgggcatggtcagcgaggtcccagctccgtagccgttgattcactcgttccatctcgtctcgtcctctcctcgcaccggccgcggccatggaggatcaccgcggaggcggtgccgtgggaggaggaggcgaggtcgagaagagctcggcgctgggcgaggtcaggaggcagctgcgcctcgccgcgccactcgccgccgggctcctcctgcagaaggtcatccagaccatctcgatcctgttcgtcggccgcctcggcgagctccccctcgccagcgcctccctcgccacctccttcgccaacgtcacgggcttcagcttgctgtcaggcatggcgagcagcctggacacgctgtgcgggcaggccttcggcgcggggcagcgccacctgctcggcgtctacaagcagcgcgccatgctggtgctggccgcggcgaccgcccccgtggcggcggtctgggcctacgccggcgagatcctcgtctggttccggcaggaccgggcgatcgccgcgggggccggcagctacacccggcgcatgctcccggcgctgctcctgttcgggcagctgcagtgccacgtccgcttcctgcagccgcagaacgtcgtggtgccggtgatggcgagttccgccgccaccgccggggcgcacgtcgccgtctgctggctgctggtgcgccgcctgggcatgggcgccaacggcgccgcgctggccaacgccgtctccaacctcgtcaacctgacggtcctggtcatctacgtcagggtctcgccagcctgcagggacacctggacggggttctcccgcgaggcgttccgcggcatcccgggcttcctcaagctcgccgtgccgtccgctgccatggtctgtatggagtggtggtccttcgagatccttgtgcttctttcaggtcttctccccaacccaaagctcgagaccgccgtgatgtctatctgcttcaacacctatgtctttgcattcatgctcccgatgggacttggttctgcagcaagcattcgtgtttcgaacgagcttggtgcaggacggccgcaggcggcgcgcctcgcgacgcgggtggtcattctcctggcgatctccctgggcgtttgtgaaggtcttttcatggtcctggcccgtaatctactgggatatgcgtacagcaatgagaaggaagtggccttgtacaccgctaagctgacgccgatcctcgcggtgtgcaccttatttgacagtctgcagtgtgttctttcaggtattgttagaggctgtggccggcaaaagattggtgcctttatcaacctttctgcattctatattgttggcattcctgcggcatccatattcgcctttgtctgtcatctcagaggaatgggactctggcttggtatcttgtgtggagtagcagtgcagatgctcttgcttctctgcatcaccttgtgcaccaactggaacaaagaagcactgaaggccaatgatagagttttcagttcttctcttcctgtcggcaacacggtaacatcaggtggtagcgagcatctaaatggacgcagttttgttggtaagggtgcgcaagggaccattgaggggacaaacggttctaccactccgagcacaggttgatggcatcatgtacttgctgctttgccttcagttagaagctttctccatccttgtctctaagaaaagaaatgcacttaggaatgtgtagcagagcactgaagatgtattcaattggttttagaagtctgaaacctcggtaaggctctccgc

SEQ ID NO: 24262 - protein, 510 aa, Panicum virgatum
  misc_feature: Ceres CLONE 1857877
  misc_feature (255)..(418): Pfam Name: MatE Pfam Description: MatE
  misc_feature (34)..(194): Pfam Name: MatE Pfam Description: MatE
MEDHRGGGAVGGGGEVEKSSALGEVRRQLRLAAPLAAGLLLQKVIQTISILFVGRLGELPLASASLATSFANVTGFSLLSGMASSLDTLCGQAFGAGQRHLLGVYKQRAMLVLAAATAPVAAVWAYAGEILVWFRQDRAIAAGAGSYTRRMLPALLLFGQLQCHVRFLQPQNVVVPVMASSAATAGAHVAVCWLLVRRLGMGANGAALANAVSNLVNLTVLVIYVRVSPACRDTWTGFSREAFRGIPGFLKLAVPSAAMVCMEWWSFEILVLLSGLLPNPKLETAVMSICFNTYVFAFMLPMGLGSAASIRVSNELGAGRPQAARLATRVVILLAISLGVCEGLFMVLARNLLGYAYSNEKEVALYTAKLTPILAVCTLFDSLQCVLSGIVRGCGRQKIGAFINLSAFYIVGIPAASIFAFVCHLRGMGLWLGILCGVAVQMLLLLCITLCTNWNKEALKANDRVFSSSLPVGNTVTSGGSEHLNGRSFVGKGAQGTIEGTNGSTTPSTG

SEQ ID NO: 24263 - DNA, 1289 bp, Panicum virgatum
  misc_feature: Ceres CLONE 1857889
  misc_feature: Encodes the peptide sequence at SEQ ID NO. 24264
gccggcgatactactactagctagccaggggcatcagcgcgtgggtgggttttgctcctgctcggcgctcgcttcgccttcggttgctgccacacctcccgtcctgcccctacgccgccgccgggatgatgggaggagggtcgctggtgctggatcagcgcatgccggcggacgacgacaaggccctcttcggcgagtgcttcctcggcgagggcgacctcgtcagcccggcaccggcgcacgacgacatgatgatgagcttcgtccccgacggcgacgagagcgacgacgacgacgtgggcggcatcgaggagctggagcgccgcatgtggcgcgaccgcctgcgcctcaggcgcctcaaggagcagcagcagcagcagcagactggcggcaaggaggaggcgccgccgcggccccggcagtcgcaggagcaggcgcggcgcaatcgcaagaagatgtcccgcgcgcaggacggcatcctcaagtacatgctcaagatgatggaagtctgcaacgcgcagggcttcgtctacggcatcatcccggagaacggcaaacccgtcaccggcgcctccgacaacctccgagcctggtggaaggagaaagtccgcttcgaccgcaacggccccgcggccgtcgccaggtaccaggccgacaacgccgcgccgggcgggggcgccgcagtggccgccgcgccggcagggccacactccctgcacgagctgcaggacaccacgctgggctcgctgctctcggcgctcatgcaacactgcgacccgccgcagcgacgcttcccgctcgacaagggcgtgccgccgccgtggtggccgcaaggcgcagagccgtggtggcccgaggccggcgtgcccggggagctgggcccgccgccgtacaggaagccgcacgacctcaagaaggcctggaaggtggccgtgctcaccgccgtcatcaagcacatgtcccccgacatcgacaaggtccggcgcctcgtgcgccagtccaagtgcttgcaggacaagatgactgccagggagatcgtccaatggctcgccgtgctcaagcaggaggaggacctgcacctcgtgcagcagcacccgcccggcgccctccccacgctgtcctccaacgccgccgccgccgtgctcccgttcagcgcaagctccggtgagtacgacgtggacggtgccgacgacggcgaagagaccgacggccggaactcgatgaagccggcctgcaacaacgcacccgcgttcgtggacctttcgtcgtccatggatgctattgctagc

SEQ ID NO: 24264 - protein, 387 aa, Panicum virgatum
  misc_feature: Ceres CLONE 1857889
  misc_feature (42)..(387): Pfam Name: EIN3 Pfam Description: Ethylene insensitive 3
  misc_feature: The sequence is a functional homolog of SEQ ID NO 1358 in the 11/479,226 US patent application
  misc_feature: Useful for making plants with modulated biomass
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
  misc_feature: The sequence is a functional homolog of SEQ ID NO 204 in the 10/225,068 US patent application
  misc_feature: The sequence is a functional homolog of SEQ ID NO 2468 in the 10/374,780 US patent application
  misc_feature: The sequence is a functional homolog of SEQ ID NO 1361 in the 11/479,226 US patent application
  misc_feature: Useful for making plants with modulated low light sensitivity
MMGGGSLVLDQRMPADDDKALFGECFLGEGDLVSPAPAHDDMMMSFVPDGDESDDDDVGGIEELERRMWRDRLRLRRLKEQQQQQQTGGKEEAPPRPRQSQEQARRNRKKMSRAQDGILKYMLKMMEVCNAQGFVYGIIPENGKPVTGASDNLRAWWKEKVRFDRNGPAAVARYQADNAAPGGGAAVAAAPAGPHSLHELQDTTLGSLLSALMQHCDPPQRRFPLDKGVPPPWWPQGAEPWWPEAGVPGELGPPPYRKPHDLKKAWKVAVLTAVIKHMSPDIDKVRRLVRQSKCLQDKMTAREIVQWLAVLKQEEDLHLVQQHPPGALPTLSSNAAAAVLPFSASSGEYDVDGADDGEETDGRNSMKPACNNAPAFVDLSSSMDAIA

SEQ ID NO: 24265 - DNA, 747 bp, Panicum virgatum
  misc_feature: Ceres CLONE 1857889-R
ctgcggcaacgcgcagtgcccgcacaacagcagcgcgcacgggttcctcgaccgcggcgcgcgcaacgcccaccagtacacctgcgagttggacttcaacttcaacacccccgccgccgataacaacaagcagctggcaccgccgccaggtcgtcaggccgtcgacttggagttgcacgtcgacggccaaaggtcgctggccgagctgatggagatgtacgacgccaacgtgggtgcgccccggagcctgagcggcatcgacgacacgggcgccgcccccgccggcgtgcaggtgtccggcggcccatttctgacgccctggctatttggcggtgccactgcaaccaacggcgtgatgccgccgccgccgctgcagcagcagcagagcgcggggttctacgtccgtgacgatgcgctgccgccgttcagcgacatcgccgccgcgtcgccggagttgaggttcagttcaggtctgaacgtgccaggaagcactgcgcattacggcggtgcatcgcagctgcagcaacagcacaagcccgcgggatccaattggttctactgagtactgactaactgctgcattagaatcatggacaagatggagcttgctagtttctcattatgtcattacaatccaagatagttctgcttgtataagatttgggtactgatgatgtagctgcagacggctcatgccatccaatcttgttcagttcgttagcttttaatcaaatcctgttcagcagc

SEQ ID NO: 24266 - DNA, 725 bp, Panicum virgatum
  misc_feature: Ceres CLONE 1857892
  misc_feature: Encodes the peptide sequence at SEQ ID NO. 24267
gaggaagcgagcgaggacgcggcggcgcgcgacgagcatctgaagccgaggaagcgaggacgcggcggcgcgcgagcatctgaagccgaggcgaggacgcggcggcgccggggaggggagatagctgaggaagttgccgctgccgtgagcgcgcgcgcgatatcgatatggccgtggcgacggcgctggccgtgttggtggtggcggcggcgctagcgcttgcgctgccggccgcgcgcggggtggaccggagcgagttccctccggagttcctcttcggcgccgcgacgtcggcgtaccagatcgagggcgcgtacctggaggacggcaagggcctcaacaactgggacgtcttcacccacacgcactctggagtgatcatggacggacggaacggggacgcggctgacgaccactaccatcgctacatgggagacgtggagatcatgcagtcgctgggcgtcaacgcgtacaggttctccatctcatgggcaaggattctaccaagaggcaggcttggcggcgtcaatccagatgggatagcgttctacaaccgcctgatcgatgccctcctgcagaaagggatacagccgttcgtcacactgcaccatttcgacatgccgcacgaactggaggtccgatacgttggctggctgggcgccggaatccgggaggagttcgagcactacgcggacgtgtgcttcagggcgttcggcgaccgggtg

SEQ ID NO: 24267 - protein, 185 aa, Panicum virgatum
  misc_feature: Ceres CLONE 1857892
  misc_feature (27)..(185): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
  misc_feature: Useful for making plants with modulated biomass
MAVATALAVLVVAAALALALPAARGVDRSEFPPEFLFGAATSAYQIEGAYLEDGKGLNNWDVFTHTHSGVIMDGRNGDAADDHYHRYMGDVEIMQSLGVNAYRFSISWARILPRGRLGGVNPDGIAFYNRLIDALLQKGIQPFVTLHHFDMPHELEVRYVGWLGAGIREEFEHYADVCFRAFGDR

SEQ ID NO: 24268 - DNA, 2026 bp, Panicum virgatum
  misc_feature: Ceres CLONE 1857899
  misc_feature: Encodes the peptide sequence at SEQ ID NO. 24269
ggttcccacttcccacccccgccgtgccggctcgagtcgcgcggtcgcgcccaatacacccgaccccccgcaaggaagatacctcctcgtccacgcgacgacacaaacccacccccgccgccgccgtcgtccaggccgcggccaattccggcgccatggccgacgacgacgacgccgccgccctctccgacgtcgacgaggacccccttccgtctccctctcccgcccccgcccgcaaaaccctaccgcaagcccagccccagcccgacgcccaggcgcagcagcagcagcagcggctgctggacctggccgcggagctcgaggaggagcgccgcctccgccgcgccgccgagggctccctcgcggacaccgagaaccgcttcgcccgcctcaaggccttcgcgcaggacgcgctccgcaagcgcgacgagctcaccgccgaggccgccgcctccgcgcgctccgtcgccgcgctccaggccgaggccgccgcctccgagcgctccctcgccgcggtccaggccgagtccgccgcctccgcccgctccctcgccgcgctccaggcggaggccgccaccgcctcctccatgctctcctccggcttcgagaggatctccgccaaggcctccccttcctcggcccccgcaccgctcccgacctcccagaagtactccgccggcctccccgccctcgcgtacggcgtcctcaagcgcgccaacgacatcgtcgacgacctcctcgcccagatcgacgccgccaaccgcgaccgcgaccgcgcgcgggagcagatggaacaccgcaactaccagatcgccatcgaggtctccgagctcgaggcatcgctcgcgtccaggtccgccgagtgcgaatccctctccaagtccctctcgcagcagcaagccgagatctccgacctccgtgacaaaattggctctctcgaggggaagctcgacgcgcagaggcccgtgctcgcggagcagatcggctgcgcctccaagctgtacgatgaaatccgggaggtggtcaagctggttgatgccgatgctgccagcacgttgtcagactcggtttttgtgtggaaggagacagacgttgaggagagcctcaaggtgtccctggaagggacgaaattggcctatgagcttgcggcaatggccttggagaaggttgggacattcattgatgacaaggagagcaagctgaggggtttggaggacagggtggatgaactgattaaagagaaggagcacattggcgtgctgctccggagtgcactacaggcaactacgagcgaagtgttaaaggttgcagaagatgggttgagggaggccggcattgagattggactcgacgagcgaaaggagcacaggccagggagtgtggagaaggacgaggtctataccctggcaggggcactagagaataccatgaaggagtcccaagttaagatcgttgagcttgaacatcttgtcgaagcactaagggcggagtctggcctacttagaacaaggctggaagggcaagaaaaagagattgtccagctaagaaagcaaataaagcaccttgaggagaaggaaagggtggcaaatgaaagtgttgagggcctgatgatggacgtgacagctgctgaagaggagattaaaagatggaagatggcagcagaggaggaagctgaagctggtagatctattgagcaagagttccaaattcagatctcttctcttaggaaggaactagatgaagcaaagcaagctatggtggagcttgaaaacaagctgaagttcaaggaagagacagcaaccgcagcgatggcagcacgtgatgctgcagagaagtcactaaagctagcggatctgcgatcgtccaggctgcgggagaggctggaggagcttaacaggcagctagaggaatcagataatagaactgactcggtcaatcgcaatggccatcggtacatgtgctggccatggcaatggttaggactgaactatgtgcggttacctcctgcagagacagatcaaacatc

SEQ ID NO: 24269 - protein, 623 aa, Panicum virgatum
  misc_feature: Ceres CLONE 1857899
  misc_feature: SWISSPROT Homolog: EC 2.7.11.1 Non-specific serine/threonine protein kinase
MADDDDAAALSDVDEDPLPSPSPAPARKTLPQAQPQPDAQAQQQQQRLLDLAAELEEERRLRRAAEGSLADTENRFARLKAFAQDALRKRDELTAEAAASARSVAALQAEAAASERSLAAVQAESAASARSLAALQAEAATASSMLSSGFERISAKASPSSAPAPLPTSQKYSAGLPALAYGVLKRANDIVDDLLAQIDAANRDRDRAREQMEHRNYQIAIEVSELEASLASRSAECESLSKSLSQQQAEISDLRDKIGSLEGKLDAQRPVLAEQIGCASKLYDEIREVVKLVDADAASTLSDSVFVWKETDVEESLKVSLEGTKLAYELAAMALEKVGTFIDDKESKLRGLEDRVDELIKEKEHIGVLLRSALQATTSEVLKVAEDGLREAGIEIGLDERKEHRPGSVEKDEVYTLAGALENTMKESQVKIVELEHLVEALRAESGLLRTRLEGQEKEIVQLRKQIKHLEEKERVANESVEGLMMDVTAAEEEIKRWKMAAEEEAEAGRSIEQEFQIQISSLRKELDEAKQAMVELENKLKFKEETATAAMAARDAAEKSLKLADLRSSRLRERLEELNRQLEESDNRTDSVNRNGHRYMCWPWQWLGLNYVRLPPAETDQT

SEQ ID NO: 24270 - DNA, 621 bp, Panicum virgatum
  misc_feature: Ceres CLONE 1857900
  misc_feature: Encodes the peptide sequence at SEQ ID NO. 24271
attgcacgctgcatcagcctccagctctcccaaggcggcggcggcggcagcagcagcacacagagctcagctcggtggtcatgcaggcatcgtcgaccacggcggccatggcgtcgctgcgcgcgctcccgctcccggcgctggtgcccctcgtcgtctcggcgctcgccttcctggtgaccgtcctccggctcgtcctgcggcggcagcggccggtgtacctgctcaactacgactgccacctcccggacgtggaccggtaggtgaacctagaggtgtgtcgagtacttcgggctcaagtgccgccgctactccgacgacatcgccgacttcatgcggctcatctacacaaagtccggcctggggcaggagaccttcgcgccgcccttcatcttctcgggccggttcgacatgactctggcgttcgcggtgcatgaagccgacgagggcctcttcgccgcggtcgggcagctcctggacaaggccgacgtgacgcccgccgacatcaccgtcctcgtcgtggcgtgctccatgatctccccgatgacgtcgctggcgtcgatgatagcgcacccgcttcaagatgcggtccgaatgtgaaggaatacgagatcctcggta

SEQ ID NO: 24271 - protein, 88 aa, Panicum virgatum
  misc_feature: Ceres CLONE 1857900
  misc_feature (1)..(87): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MRLIYTKSGLGQETFAPPFIFSGRFDMTLAFAVHEADEGLFAAVGQLLDKADVTPADITVLVVACSMISPMTSLASMIAHPLQDAVRM

SEQ ID NO: 24272 - DNA, 2281 bp, Panicum virgatum
  misc_feature: Ceres CLONE 1857923
  misc_feature: Encodes the peptide sequence at SEQ ID NO. 24273
gtacgccgtcccgctcgcttccctcgcgtgccatggctccccgcgccacacagctcctgctctccctcctcgtcgggctactcgtcctcgccgcgcccgcgcccgcgctcgccgccgacggcaccatcgtcttcaccacgctgggccgcagccgctacgccttcgacatcttcgcgctccccctcgccccgctctcctcctcccccgccgccgaggctcgcctcaccgacggcgcctccgtcaactacaacggcaacttcgcgccgtccggggagtccctcctcttcgtctcggagcgcaacggcaccctcaacctctacatctcccccgtcccctccgcctccgcctccggctcccgccgcgaggcgctggaggttcccgaggcggcgccgctcacgccgctgctcccgtgggaccccatcacgctcaaggaccgcccgtcgctgacacccgacggcgcccacctcgtgtacgtctccaccgccgatcccgcggaggccccgcgccggagctgggcggccgtctacaacatgcacctgccctccgggtccacgcgccggctcaccccgcgcggcgtcgcggatttcagccccgccgtgtcgccgtccggggagtggacggccgccgcgtcgccgggccccgacgggtggggcggcgaggtggaggacctcgacaccgacatctacgtcttccggacgtccgacgggtcgcggcggacgctggccatccgcgacggcggctggccgagctgggccgacgagacaaccctcttcttccaccgccgcgacagcgacggctggttcggcgtgtaccgcgccaagatctcgttcgcgggcgacgccggcgtgtccgcggcgtccgtcgagcgcatcaccccgccggggttccacgccttcaccccggccgcgtcgcccggcgcgcccgggctcgtggcggtggcgaccaggcggcccggctcggactaccgccacatcgaggtcatcgacgtgagcggcggcggcggcgccaacgcctacttcgaggtgaccaggcccgtggcgccgcgcgtgcaccacttcaacccgttcatctcgccggacggcgcgcgcgtcgggtaccaccggtgccgggggagcgggaacggggactcgccgctgctgctggagagcatcaagagccctgcgccggacacgttctcgctgttcaggatcgacgggtcgtacccctccttctcgcacgacggcaagaggatcgccttcgtcgggctgccggggctgttcgtggtcaactccgacggttccggtggtcgccggcgaatcttctctggcaatgccttccccacggcatgggactggaagaggaagggggtcatctacaccagcatcgggccagacttcgcgagcgagaggacagaggtcgacgtggtcgccgtgtcgctcggcgacgaggactcgagcatctcgatcaagaagctcaccgtgggtggcgggaacaacgcgttcccttccccctcgccagacggcaagtggatagtgttccggtccgggaggtccgggcacaagaacctctacatcatggacgccgaggacggcgaggccggcggcatccggcggctgaccgaggggccctggtcggacaccatgtgcaactggtcccccgacggcgagtggatcgcgttcgcctccgaccggcacaacccgggcggcggcagcttcgccatctacatggtccacccgaacggcaccgggctgcggcgggtggcccacagcgccgacggcgggcggacgaaccacccctggttcagcccggactccaagtccctggtgttcacgacggactacgccgccgtgtccgcggagcccgtctcgaacccgcaccactaccagccctacggcgagatcttcaccgtgaacatcgacggctcgggcatccggcggctcacgcacaactcgttcgaggacgggacgccgtcgtggacgccctactacctgaagccggaggacgtcggcgagacgctgcaggactccgggacttgcgcgttcgaggattgccactggctcaacatcgatgcccagccacatggcctcctcatgtgtggcaggcacggctaattaagttcatgcatgtatgtaaataataactaggtatatagcgaccagcgacagcgagagcagtgatgccctcccatctatgtttgcttgcctatgaataaggtcatgtatgtacagtcatgccagttctacggcaacaataacctcattagcacatactcataatgaagtttacttgccagtattatggc

SEQ ID NO: 24273 - protein, 685 aa, Panicum virgatum
  misc_feature: Ceres CLONE 1857923
  misc_feature (519)..(558): Pfam Name: PD40 Pfam Description: WD40-like Beta Propeller Repeat
  misc_feature (472)..(507): Pfam Name: PD40 Pfam Description: WD40-like Beta Propeller Repeat
MAPRATQLLLSLLVGLLVLAAPAPALAADGTIVFTTLGRSRYAFDIFALPLAPLSSSPAAEARLTDGASVNYNGNFAPSGESLLFVSERNGTLNLYISPVPSASASGSRREALEVPEAAPLTPLLPWDPITLKDRPSLTPDGAHLVYVSTADPAEAPRRSWAAVYNMHLPSGSTRRLTPRGVADFSPAVSPSGEWTAAASPGPDGWGGEVEDLDTDIYVFRTSDGSRRTLAIRDGGWPSWADETTLFFHRRDSDGWFGVYRAKISFAGDAGVSAASVERITPPGFHAFTPAASPGAPGLVAVATRRPGSDYRHIEVIDVSGGGGANAYFEVTRPVAPRVHHFNPFISPDGARVGYHRCRGSGNGDSPLLLESIKSPAPDTFSLFRIDGSYPSFSHDGKRIAFVGLPGLFVVNSDGSGGRRRIFSGNAFPTAWDWKRKGVIYTSIGPDFASERTEVDVVAVSLGDEDSSISIKKLTVGGGNNAFPSPSPDGKWIVFRSGRSGHKNLYIMDAEDGEAGGIRRLTEGPWSDTMCNWSPDGEWIAFASDRHNPGGGSFAIYMVHPNGTGLRRVAHSADGGRTNHPWFSPDSKSLVFTTDYAAVSAEPVSNPHHYQPYGEIFTVNIDGSGIRRLTHNSFEDGTPSWTPYYLKPEDVGETLQDSGTCAFEDCHWLNIDAQPHGLLMCGRHG

SEQ ID NO: 24274 - DNA, 2336 bp, Panicum virgatum
  misc_feature: Ceres CLONE 1857924
  misc_feature: Encodes the peptide sequence at SEQ ID NO. 24275
gagaacacgcgcgctgacagcgagcactaaccaacacaagtgccccgcgccgccccccagaatcccagatctctgtccctgtcgtggcaccaaaaccaaatcccattatttgttggacacctctaatcccaaaggggaggcgaaaatcccgttaaccccagggcattccccggaggcgacgaacagcccagggcaggggtcacaagagaggaggcggagggacgaacgaaaagctgaaaagaatccatctctttcgtgctcctacccccctcttccgcctcaagctttcctccgttctcatcttctcggggtggggggcgacaggcggtgcgatcttggttgggttcacgggggggagagagaggggggcgccgccggagaggtgctccgccgccatggcattgcccgttcccttcgtccgcctgacgctgctgctgctcgtcgccctgccattctgcgcggcgcatcccggtccgggcttccatactcatcgcgagttccagaggcccgcgctcgactcagatggatttggcttggtggcaaggagatcaattgctgaagctcctgctgacataaacatcactacgaatagctcctttgtcttggcagcagataggacgtaccgcagggaccccttgaatggtttcaggaaatatccaggtggctggaatatcagtgaagtgcactattttgcttctgttggatatacagccattcccctgtttgcgattgccctggtgtggtttgtgttcttttttctggttatgcttgggatttgctgccatcattgctgttgtccacatcgcagttacaagtattctagaacagcatatgccttgtcactgatacttctaatattgttcacttgtgctgcaattgttggatgtgttatgttatatgatggccagggcaaattccataaaagcacaacaactactctgaaatttgttgttagccaggcaaattataccgttgacaaccttaggaacctatcagatagtttgtctgctgcaaagaaggttgacattgggcgattcttactgcctcctaatgtgcaaaatcaaatcaacgaaattcaaggaaagttggattcatcagctaatgatcttgcagttaaaacaacagataatgctgcaaaggttaaaaaattgctaaaccaagtgcggttggctttaattgtcattgcggctgtaatgcttcttctggcttttattggcttcttgttatccatctttggtctggaattccttgtctccgttttggttgttattggatggatactagttactggaacatttatcctgtgtggtgtcttccttctgctgcacaatgtcacgtcagatacctgtgttgcaatggaggagtgggttgctcatcctaccgaacacactgccctggatgagattatcccttgcgttgaacctgccacagcaaatgagaccctgtatagaagcaggcaagtcactttccagctagtgaatctggtgaaccaggtgatcaccaacgtgtcgaatcagaactttccttctcctccggtagcaacgcctttctactacaatcaatcggggccattgatgccgctgctctgcaacccattcacacctgatctgagcaaccgcacctgcaccagaggagaggttaccttggacaatgcaacacaggtttataggagctttgaatgccagaccaccactgtctcaggagccgagatttgcaccacggtgggccgtgtcacccccaggatctatggccagatggcggcgggtgtgactgtgagccaggggctgtaccagtatggccctttcctcattcagctggaggactgcaccttcgtccgcgacacattcaccgccatcaatcaggactactgccctggcctgcagcggtacagcaagtgggtgtacatcggcctggtgatggtctcggcagcagtgatgctgtccctgatcttctgggtgatctacgcgagggagcggcgccaccgcgtgtacaacaagcagttcatcgcccagcaccagccatacccggtggaagacaagccggcccctactgcaccgcacgcttgatgaccgcgttcccatgcctgtgcatactccttgctagtggttttcgtaatgtagatcgcaggacccttgattgttggttgcttgctgattttcgtagccgaggtttatgtgcattttcgtattgacggtagctggatttgtggctcgaatttgcagaggtcagacagacttggtctgaacgtgtttcggttggttgtgttgggattggtcattggtggtgtactgtacatacagtcatgatctggaagagctgcatggtcgtcagtttac

SEQ ID NO: 24275 - protein, 556 aa, Panicum virgatum
  misc_feature: Ceres CLONE 1857924
  misc_feature: Useful for making plants with modulated biomass
MALPVPFVRLTLLLLVALPFCAAHPGPGFHTHREFQRPALDSDGFGLVARRSIAEAPADINITTNSSFVLAADRTYRRDPLNGFRKYPGGWNISEVHYFASVGYTAIPLFAIALVWFVFFFLVMLGICCHHCCCPHRSYKYSRTAYALSLILLILFTCAAIVGCVMLYDGQGKFHKSTTTTLKFVVSQANYTVDNLRNLSDSLSAAKKVDIGRFLLPPNVQNQINEIQGKLDSSANDLAVKTTDNAAKVKKLLNQVRLALIVIAAVMLLLAFIGFLLSIFGLEFLVSVLVVIGWILVTGTFILCGVFLLLHNVTSDTCVAMEEWVAHPTEHTALDEIIPCVEPATANETLYRSRQVTFQLVNLVNQVITNVSNQNFPSPPVATPFYYNQSGPLMPLLCNPFTPDLSNRTCTRGEVTLDNATQVYRSFECQTTTVSGAEICTTVGRVTPRIYGQMAAGVTVSQGLYQYGPFLIQLEDCTFVRDTFTAINQDYCPGLQRYSKWVYIGLVMVSAAVMLSLIFWVIYARERRHRVYNKQFIAQHQPYPVEDKPAPTAPHA

SEQ ID NO: 24276 - DNA, 630 bp, Panicum virgatum
  misc_feature: Ceres CLONE 1857933
  misc_feature: Encodes the peptide sequence at SEQ ID NO. 24277
atttcagccgcccatcgcaagcaagcgaaagcaagcagcacggtgccctatcttgtcctgccccggccgatgtcttgtgtccgggccatccggccgtccatggcggcgacggccctgctcctccccggcctctcggcggcggcgcccacggccgggcagcgccagctccagctccagcgcggctccctcgcctgctgggccccccggccgcgccggcggctcgcggcctccgccgtgcaagagaccaaggagggcgaggccaagacggccgaggagatcaccgagaagtacgggctcgagttcggcctctggaaagtcttcagctcctcctctccctcgccgcggcggccgcggtcgtcaccgccgccgtcgacgccgaggaccccctgatccgtcaggtggtgcccggcggcgacgacaacgacctggagctgaacgcggagtcccacttcttgagcttcgtgcagcgcttcggcaagtcttacaaggacgccgacgagcacgcgtaccggctgtccgtgttcaagtccaacctgcgccgcgcgcgccgccaccagctgctggacccgtcggcggagcacggcatcaccaagttctccgacctgaccccggccgagttccgccggacct

SEQ ID NO: 24277 - protein, 209 aa, Panicum virgatum
  misc_feature: Ceres CLONE 1857933
  misc_feature (150)..(206): Pfam Name: Inhibitor_I29 Pfam Description: Cathepsin propeptide inhibitor domain (I29)
  misc_feature: SWISSPROT Homolog: EC 3.4.22.51 Cruzipain
FSRPSQASESKQHGALSCPAPADVLCPGHPAVHGGDGPAPPRPLGGGAHGRAAPAPAPARLPRLLGPPAAPAARGLRRARDQGGRGQDGRGDHREVRARVRPLESLQLLLSLAAAAAVVTAAVDAEDPLIRQVVPGGDDNDLELNAESHFLSFVQRFGKSYKDADEHAYRLSVFKSNLRRARRHQLLDPSAEHGITKFSDLTPAEFRRT

SEQ ID NO: 24278 - DNA, 725 bp, Panicum virgatum
  misc_feature: Ceres CLONE 1857941-R
  misc_feature: Encodes the peptide sequence at SEQ ID NO. 24279
ggccaacgtgaccgtgcgcaacgccgtgatccggcgctccgacaacggggtccggatcaagacgtggcagggcgggtcggggtccgtgtcgtcggtggcgttcgagaacgtgcgcatggacgccgtgcgcaaccccatcatcatcgaccagtactactgcctctccaggacctgcgagaacgccaccaccgccgtcttcgtctctggcgtctcctacgccgggatccggggcacctacgacgcgcgcagcccgccgatccacttcggctgcagcgacgccgtgccctgcaccaacatcacgctcgccgacgtcgagctgctcccggcggcgtcgtcgtcggggcaggcggccgacgaccccttctgctggaacgtctacgggaacgccgccgcgcccacggtgccgccggtggcgtgcctcatggacggcgtgcccggtaactacgccgacaagagcagcttgaaatgctactgaccgatcgaggtcgtcgtacaatctaattaatagtgatctgcaatcctggtacttgtttagagggaggccaacagatgacagagaaaagtaagattagtgcagataaaacatggttgttaaagcgtgattacttatgtatatatagaaaagaagataaaggtatactagctagtaacaagcagggatttgagtgagtattaccggaatgtatacacagtatgtatagaaggaatgctgcttggtgccatgc

SEQ ID NO: 24279 - protein, 157 aa, Panicum virgatum
  misc_feature: Ceres CLONE 1857941-R
  misc_feature: SWISSPROT Homolog: EC 3.2.1.15 Polygalacturonase
  misc_feature: Useful for making plants with altered cell wall content and/or composition
  misc_feature: Useful for making plants with altered carbohydrate content
ANVTVRNAVIRRSDNGVRIKTWQGGSGSVSSVAFENVRMDAVRNPIIIDQYYCLSRTCENATTAVFVSGVSYAGIRGTYDARSPPIHFGCSDAVPCTNITLADVELLPAASSSGQAADDPFCWNVYGNAAAPTVPPVACLMDGVPGNYADKSSLKCY

SEQ ID NO: 24280 - DNA, 648 bp, Panicum virgatum
  misc_feature: Ceres CLONE 1857941
aacaagcctctgatgaggcctccactaccgcgctgctctcccaccaccaccaccaccgccctccctcccctcttccaatcctgctcctcctcccgtcccctgttcctgcgcacggcgcgccacctataaatccgtgcgtctccaagccaacaactaccgcggctaactgcctcgcctcgcctcgcctccggcagtgtctagctagctagctcagctcgtcctagccagccagctagctgcagtagcttgcttgctagatccccgcgacagcgaccgcgctaatggaggtcgccgccaggaccgccattgctctgctcctcgcgctcgccgtcgcctcggggtgcctctgcggcggcgcgcagggacgccaccaccgccacaccaagcacaccaggcacaactcggcgcacgcgccctcccaggctccgggcccggcgagctccaggcggcacgcgcctccgcacgcgccgggcgcctctcccccggccccgccgccgccgtcgtcgtcgtcgggggccggcggcgcggcccccgcgccggcgccagagaccgcggcgggcggcgcggccgccgtgtacgacgtcgtgaaggacttctgcgcggtcggggacggcgtggcggacgacaccgacgccatcaagacggcgt

SEQ ID NO: 24281 - DNA, 397 bp, Panicum virgatum
  misc_feature: Ceres CLONE 1857946
  misc_feature: Encodes the peptide sequence at SEQ ID NO. 24282
accacacgccgaggcttgctcttcttcttcttcttgttgttgttgatacaaaaatagaattcaggggcagccggggcccgagatcggcgaggccggccgtgcttgctgctcgcgccattgacacatcctccatctgctaccgcacaggtagcgaggcaggtagcaatggagacccgggacagcgccccctccaccacgccgctcccctactcctactcgccgctgccggccgccgacgccgcctccgccgaggtctccggagcccgcgcccgccagaggccgctctgtcccgccccgctcgtgctgtccgccgcgctgctgctcctcgccttccctccgctggctggcgtccggataccgcccccccggcccctcccggcgcgacatacagatccgg

SEQ ID NO: 24282 - protein, 77 aa, Panicum virgatum
  misc_feature: Ceres CLONE 1857946
  misc_feature: Useful for making plants with altered carbohydrate content
METRDSAPSTTPLPYSYSPLPAADAASAEVSGARARQRPLCPAPLVLSAALLLLAFPPLAGVRIPPPRPLPARHTDP

SEQ ID NO: 24283 - DNA, 1385 bp, Panicum virgatum
  misc_feature: Ceres CLONE 1857947
  misc_feature: Encodes the peptide sequence at SEQ ID NO. 24284
gcccccgcatggttctggccttctgggttcctggctccttcctcctcctgtacctgcccccggttcttggcgacggagcgccgctgggatggtgacgacctccgccgccgccgacgacgcccgttgctcctccgatccggctcctcctcttttgagtagagtctccctttgaattcaaacacgatcgagctttctggaagttggtcgacaatggatcacagtcaccacatctataaccaatctgctgcaaacctctgccaccagtttggttcagacaatccattgcttggcatggggattcagcagtcatttgcgccattcacctctccatttggtgcttcctcatcgaccaatattccccacatggattggaacccagctaccatgctagataacctcaccttcatcgaggagaagatacagcaagtgaaggatgtaattcggacaatggtggacaatggcagccagctaccatgttgtccaggggagctcgcccagcagcagcaggtggtcaatgcagacctgacatgcctcatcgttcagctcatctctactgccgggagcctcctcccatcactgaagaactcgtcctttctgagccaccccccagctggacacacaggcatcgttaaccatgttgggtcgagctcaagctttgttcctaacgtgacaaccatttctgaggagaacgaggaaatgtgtagcccggaggactacgaagaacttttcaagggtttcactgatggcgcgatggaaggagacattgaaattgacaatgttcttgctggggagcaggatgcaaaggatggcgatgaaggtggtgatgctggcatggatggagagagcttaccgctaggctcttatgagttactgcagctggagaaggatgagatattggccccacacacgcacttctgctccatctgtggaaagggtttcaagagggatgcgaatctgcgaatgcatatgagaggccacggtgatgagtacaagagccctgctgcactagccaagccacctagagatgcaagcacagaacacgaagtggtgaagaggtactcttgcccatttgtaggctgcaagcggaacaagctgcacaaaaacttccagcccctcaagacgatcctgtgcgtaaagaatcactacaagaggagccactgtgagaagagctacacctgcagccggtgccacacgaagaagttctcggtcatggccgacctcaagacgcacgagaagcattgcggccgcgagaagtggctgtgctcctgtggaacaagtttttcaaggaaggacaagcttttcgcacatgtagctctgtttcaaggccatacaccagcattgccagcagaggaggcaaagacttctttagaccagatcggtgactt

SEQ ID NO: 24284 - protein, 391 aa, Panicum virgatum
  misc_feature: Ceres CLONE 1857947
  misc_feature (234)..(256): Pfam Name: zf-C2H2 Pfam Description: Zinc finger, C2H2 type
  misc_feature: The sequence is a functional homolog of SEQ ID NO 552 in the 10/666,642 US patent application
MDHSHHIYNQSAANLCHQFGSDNPLLGMGIQQSFAPFTSPFGASSSTNIPHMDWNPATMLDNLTFIEEKIQQVKDVIRTMVDNGSQLPCCPGELAQQQQVVNADLTCLIVQLISTAGSLLPSLKNSSFLSHPPAGHTGIVNHVGSSSSFVPNVTTISEENEEMCSPEDYEELFKGFTDGAMEGDIEIDNVLAGEQDAKDGDEGGDAGMDGESLPLGSYELLQLEKDEILAPHTHFCSICGKGFKRDANLRMHMRGHGDEYKSPAALAKPPRDASTEHEVVKRYSCPFVGCKRNKLHKNFQPLKTILCVKNHYKRSHCEKSYTCSRCHTKKFSVMADLKTHEKHCGREKWLCSCGTSFSRKDKLFAHVALFQGHTPALPAEEAKTSLDQIGD

SEQ ID NO: 24285 - DNA, 694 bp, Panicum virgatum
  misc_feature: Ceres CLONE 1857964
  misc_feature: Encodes the peptide sequence at SEQ ID NO. 24286
gtattgccaaattttggaggctttgactaaaaaagctccgttttttcgagcttcctcctcctccccggaaataaaattcgggggcccaaaaaattcgcaattttgggggcgctcgtggccgccgctccgcccgaattcgcgcgcctcccggagccgatcccgcgcgggccatggaaatgaagattcaattcctctctttggttcaatgaggaactgtgcatacttaactcttgtccagttgttgctcttggggttcgttgctcccactcaaattagtctgtttgacaatcgaatccaaaggtgcagatgagtgaggagtgcaatatggatgaggccctgaaagccaaaggtgttgctgagaacaagttccgtgaccatgacatcaggggtgctcggaagtacgcaatcaaggctcagactctctgcccgtcgcttgaaggcatatctcagatggtgtccacactagaagttcatcttgcagctgagtccaagattgatggagagtgtgactggtaccggatattgtctctaggtgcctttgcagatgaagaggaagtgaagaagcagtatcggaagctagctctgctgttgcaccccgacaagaacaagtcaattggtgctgaggaggccttcaaactgatctctgaggcatggggtgtgttgtctgataatggcaggaagatgctttacgatg

SEQ ID NO: 24286 - protein, 129 aa, Panicum virgatum
  misc_feature: Ceres CLONE 1857964
  misc_feature (68)..(129): Pfam Name: DnaJ Pfam Description: DnaJ domain
  misc_feature: SWISSPROT Homolog: EC 2.7.11.1 Non-specific serine/threonine protein kinase
MSEECNMDEALKAKGVAENKFRDHDIRGARKYAIKAQTLCPSLEGISQMVSTLEVHLAAESKIDGECDWYRILSLGAFADEEEVKKQYRKLALLLHPDKNKSIGAEEAFKLISEAWGVLSDNGRKMLYD

SEQ ID NO: 24287 - DNA, 1850 bp, Panicum virgatum
  misc_feature: Ceres CLONE 1857969
  misc_feature: Encodes the peptide sequence at SEQ ID NO. 24288
cactgcattgtgtaggttgatcgcgcggacatggcgcacgtcctggtgttcccgctcccggcgcagggccacctcaacagtttcccgccttcctccacttctcctcggggctcctccgcgccgacctccacgtcaccttcctccacagcgaccacaacctccgccgcctgggcgccgccgcgcgcgaggccgcggccgcctcgccgcgcctccgcttcctgtccgtgcccgacggcctccccgaagacgacccccgcgacgcgggcggcatcccgcggctcttggagggcctgcacaccacgggcggccccgcgtaccgcgacctgctcgcctcgctgcgccgcgcggggggcaccgccgacgggttcccgccggtgacgtgcgtcgtcgccgacggcatcatgccgttcgccttgggcaccgccgaggagctcggcgtccccgcgatcgcgtaccgcacggtgagcgcgtgcgccatcctggcgtacctgtccgtgcccaagctgatcgagctcggcgagctcccgttccccgagggcgccgacctcgacgagcccatccgcggcgtcccggggatggagagcttcctgcggcggcgagacctcccggtccagtgccgcttcctcaccgacacgcatcaagaccccttgctggaaaaggcagtcgcggccaccatgcagagccgcaaggcgagggcgttcattctcaacacgaccgcgtccctggagcgggcatcccttacgcacctggcgcgggagatgcgggacgtgttcgccatcgggccactccacgccatgtcccccgcgccggcggccgccacgagcctgtggcgacacgacgaccggtgcttggcgtggctcgacggccaggcggagcggtccgtggtgtacatcagcctggggagcctcacggtgatctcccacgagcagttcaccgagttcctgcacgggctcgtcgccgccggctacccgttcctgtgggtgctccggccggacatgctcgggacgagccaggacgcggcgctgcaggaggcggtcgccgctgccggggagggcaggtcgtgcgtcgtgccgtgggtgccgcagcgggacgtgctccggcaccgcgccgtggggtgcttcctgacgcacgccgggtggaactcgactgtggagggcatcgtggagggcgtgcccatggtgtgctggcccttcttcgtggaccagcagatcaacagccggttcgtgggcgccgtgtggaagaacgggctggacatgaaggacgtgtgcgagagggacggggtggaggggacggtgagggtggccatggagtccgccgagctcaggaggacggcgcgtgccctggcggagcaggtggagcgtgacgtcgccgacggcgggtcgtcggcgctggagttcaagcggctcgtcagcttcatcagggagctcagcagcacgtcagcagcagagaacgatctccagaataaagaatggactgatctgaaagtggctcaaactaacttgatccacttgccatcgagtaccctatgctatctgcacgtgaaacaccaccacctgccacctccaagcctacaaaagggaagaaagttaaggagaaggcaaaggcagcagggaagaaaaagaagaaaattatttcaatgctacatgatagtccagcaatgggtactagaagcaagaccctttagaatcaaagccctgcctcacatactagaagtcaaagaaagcttccacttccgggcctaaatggctagttcatgcggttctcttcagttttaggggcaatagctatttgcttgttcttttgtgaaccaagtctaatgttagcatgtgagactacaatggctggactac

SEQ ID NO: 24288 - protein, 446 aa, Panicum virgatum
  misc_feature: Ceres CLONE 1857969
  misc_feature (1)..(343): Pfam Name: UDPGT Pfam Description: UDP-glucoronosyl and UDP-glucosyl transferase
  misc_feature: SWISSPROT Homolog: EC 2.4.1.115 Anthocyanidin 3-O-glucosyltransferase
  misc_feature: Useful for making plants with altered carbohydrate content
MPFALGTAEELGVPAIAYRTVSACAILAYLSVPKLIELGELPFPEGADLDEPIRGVPGMESFLRRRDLPVQCRFLTDTHQDPLLEKAVAATMQSRKARAFILNTTASLERASLTHLAREMRDVFAIGPLHAMSPAPAAATSLWRHDDRCLAWLDGQAERSVVYISLGSLTVISHEQFTEFLHGLVAAGYPFLWVLRPDMLGTSQDAALQEAVAAAGEGRSCVVPWVPQRDVLRHRAVGCFLTHAGWNSTVEGIVEGVPMVCWPFFVDQQINSRFVGAVWKNGLDMKDVCERDGVEGTVRVAMESAELRRTARALAEQVERDVADGGSSALEFKRLVSFIRELSSTSAAENDLQNKEWTDLKVAQTNLIHLPSSTLCYLHVKHHHLPPPSLQKGRKLRRRQRQQGRKRRKLFQCYMIVQQWVLEARPFRIKALPHILEVKESFHFRA

SEQ ID NO: 24289 - DNA, 2426 bp, Panicum virgatum
  misc_feature: Ceres CLONE 1857973
  misc_feature: Encodes the peptide sequence at SEQ ID NO. 24290
aaaaaaaaactgtcaatttgtcctccccgctcctcccctgtcgcctcccccctcaccgtcgcgacgccgcccttctgcccctcctgcaccgcgctcgacctcccactaaatccgccgcgcgcgccgcgtccaccgccgcctcggaacccgatcttcttcgcctcccgcgtgacaggcgcgggctcccatcgattggaagggattgctgcatcatgcatttttggtggataatcttcatttgctcttgactcttcaatgcttgttgtcttcaaaatgtcaggcttgcttaattcaaaccttaatagttccgcatcaaatcttccggactcaactggaagaccatttacagcatccttttcaggccaatctggatcaattccaggtttccatcattctggtttgcacaacattcatggaagtttcaaccttccaaatatgcctggatcacttgtccaaaggaatgctgcaatgagtggccttccatcctctggggttcaacaacccggtgggagcatttctgggagattcacctcaaataaccttccagttgccatgtctcagattccgcacgcacattcaggcgtcagtggtagagggatgaatgttggtgcaggtccagcatttagtagcagcatgaatattggtggtaacattcaaggcttatcctcgagcttgggtgccggtggtagtcgcaattctgttcctgggatgtcggtatctccatctttaggaaacttgggcccacggatcacaagttctgtaggaaatattgtaggtggcagtaatattggaagaaatataagctctggtggtttatccgtgccaagtattgcatctcggatgaatctgagtggcaacactgtgagtggtaatctaaatagcaggatgatgaatggcctgcttcagcaagcatctcctcagttgataaatatgcttggaagttcttatccaacatctggaggttcattatcacagaaccaaattcaagcaggaaataattctctaagttctattgggatgttgcatgatgccaatgacaccgctccatttgacataaatgattttccccatttgactggtcgacctagttcagctggtggtccacaaggacaatatgggtcactacgcaagcaaggagttggtgttaataccattgttcaacaaagccaggaattcagcattcaaaatgaagacttcccggctttgcctggattcaaaggtaactcttcagattatgctatggagttgcatcataaggaacaacttcatgagaatgtacctgtaatgcaaacacagcagtttcctatggcaaggtcagttggctttaatttaggaagtagctacccacctaatcgtcagcaacaccagcaaggtgctaactcagtccagaatgctggaactcaaaatattggactaagacctagtttggcatacgatcaatttatgcagcaataccagcagccgcagtctcaaaatcctttcaggatgcagcagatgacttcagctacacattcatttcgggatcagattcaaaagattcagggggggccgtcaccacctgatccatatggcttgttaggattactgggagttataaggatgaatgatgctgaattagcatctcttgctttaggaatagatttaacaacattgggtttgaacttgaattcacctgataatgtatacaagacatttggttcaccctggtcaaatgagccagcaaaaggagatcctgattttcatattccagcttgctacttctctgagcaaactccagagctgcagcctatactttttcagaagcttcacctagcaaccctattttacatcttctatagcatgccaaaggatgaagctcagctatatgctgcccatgaactatatagtcgaggatggttttaccataaagaatcaaggttatggttcacaaaaattccaaatgtggaacctctagtcaaaactcctctctatgaacatgggtcttatggtttctttgatccacagatttgggagacagtccgtaaggacaactttgttctccattacgagctggtagcgaaaaggccagcccttccttctgtagcacaaaatgttagatgaaaaaaaaattctgggtatctccttagtcctaactcaaattttgtccctgctggatgggacaaagaagctcatattcacactatggcatcattacctaactcttaaggacggggagaaactcagaaactaaggttacactgatctgctgtgaggaaggctacagcacagaattggggctgtccagttgacagcccttgtaattatactaaaccagtgtagagaatgctgcattttcctttgatcgtggggagcgcctactccctgtgtaggagaaaaccagtgtaggacaaaaaagagaagcaatggctcatgtccttctgtcccgg

SEQ ID NO: 24290 - protein, 614 aa, Panicum virgatum
  misc_feature: Ceres CLONE 1857973
  misc_feature (462)..(601): Pfam Name: NOT2_3_5 Pfam Description: NOT2 / NOT3 / NOT5 family
MLVVFKMSGLLNSNLNSSASNLPDSTGRPFTASFSGQSGSIPGFHHSGLHNIHGSFNLPNMPGSLVQRNAAMSGLPSSGVQQPGGSISGRFTSNNLPVAMSQIPHAHSGVSGRGMNVGAGPAFSSSMNIGGNIQGLSSSLGAGGSRNSVPGMSVSPSLGNLGPRITSSVGNIVGGSNIGRNISSGGLSVPSIASRMNLSGNTVSGNLNSRMMNGLLQQASPQLINMLGSSYPTSGGSLSQNQIQAGNNSLSSIGMLHDANDTAPFDINDFPHLTGRPSSAGGPQGQYGSLRKQGVGVNTIVQQSQEFSIQNEDFPALPGFKGNSSDYAMELHHKEQLHENVPVMQTQQFPMARSVGFNLGSSYPPNRQQHQQGANSVQNAGTQNIGLRPSLAYDQFMQQYQQPQSQNPFRMQQMTSATHSFRDQIQKIQGGPSPPDPYGLLGLLGVIRMNDAELASLALGIDLTTLGLNLNSPDNVYKTFGSPWSNEPAKGDPDFHIPACYFSEQTPELQPILFQKLHLATLFYIFYSMPKDEAQLYAAHELYSRGWFYHKESRLWFTKIPNVEPLVKTPLYEHGSYGFFDPQIWETVRKDNFVLHYELVAKRPALPSVAQNVR

SEQ ID NO: 24291 - DNA, 656 bp, Panicum virgatum
  misc_feature: Ceres CLONE 1857983
  misc_feature: Encodes the peptide sequence at SEQ ID NO. 24292
ggaatttccaattgcttccgcggaaaaaacatttttttttttgttctagcgatagcttgctgctcgctctccatcctcctctcgacctccaggctgcgggttcggcgcgcctcggctttgcctcgcccccaatcccacctcgcgctcgccgccggcattccggcagttcctgctgcgggaggggccttccggaaccgcgctgccgcgccccgatggacgacccgggagccaccgaccccgccgccgcgcgccaccacctctcgccgcagctcggggggcagcagccggtgccgcgctccccgaccccgctcgacctggcggccgccgcggcgtccgggtaccgccgcctctcgccgtcgctccgcccgccggcgcacccacaggcgcgcctcccgtcgccctacggccagatccccgcgccggggggcgggggccaccacgcgcgctccctctcccagccgctcttcttctcgctcgactcgctcccgccgccgccgtacgccgatctgggcgccgcgccgcacgcggagccgccgtccccgccgtcttcgagctccgacccgcagcagcagccgccgccgccgccgccgctcgggctgccgccgaggaagggagcccaccgccgctcgcacagcgacatcccctttggcggcttc

SEQ ID NO: 24292 - protein, 147 aa, Panicum virgatum
  misc_feature: Ceres CLONE 1857983
  misc_feature: SWISSPROT Homolog: EC 2.7.11.24 Mitogen-activated protein kinase
MDDPGATDPAAARHHLSPQLGGQQPVPRSPTPLDLAAAAASGYRRLSPSLRPPAHPQARLPSPYGQIPAPGGGGHHARSLSQPLFFSLDSLPPPPYADLGAAPHAEPPSPPSSSSDPQQQPPPPPPLGLPPRKGAHRRSHSDIPFGG

SEQ ID NO: 24293 - DNA, 529 bp, Panicum virgatum
  misc_feature: Ceres CLONE 1858010-R
  misc_feature: Encodes the peptide sequence at SEQ ID NO. 24294
cccatacagttccaaacaaaaatgacgggtgtagggaacccactaaagaggcactacgagacatatttgctggaatacgaacttgcacatgatgatgttgatggggagtgttgcttgatttgccacagcagtgctctgggcgactgggtgaactgtgggttatgtggagaatgggcccactttggctgtgacagacggcaagggctgggcactttcaaggactatgcgaagacagatgggttggaatatatttgcccccagtgtagccttgtgaaaagcaaaaagccaccgctgcccgttagagtaggcaatggcttagccacctctggattacaaactgtaaattaacttacgttatttttcttttcccttggctttttgtcccactttttggggggtgattgtttgggtagataatattggccaagcatatgtttttttttgtttgaggagatggcatgtgtagtgttgttgatctgtgctatcatttaacccgtaggttctaagttatatatatagattgtaatcg

SEQ ID NO: 24294 - protein, 115 aa, Panicum virgatum
  misc_feature: Ceres CLONE 1858010-R
  misc_feature (37)..(91): Pfam Name: PHD Pfam Description: PHD-finger
  misc_feature: SWISSPROT Homolog: EC 2.1.1.43 Histone-lysine N-methyltransferase
PIQFQTKMTGVGNPLKRHYETYLLEYELAHDDVDGECCLICHSSALGDWVNCGLCGEWAHFGCDRRQGLGTFKDYAKTDGLEYICPQCSLVKSKKPPLPVRVGNGLATSGLQTVN

SEQ ID NO: 24295 - DNA, 1192 bp, Panicum virgatum
  misc_feature: Ceres CLONE 1858010
aaaacagcaacggtggcagcagcatcgatcagaagccgcgtgaggaggagaatccgcgcccacacgcgccgccacctgcgaggccgattctcccaatccgagcggttcagtattggcatgagctgaagtccaggagctagttattccttcgaccatgtctcaaatccagagcacctcgcgctgtgcgctccttgctgttcgatgtgggaggttcaccgaggagcagcagaccccggctcacctggcacctgagccgaagcgggtgcgtccatcctaccccttcccggagctcgtctcctgtgggagattagaggtgcacacgctgatcaatccctcggtggagcaatttagagaggcacagcaggcggtgcaacctaacttgttgtatcttcaggggcagcagctagagaacgcggagataggttcactcgtctggggcgatactgatttatctgacccgcagacatttagctcactcatcagcccaccatttccgaccatagtttatttggaagttcccataggggaaaagtttgcccagtcacttcattcaaaggggataccatatgtaatatattggaggaattcatttccatgttatgcagcatctcattttcgccaggcattaatgtcagtcattcaaagttcctgcagccatacatgggatgcatttcaacttgcgcatgcctcgtttcgactatattgtgtgagaaataactatgtacaaagtgttaagcttggccctcgcctacttggggatgctccaaaaataaatatcatccctgccgagaatgatgtggatgaggaagaaggttgttctgaagcttttctggctataaaaatatatgatgaagatgtgaacatgaaatttcttgtctgtggagtgccatgcaccttggatgcatatttgttgggcgcactggaggatggtttgaatgctctgttgaatattgagattcgtgggagtaaacttcagaaccgagtcagtgctgctgctccacccctacaagctgaaactctttcacatggggttgtttccatgcgctgtgacatcacaacatgcagttcttcacatgtgtcacttcttgtttctggtttgaaacatcttgcgccagaaatctcttacagaagcttggttgcacttggaattgcttgtgtaaatggcacaccagtgtcttcatttgacaggaag

SEQ ID NO: 24296 - DNA, 635 bp, Panicum virgatum
  misc_feature: Ceres CLONE 1858017
  misc_feature: Encodes the peptide sequence at SEQ ID NO. 24297
aagatcgagctcggggaggttggggcgcagaaaaaaaaaatcatctccaatctccaaccaaactaaccctagcagcagccggcggttagggtttcgagcgagatggcggcggcggcgaggcagcgcgggacggtgaagtggttcaacgacaccaagggcttcggcttcatctcccccgaggacggcagcgaggacctcttcgtccaccagtcgtccatcaagtcggagggcttccgctccctcgtcgagggcgaggaggtcgagttctccgtctcggagggcgacgacggccgcaccaaggccgtcgacgtcaccggccccgacggatccttcgtcaagggcggctccgcatcctcctcctccgccgccgccgcccacttcccgcgcgcgcgcgcagggatatggagcgatgcggctcgcgcggcgccctctcgggcctcgcccttctcgtctccgagcaccgcccacaggttcttccacgggactaggccggtggctgcgagggactactacgatgtgcttggcgtcagcaagaatgcgagccaggccgatattaagaaggcgtattacgggcttgcaaagaagcttcatccagacacaaataaaggtgatgcggatgcagaacgtaagtttca

SEQ ID NO: 24297 - protein, 177 aa, Panicum virgatum
  misc_feature: Ceres CLONE 1858017
  misc_feature (6)..(73): Pfam Name: CSD Pfam Description: 'Cold-shock' DNA-binding domain
  misc_feature (135)..(177): Pfam Name: DnaJ Pfam Description: DnaJ domain
MAAAARQRGTVKWFNDTKGFGFISPEDGSEDLFVHQSSIKSEGFRSLVEGEEVEFSVSEGDDGRTKAVDVTGPDGSFVKGGSASSSSAAAAHFPRARAGIWSDAARAAPSRASPFSSPSTAHRFFHGTRPVAARDYYDVLGVSKNASQADIKKAYYGLAKKLHPDTNKGDADAERKF

SEQ ID NO: 24298 - DNA, 1335 bp, Panicum virgatum
  misc_feature: Ceres CLONE 1858033
  misc_feature: Encodes the peptide sequence at SEQ ID NO. 24299
cctgctagatctcactcaattcgccgcgcgcgctgccgcagatccatcccctccacctgccccagcggcctaaccccctcccgcaccccgccatggcggatctcgccgtggcgtcccctccgccggcccacgccccggccccggcgacggacctcttcggggagcccatcgaggcgcacccgccatggttcaagcccgactccttcctccgcgccgatttcgacccggacgcgtacgtcgccgagctccgctcctacgtcccgctcgagagcctcgccgccgagctccgcgcccacctcgccgcgctccgcgccgagctcgtcggcctcatcaaccgcgactacgcggacttcgtcggcctcagcgcgcgcctcaagggcgtcgacgccgccgccgcgagaatgagggcgccgctggcggacctcagggacaaggtcgcgggcttccgcgcgggggcggcggccgctctggccgcgctcagggcggggctcgagcagcgggcggcggccactgccgcgcgagagcttctcgagctgctgctcgacacttcgcacgtcgtctccaaggttgagaaattgatcaaggaactaccatctgcaccatctgattcatcgaatgctgaagttcagtcaatcgatacacaaaatgtggaggcaggaacaggtgtcagagaaactcaaagcatcctcctagaaagaatagcaagtgagatgaaccggcttaaattctacatcagtcatgcacagaacctcccttttattgagaacatggagaagagggtccaaggtgctacaaaactgcttgatggtagcttggagtgttgctttgtggacggtctggaacaccgtgatgcgaaagtaatttacaactgtttgcgcgcttatgctgccatcgacaatacatcatcagctgaagagcttttccgtgcaacagtggtgtccccgttgattcagaaaatagtccctcaaaattatgcaaaagcagttgctggtgcatcttctgatggactggaagatgattatgagcagataaagcaatgcatagaaaaagattgcaaatttatattggaaatatcatcatcagcaaactctggattgcatgtttttgattttctgggtaattcaatactcaaagaagtcctttctgcaatacagaaaggcaagcctggggccttttctcctggaaaacctaaagaattcctgaagaactacaaggcgaccttaggatttcttgattttctggaaggttactgtcaatccaagtctgctgtaataaagttccgctctgagcctgcttacacagatttcatgcgacaatggaatgttggtgtctact

SEQ ID NO: 24299 - protein, 414 aa, Panicum virgatum
  misc_feature: Ceres CLONE 1858033
  misc_feature (1)..(414): Pfam Name: COG2 Pfam Description: COG (conserved oligomeric Golgi) complex component, COG2
MADLAVASPPPAHAPAPATDLFGEPIEAHPPWFKPDSFLRADFDPDAYVAELRSYVPLESLAAELRAHLAALRAELVGLINRDYADFVGLSARLKGVDAAAARMRAPLADLRDKVAGFRAGAAAALAALRAGLEQRAAATAARELLELLLDTSHVVSKVEKLIKELPSAPSDSSNAEVQSIDTQNVEAGTGVRETQSILLERIASEMNRLKFYISHAQNLPFIENMEKRVQGATKLLDGSLECCFVDGLEHRDAKVIYNCLRAYAAIDNTSSAEELFRATVVSPLIQKIVPQNYAKAVAGASSDGLEDDYEQIKQCIEKDCKFILEISSSANSGLHVFDFLGNSILKEVLSAIQKGKPGAFSPGKPKEFLKNYKATLGFLDFLEGYCQSKSAVIKFRSEPAYTDFMRQWNVGVY

SEQ ID NO: 24300 - DNA, 1402 bp, Panicum virgatum
  misc_feature: Ceres CLONE 1858050
  misc_feature: Encodes the peptide sequence at SEQ ID NO. 24301
atcccaaactctaacaagatttcgcctttcctcctctcatcttctccccaaatccaattcctctctatcgccgtgccccccgtcgcaaatttggcttcttgggtttgattccttcgacctgctgcgttctttccccctcctatttcccgctgcttctgagttctagactctggaagagttgaggaactcgctcctgttcaacgcctgtcgaccaattccgatagctcgcgctgcaagattcggtttttgagccggtgcgcggaggtccgggtctggattgcgtagcccgccgggaggttctgccgttctggcatcggtgacctaagtattggtgggcattctggtggagcgatggagcaggggaagaatcagcagcacccgcagcagcagcagcagccgaagcctgttgttttagtcgccgcgggcgagatgaaggcacccgcggtggctccgcagcagcccaagctggcggtccccgtggtgccggtgtctaggcagtggccgatggccttcaacccgccttccactgaagcgaaaagtgtcactccaaagaaaaagaagcattgtaattgtagaaactcaaaatgtttaaagatgtactgtgaatgcttccaagaacaacagttctgtgatggctgcaactgttcaaattgtggaaacattgttgggaacgagaaagccagacaggaagctattaacgcaattgttcaacgtaacccacttgcttttcagcctaaaattgaaaatggcccaagtacacacaatgttcgaaaggataattctggagcagtgcctcttgtaccaaagcacaataaaggttgccactgcaagaagtcagggtgcctaaagaagtactgtgaatgctaccaagcaaatgttctttgctccaagaattgtaggtgcatggactgtaagaactttgaaggaagtgaagaacgaaaagctttaattcaaggggactatgcatctgatggaaatcatattcaacaagcagctagtgtagcacttaatggtaccattggatcatcaggatacaattgttctccggtgcgtagaaaaagatctcatgaagatgccctaggtcctaggataaacagtgaaggaagtatgccagagacacaatttctgcaggataaccatgcagatgtttcattgcttgcaccctcttccacaggatttgatgggcataacgctgccaattcccaatctaaatcatataacccaatctacaggtctccacttgcaaacaccatccaccttagtgaggtcaatgacctagtcacacaattggtgactgtgtgcagaatggctgcagcgacaacagctgataataaagtgaatgggactacagcgggagatcaattccatgtgaatggtggtttatgcaatggtaactgcaaac

SEQ ID NO: 24301 - protein, 350 aa, Panicum virgatum
  misc_feature: Ceres CLONE 1858050
  misc_feature (152)..(193): Pfam Name: CXC Pfam Description: Tesmin/TSO1-like CXC domain
  misc_feature (67)..(107): Pfam Name: CXC Pfam Description: Tesmin/TSO1-like CXC domain
MEQGKNQQHPQQQQQPKPVVLVAAGEMKAPAVAPQQPKLAVPVVPVSRQWPMAFNPPSTEAKSVTPKKKKHCNCRNSKCLKMYCECFQEQQFCDGCNCSNCGNIVGNEKARQEAINAIVQRNPLAFQPKIENGPSTHNVRKDNSGAVPLVPKHNKGCHCKKSGCLKKYCECYQANVLCSKNCRCMDCKNFEGSEERKALIQGDYASDGNHIQQAASVALNGTIGSSGYNCSPVRRKRSHEDALGPRINSEGSMPETQFLQDNHADVSLLAPSSTGFDGHNAANSQSKSYNPIYRSPLANTIHLSEVNDLVTQLVTVCRMAAATTADNKVNGTTAGDQFHVNGGLCNGNCK

SEQ ID NO: 24302 - DNA, 1241 bp, Panicum virgatum
  misc_feature: Ceres CLONE 1858064
  misc_feature: Encodes the peptide sequence at SEQ ID NO. 24303
atcgagcactccacgccgctctagtactcccctcccaccctccctctctctcctcgggcaagaaaaagccggaaatccctgcgcaaacccgccggctcctccaccgccgaagctcctgggtcctcctcgccgccgctccgcaagagatcagcccgccgccgccgattggtgatgtagagtgctcttccgaactccaatggtttcctcccacagtgcaagatgtggaaatgttcacaatgctcttatagctgagtttcctgacaagtaatgaagtaattgcagagctcatctaggacatcatctgggatttcttggttctttctggagtgagtacttgtttgtttgaagatcttcttcattcaagatgatgcagaggccgctgttccgtcccgaggagtactccttgaaggagaccagacctcaccttggaggccatgctgccggtgacaagctcaccagcacctatgacctggttgagcagatgcagtacctctatgtccgagtggtgaaagcaaaggaacttccaaacatggacatcactgggggctgtgacccatatgttgaggtgaagctagggaattataagggcacaactaggtttttcgagaagaacaacaacccagagtggaatcaggtttttgccttttcaaaggagcgcattcagtcatcagttgtggagattgtggtcaaggacaaggatcttgttaaggatgacttcattgggcgcgttgtatttgacctgaatgaggtcccaaagagagtgccacctgatagcccattggctccacagtggtatcgcttggaagaccgacacgggcacaaggtgaagggggagttgatgttggctgtttggatgggtactcaagcagatgaagcattccctgaagcgtggcattctgatgctgcctctgtccctggagatgggcttgcaagtattagatcaaaggtgtatctcactccaaagctttggtatctgcgtgtcaatgtcattgaagcccaggatctcataccaaatgataagaccaggttccctgaggtttatgtcaaagccatgctaggcaaccaagttcttagaaccagggtatcagcaagccgcactctgaacccaatgtggaatgaggatttgatgtttgttgctgctgagccattcgaggagcacctgatgttgagcgtagaggacagggtggcccctgggaaggatgaagtaattggaaggacaaccatttctctgcagcatgtac

SEQ ID NO: 24303 - protein, 292 aa, Panicum virgatum
  misc_feature: Ceres CLONE 1858064
  misc_feature (43)..(123): Pfam Name: C2 Pfam Description: C2 domain
  misc_feature (204)..(286): Pfam Name: C2 Pfam Description: C2 domain
MMQRPLFRPEEYSLKETRPHLGGHAAGDKLTSTYDLVEQMQYLYVRVVKAKELPNMDITGGCDPYVEVKLGNYKGTTRFFEKNNNPEWNQVFAFSKERIQSSVVEIVVKDKDLVKDDFIGRVVFDLNEVPKRVPPDSPLAPQWYRLEDRHGHKVKGELMLAVWMGTQADEAFPEAWHSDAASVPGDGLASIRSKVYLTPKLWYLRVNVIEAQDLIPNDKTRFPEVYVKAMLGNQVLRTRVSASRTLNPMWNEDLMFVAAEPFEEHLMLSVEDRVAPGKDEVIGRTTISLQHV

SEQ ID NO: 24304 - DNA, 615 bp, Panicum virgatum
  misc_feature: Ceres CLONE 1858067
  misc_feature: Encodes the peptide sequence at SEQ ID NO. 24305
gtcgtcagggatggcggcgaccgcgctgctggcgggctcgccgtggctgcgcctccgcctccgcctccgcccggacgcgcccgcgcgccgccccttcgcccgccacatccacctccgccgggccctctcctcccgcgcccgcgcctccgcctccgcctccgaccccgtccgcgtccgcttcgcgccctcgcccacgggcaacctccacgtcggcggcgcccgcaccgcgctcttcaactacctcttcgcgcgctccaacggcggccgcttcgtgctccgcgtcgaggacaccgacctcgagcgctccaccaggaggtccgaggaggccgtcctcgccgacctcgcgtggctcggcctccagtgggacgaaggtccggatgttggcggggagtttgggccctatcgccagtcagagcggaattcactgtacaaggagtacgccgagaagcttttagactccggcgcagtttaccgctgcttttgctccaacgaggaacttgagcaaatgaaggaattcgcaaagcagaggcaacttcctcctgtgtacatgggcaagtgggcaaccgcttcagacgttgaagtggagcaggagctagagaaagggacaccttacac

SEQ ID NO: 24305 - protein, 201 aa, Panicum virgatum
  misc_feature: Ceres CLONE 1858067
  misc_feature (52)..(197): Pfam Name: tRNA-synt_1c Pfam Description: tRNA synthetases class I (E and Q), catalytic domain
  misc_feature: SWISSPROT Homolog: EC 6.1.1.17 Glutamate--tRNA ligase
MAATALLAGSPWLRLRLRLRPDAPARRPFARHIHLRRALSSRARASASASDPVRVRFAPSPTGNLHVGGARTALFNYLFARSNGGRFVLRVEDTDLERSTRRSEEAVLADLAWLGLQWDEGPDVGGEFGPYRQSERNSLYKEYAEKLLDSGAVYRCFCSNEELEQMKEFAKQRQLPPVYMGKWATASDVEVEQELEKGTPY

SEQ ID NO: 24306 - DNA, 1301 bp, Panicum virgatum
  misc_feature: Ceres CLONE 1858084
  misc_feature: Encodes the peptide sequence at SEQ ID NO. 24307
atccacccccgtgcggtcaccgactcccggcttcacctccccaccaccccacctcgcccctgcccgcctcccccttcctccatccatccgggccgcctccttccccgctccgcaggccccaggtccggccctgtgcgcgcggcgctgctccctgtgccagatctgcatcagccgccgccggcgcccagcgacctcgcccccctcacctctcgccgccatcgccacgaaatggcggatgtgtgcttctctacgcagctcattgatggagatggggtcttcaatgtcacaggattggagaacttcatgaaggaagttagattgggcgaatgcgggctctcatatgctgttgtatcaataatgggcccgcaaagtagtgggaaaagtacgcttttgaatcatctttttcgcaccaattttagggagatggatgctttcaaaggaaggtcacagactaccaaaggtatatggttggcaaaggcccaaaacattgaaccatgcacccttgtaatggacttggaaggaactgatggaagagagaggggagaggatgacacagcctttgagaaacaaagtgctctgtttgctttggctgtttcggacattgtattgatcaatatgtggtgtcatgacattggcagagaacaggctgcaaacaagccacttttgaagacagttttccaggtcatgatgaggttgtttagtcctcgcaaaacgacactgttatttgttattcgtgacaaatcacggacacccctagaaaatcttgaaccaattttaagggaagacattcagaagatatgggatgctgttcctaaaccccatgcccacaaagaaactcctcttagtgaatttttcaatgtacaagttgtggggctatccagttatgaagaaaaagaggagttattcaaagaacaggtttctgatttaagagataggtttcagcattctattgctcctggtggacttgctggagatcggcgtggtgttgtcccagcttcaggtttttcatttagttcacagcaattttggaaagtcattaaggagaacaaagaccttgacctgcctgctcataaagttatggtggctactgtacgttgcgaggaaattggtaatgagaaagttgccagttttactgccgatgaggaatggcaacaattagaggaggctgttcaacatgactactgtcctggttttgggaagaagattagcagccttcttgatagatgtttatcagagtatgacatggaggctatttattttgatgaaggtgtcagaagctcgaaaagacaacaacttgagtc

SEQ ID NO: 24307 - protein, 357 aa, Panicum virgatum
  misc_feature: Ceres CLONE 1858084
  misc_feature (44)..(357): Pfam Name: RHD3 Pfam Description: Root hair defective 3 GTP-binding protein (RHD3)
MADVCFSTQLIDGDGVFNVTGLENFMKEVRLGECGLSYAVVSIMGPQSSGKSTLLNHLFRTNFREMDAFKGRSQTTKGIWLAKAQNIEPCTLVMDLEGTDGRERGEDDTAFEKQSALFALAVSDIVLINMWCHDIGREQAANKPLLKTVFQVMMRLFSPRKTTLLFVIRDKSRTPLENLEPILREDIQKIWDAVPKPHAHKETPLSEFFNVQVVGLSSYEEKEELFKEQVSDLRDRFQHSIAPGGLAGDRRGVVPASGFSFSSQQFWKVIKENKDLDLPAHKVMVATVRCEEIGNEKVASFTADEEWQQLEEAVQHDYCPGFGKKISSLLDRCLSEYDMEAIYFDEGVRSSKRQQLE

SEQ ID NO: 24308 - DNA, 1327 bp, Panicum virgatum
  misc_feature: Ceres CLONE 1858113
  misc_feature: Encodes the peptide sequence at SEQ ID NO. 24309
  misc_feature (1225)..(1225): n is a, c, t, g, unknown, or other
gcgcagctcgcctcgcctccgcttcgacctcctctccctcgcccgcccccgtctcatctcctctcacctagggcacgcgcgccgcctcgccgccgccgcagccgatccggccgccgtcgatccccgccgctccgatcgcccgagttgaatagtctgcttggttgttgggaatctacttttacagttgtctccaagcatggaaaacctaccaaatggctcagcaaatgctgctgagcataaccaggaaaacgagaagtccatggatgctagtgagcctgaaggagttccagatgtttttgtttacagagaagatgttgtcagcttgaagtccaaggaggatgcccgtggattagtgttggaggttgctggggaatatgattctgaaggtagcatcactgacgatgatgatgcacatactgaggagcgtgaacataaggctactcgtggggctgaaaacagtggtgctgatggtgataatgccagtaatggagctgaagttgacagccagagttctttgcctgataacaaagttcgcgtgttatggatagatggtagtgaaaagacagaagatattgacgatgtagttgtagttgacagaagtttccttcatggagacttagttgcttctgcttcggacccaactggtcagatggggcttgttgtggatgtcaatcttgtggttgatgtacaagctcccaatggaagtctgataaagggtgtatcctcaaaggatttgagacgaatcagggaattcaatgtgggtgattatgttgtctctggtccatggcttggtcgagttgatgaagtgctagataatgttaatgtgttgtttgacgatggctctgtctgtaaggtgaacaaggcagatcctatgcgcctaaagccagtgtcaagcccaattcacccggatacagcttgccccttctatccaggacagcgtgtgaaggcagtgtcatcatctgttttcaaagcatcaaggtggcttaatggattgtggaaagcaagtcgtcttgaaggtacggttacaaaagtggagagtgttgctgttatagtctactggattgcatctgcacactttgcagaacagcaatctgttcctccggaggagcagaacccaaaagacctgactcttttgtcttgtttctcatacgcaaactggcaattaactgaatggtgccttccctactaccgacacacttcatgtactgatggtgctatagctganaactcagagacaaaagagttaaactcggatgagcatacaggaaacaagtgtacatgctcagaaatctcagctctactatctgatattcctgaatctcaagct

SEQ ID NO: 24309 - protein, 376 aa, Panicum virgatum
  misc_feature: Ceres CLONE 1858113
  misc_feature: SWISSPROT Homolog: EC 6.3.2.19 Ubiquitin--protein ligase
  misc_feature (343)..(343): Xaa is any aa, unknown, or other
MENLPNGSANAAEHNQENEKSMDASEPEGVPDVFVYREDVVSLKSKEDARGLVLEVAGEYDSEGSITDDDDAHTEEREHKATRGAENSGADGDNASNGAEVDSQSSLPDNKVRVLWIDGSEKTEDIDDVVVVDRSFLHGDLVASASDPTGQMGLVVDVNLVVDVQAPNGSLIKGVSSKDLRRIREFNVGDYVVSGPWLGRVDEVLDNVNVLFDDGSVCKVNKADPMRLKPVSSPIHPDTACPFYPGQRVKAVSSSVFKASRWLNGLWKASRLEGTVTKVESVAVIVYWIASAHFAEQQSVPPEEQNPKDLTLLSCFSYANWQLTEWCLPYYRHTSCTDGAIAXNSETKELNSDEHTGNKCTCSEISALLSDIPESQ

SEQ ID NO: 24310 - DNA, 668 bp, Panicum virgatum
  misc_feature: Ceres CLONE 1858138-R
  misc_feature: Encodes the peptide sequence at SEQ ID NO. 24311
gggtatgaatgggattacagatggatgacatacccgtcagaagcccgatatttgaagcatccatatgatcagtcactagccacattcagaggccattctgtgttgcgcacacttattcgttgttatttttccccaatgcacagcacgggtcagaggtacatatacacaggatccagtgaccaatgtgtctatatttatgatgtggcgacaggtaaggttgttgaaaaactgagatggcacgggtcgatcatcagagactgctcatggcacccgtacctccccacacttgtcagctcttcttgggacggctatttggtccggtgggaggcaacagaggatggcagagacccctccatgctcaagacatggaagcagaggatgcatccagaaggatacacagtgtcgtttgtcctttagaagtgaagctctcaagggtctcatgtgggcatgtggctccacttggtcaccttgcaggcttcccaagcctctggctcgaaaaagtccttttactatttaaaatttcgtgctgtatataagtgatcgagagtgaattgttgaggcggttcgcaggtcgagtgaattgttgaggcggtacatagactcgcaaaattgtaatgcaaaagtttatctatctatactatatcttatcttatatactataaatgttg

SEQ ID NO: 24311 - protein, 138 aa, Panicum virgatum
  misc_feature: Ceres CLONE 1858138-R
  misc_feature (71)..(109): Pfam Name: WD40 Pfam Description: WD domain, G-beta repeat
GYEWDYRWMTYPSEARYLKHPYDQSLATFRGHSVLRTLIRCYFSPMHSTGQRYIYTGSSDQCVYIYDVATGKVVEKLRWHGSIIRDCSWHPYLPTLVSSSWDGYLVRWEATEDGRDPSMLKTWKQRMHPEGYTVSFVL

SEQ ID NO: 24312 - DNA, 1451 bp, Panicum virgatum
  misc_feature: Ceres CLONE 1858138
gactcgacattgacgcctccgccgagctttcgtaaccacttcctcctcgtcctcctctgctcttgttcatcgtcgtcgttcttactattccccaccccttgcctcgcggcgcggttgtggggttcgattttgggaagggaaggaaacggggcgggcgcgggagtcagttctcttccagcgacgttttcatcgcggttaattaaggggatgactggcagtagaagggtccaagcctcaggctatcaattgtactgtcctggttggaattgcctggacagctggattgcaagtctgtgtccacgttaaagtcttcttgtggaggataccatactgctatatcgaccgaattgttccttgaagcttaggtaatataaggcaatgggatgttcaatggttattctgagaaatgaccaatggtttactaactagtgttcattaattgagtggccaaacatgcggtggaaacgaaagatacatcatggaggaccatctgaacaacaacaggtcagtccacttgtggatgaagtatgtgccattgacgaggaggtttcccatctttgtagaattaaatctgaaccaagtcagagaactcgtgcatccatttatgctggccagaagaggcctgtctcaacattcaagttattatcagggagagaatcaaattgctcggggatgggcagattctcttcagctgattgctcttatgctcttcggaaacacctaccactgaaaggcccatggtgtgtggatgacatggatagtgaagcttacatctcacagttctctgcagatggttcacttctaattggtgggttccggggaagccacatcagagtctacaactctgaaaaaaattggaaggttcataaagatataacctgcaaacgtctgcgctggacaatttcagatattgccctctcacctgatcaacgattcctggcttattccagtttgtcgcctactgttcacatagtaaatgtccagaatgctgtaagggaatcacatgctaacattacagaaattcatgagggtctggagttttctgacgatgatgacgaattctcctttgggatattctctgtaaaattttcaaaagatgggcgagaacttgttgtaggaaacaacaatgaatcaatatgtatttatgatcttggagcaaacaaagtaacagaacgcattaatgcacatgtggctgatgtcaatgtggtcaccttcgctgatgaaacaagtgatgtcttgtactctggaagtgatgatagcctttgtaaggtttgggataggcgctgccacaagaaacaaaagccagtaggtgttctgaccggtcatttagatgggattacatttatcgatagccgtggagatgggcactattttatctcaaactgcaaggatcagactattaaattatgggatctcaggaaaatgtcttccactacaaaagactgcacacc

SEQ ID NO: 24313 - DNA, 2031 bp, Panicum virgatum
  misc_feature: Ceres CLONE 1858143
  misc_feature: Encodes the peptide sequence at SEQ ID NO. 24314
gcgacagcttcgttggtttttcttccggttttgcccccgccgagctcagccggggaggcgctgcactccactccgctccacgccagatccagcctcacaaggtcgactccatggccgtccgcttcctcctcgccgtcgccctcgcgctcctccgcccgggggaggcgtccgtgcacgagtaccgcggcctcggcttcgccaacaagggcaacgccttcatcctccacgccggcagcgagggcctctacgcggcctcccccaccaacgccaccgccgaggacgatgaggacgccgccgcagtggccgacgccttcatccggtttgacaagattacttttaggagaccagaggatgctgttgattctgtaaaggagaccagttcagctaaggttcaggtacttgttttcgagatagaagaccgtgaaatgattggtggatcagcttatggaggtcagaaagctatttgctgtacctcagatcttgcaaagttaggagcttgcacggaaggttctgtcatctaccgcccatcccaggtaaatcctggttggccaaaattgtttgttgcatcatttgatggaagtgatctgattgcaacgctactgtcaaggaccattccaataaccaaaactgggatgtacaatatgtactttatacactgtgatccttcacttgctggtttggagattgaggggaaaaccatttggaaaaatcctactgggtaccttccaggtcggatggcacctcttaagaacttttttggactgatgtcttttgcttttgttatacttgggatctattggttctatcagtacatgaagtcttggagagaggttcttccacttcaaaactgtattactctcgtgattacactgggcatgctggagatggcattgtggtattttgagtatgctgagttcaatgagactggaattcggccaaagggcatcacattttgggctgtcacgtttggaactattaagagaacagcggctgaagttattgttctcattgtctcaatgggatatggagttgtcacgcctactttgggtggcctgacatccaaagtggtcatgcttgggggaacattctttctagcaacagaaactcttgagttggtagaaaatctcggtgccgtgaatgatctatcaggaaaagctcggcttttcttggtttatccagtggccattttagatgccgcatttgttgtttggatattcatttctctagctaagaccattggtaaacttcaggcaagaaggctgatggccaaacttgagatttataggaaattcgcaattgccctgattgtatctgttctggtgtctgttggctggattggctatgagatttacttcaaatcaacagatgttttcaatgagcgatggcaatacgcatggattattcctgccttctggcatgttttgtctttctcacttctttgcgtaatttgctacctgtgggcaccttcgcagaactcaatgagattcgcttatgatgcaagcgaattcttcgaccggaaggacaatctatcattaattaggccagcgcccagtgcttccaaaaatggatggagtttatcttcaacaccagatgacaaagcaacaaagaatgtgaataccgaaacatcttttgatggggatgatgaggaaaacaaaagggagtagaacttattgtcaattcaattaggggagggaatatgcaaagatatgtgatccattgaagtggacaatagagcaattttggtgttttgctgaggattggccttgctaattctagttaatgaagtacttcacttgaggttatttctttacctgattcatttccactatagcttattgccttattgcacggccagtcatgctattatcatcatagtctgaatgatggtacatgataggaacaattagtctgtggcattatgaagggtttatgctgtgtaatgtttatattatagacatcatattgctggttgcatgaactcggcctatgccatctatgttagagaataaactattttactggatctttgtt

SEQ ID NO: 24314 - protein, 517 aa, Panicum virgatum
  misc_feature: Ceres CLONE 1858143
  misc_feature (170)..(457): Pfam Name: Lung_7-TM_R Pfam Description: Lung seven transmembrane receptor
MAVRFLLAVALALLRPGEASVHEYRGLGFANKGNAFILHAGSEGLYAASPTNATAEDDEDAAAVADAFIRFDKITFRRPEDAVDSVKETSSAKVQVLVFEIEDREMIGGSAYGGQKAICCTSDLAKLGACTEGSVIYRPSQVNPGWPKLFVASFDGSDLIATLLSRTIPITKTGMYNMYFIHCDPSLAGLEIEGKTIWKNPTGYLPGRMAPLKNFFGLMSFAFVILGIYWFYQYMKSWREVLPLQNCITLVITLGMLEMALWYFEYAEFNETGIRPKGITFWAVTFGTIKRTAAEVIVLIVSMGYGVVTPTLGGLTSKVVMLGGTFFLATETLELVENLGAVNDLSGKARLFLVYPVAILDAAFVVWIFISLAKTIGKLQARRLMAKLEIYRKFAIALIVSVLVSVGWIGYEIYFKSTDVFNERWQYAWIIPAFWHVLSFSLLCVICYLWAPSQNSMRFAYDASEFFDRKDNLSLIRPAPSASKNGWSLSSTPDDKATKNVNTETSFDGDDEENKRE

SEQ ID NO: 24315 - DNA, 689 bp, Panicum virgatum
  misc_feature: Ceres CLONE 1858152
  misc_feature: Encodes the peptide sequence at SEQ ID NO. 24316
gtcgcccgcaccgccatggcgcgggcgcacgcggcggccgggcaggcggccctggcgcttgccgtgtttcgggacatgctcacggacagcctgctccccgacaacgtggcactggcggtcgcactcgcagcgtgccacggggtgggctcgtcctccgtggcagcccggaagcctgggaagatggttcatgctctcatcgtgacaagcggcattgtgccggatgtgttcgtctccacagaattgatcagggtctacggggagtgcggcgagctgtctgtttcgcagagggtgttcgatgacatgcccgtgaggagtactgtttcgtggaacgccatggtgcatcagtatgtcaggcatagtaatgttggcgctgcatacgagctgtttcttgcaatgccaaggagggatgtggtgtcatggaatacaatgattgccgggtattgcctcattggccaatgtagggaggcactagaattgtttcgtcagatgatattgccatcttcacgtccggtgcatccaaatggacctacaatgagcactgtccttgctgcttgcgccggtgcaggctgtttggagactgggatttgggtccatgcctacattgacaggaaccgaatgaattatgacggctcattggaccggtccttgatagacatgtacgccaaatgtggaagcattgaaaaggctct

SEQ ID NO: 24316 - protein, 224 aa, Panicum virgatum
  misc_feature: Ceres CLONE 1858152
  misc_feature (133)..(167): Pfam Name: PPR Pfam Description: PPR repeat
MARAHAAAGQAALALAVFRDMLTDSLLPDNVALAVALAACHGVGSSSVAARKPGKMVHALIVTSGIVPDVFVSTELIRVYGECGELSVSQRVFDDMPVRSTVSWNAMVHQYVRHSNVGAAYELFLAMPRRDVVSWNTMIAGYCLIGQCREALELFRQMILPSSRPVHPNGPTMSTVLAACAGAGCLETGIWVHAYIDRNRMNYDGSLDRSLIDMYAKCGSIEKA

SEQ ID NO: 24317 - DNA, 648 bp, Panicum virgatum
  misc_feature: Ceres CLONE 1858161
  misc_feature: Encodes the peptide sequence at SEQ ID NO. 24318
gcaaagccgagtgcgagaacccacgaaactaaccaagagctccgccccattaaggcaggcaggcaggctcgcagcagcactccatcgtcgttgtcctctccctgtaatgtcactcccccgaagcttgcccgcagctcaatggccatgaggacgacggccgcgcccacctcccgtgccctcgtcggcctcctcctcctcgccgtcgccgtcgccgacgacggttcgacgctgctggagatcaagaagtccttccgcaatgtcggcaacgtactgtacgattggtccggcgacgactactgctcctggcgcggcgttctgtgcgacaacgtcaccttcgccgtcgctgctctcaacctctctggactcaaccttgggggcgagatctccccagccgttggcagcctcaagagcctcgtctcgatcgatctgaagtcaaatgggctgtccgggcagatccctgatgagattggtgaatgttcatcacttaagacgctggacttctctttcaataacttggatggggacataccattttcgatatcaaagttgaaactccttgagaacttgatattgaagaacaatcagctgattggtgcaattccatcaacactgtcacagctcccgaatttgaagatcttggacttggct

SEQ ID NO: 24318 - protein, 167 aa, Panicum virgatum
  misc_feature: Ceres CLONE 1858161
  misc_feature (22)..(60): Pfam Name: LRRNT_2 Pfam Description: Leucine rich repeat N-terminal domain
  misc_feature: SWISSPROT Homolog: EC 2.7.11.1 Non-specific serine/threonine protein kinase
MRTTAAPTSRALVGLLLLAVAVADDGSTLLEIKKSFRNVGNVLYDWSGDDYCSWRGVLCDNVTFAVAALNLSGLNLGGEISPAVGSLKSLVSIDLKSNGLSGQIPDEIGECSSLKTLDFSFNNLDGDIPFSISKLKLLENLILKNNQLIGAIPSTLSQLPNLKILDL

SEQ ID NO: 24319 - DNA, 1651 bp, Panicum virgatum
  misc_feature: Ceres CLONE 1858163
  misc_feature: Encodes the peptide sequence at SEQ ID NO. 24320
aatcggctttgttttccagctcgttgcccgcggctcaggcgagtgcgggagcagagcagcaatggcggggcggcggcggctgtggaccctggtgctcgtgagcgtggcggcgctgctggagcgcgcggacgaggcgctgctgccggcggtgtacagggaggtgggagcggcgctgggcgcgtcgcccaccgctctgggctacctcacgatgtgccgcgcgctcgtgcagaccttgtgctacccgctcgcgacgtgggccgcggcgcgctacgaccgcgcgcgcgtcgttgccgcgggggccttcctctgggccgccgccaccttgctcgtcggcgcatcgggctccttcctacagatggcgctggcgaggggctccaacggcgtcgggctggcggtcgcggtgccggcgatctattccctggtggccgactgcaccgacgacaccacgcgcggctgggcgttcgggtgggtggtgatggcgcagagcctaggcttcatcgccgggagctccatcgccttgctgctcgcgcccacaagcttactcggcgtctctggctggcggctcgcgttcttcgcggtcgcgctcatcagccttctcatcggcgccctggtgtggctgtttgccgccgacccccgccccgtcgtcgccaaggacgaagcggccccagcggcgacgcttgccgacctcgtccgagaagccagggacgtgctgagggtgccgacgtttcagctcatcgtggcgatgggcgtggtcgggtcgttgccgttcgcggccttcagcttcatcaccatgtggctggagctcatcgggttctcgcacgggcagaccagcctgatcatcagccttgccagcatcgctaactttctcggcatcctgttcgcggggttcctcggggatgccgtggcgcggcgattccccagcaccggacgggtcgcggtggcgcaggcggtcaacgcggtgtcggtcccgctggcagccgccctgctgctcgcgttccccggcgacccctcggcggcggtcccgtacgccgccgtgtgcttcgccttcggcttcaccatttcctggaccccggtgtccaccaccaatcctatcttcgcagagatcgtgccggagaaggcgaggacgatggtgtacgcgctggacaagtgcttcgagtcggtgctgggatcgttcgggtcgcccctggtgggcatcctggcggagcgcgtgttcgggtaccagccgggcacgcccggcaagagcgcggaggccgaccgcaagaacgccgacgcgctgagcagggccatcttctcggagatcgccggacctttcatcatctgctgcctcacgtacaccgcgatgtactggacctaccccgccgacagacggcgggcccagatggcggctttgcaggcggcgtcggaggatcaggacgacgactgcgaagcaagtgtggttgcgcatgctgcagcagctgatggcttggaccaggctctactactacccgggacaagtagcaaatcatgaagaagaggctctctacttgcctggctataactaatgggcagattcggcctagcatggaaggatttcaaatacttgtactgtactagctaaatgcctgtgccttgcaatgggcattttaattttactagaacatatagttggttc

SEQ ID NO: 24320 - protein, 481 aa, Panicum virgatum
  misc_feature: Ceres CLONE 1858163
  misc_feature (13)..(373): Pfam Name: MFS_1 Pfam Description: Major Facilitator Superfamily
MAGRRRLWTLVLVSVAALLERADEALLPAVYREVGAALGASPTALGYLTMCRALVQTLCYPLATWAAARYDRARVVAAGAFLWAAATLLVGASGSFLQMALARGSNGVGLAVAVPAIYSLVADCTDDTTRGWAFGWVVMAQSLGFIAGSSIALLLAPTSLLGVSGWRLAFFAVALISLLIGALVWLFAADPRPVVAKDEAAPAATLADLVREARDVLRVPTFQLIVAMGVVGSLPFAAFSFITMWLELIGFSHGQTSLIISLASIANFLGILFAGFLGDAVARRFPSTGRVAVAQAVNAVSVPLAAALLLAFPGDPSAAVPYAAVCFAFGFTISWTPVSTTNPIFAEIVPEKARTMVYALDKCFESVLGSFGSPLVGILAERVFGYQPGTPGKSAEADRKNADALSRAIFSEIAGPFIICCLTYTAMYWTYPADRRRAQMAALQAASEDQDDDCEASVVAHAAAADGLDQALLLPGTSSKS

SEQ ID NO: 24321 - DNA, 445 bp, Panicum virgatum
  misc_feature: Ceres CLONE 1858170
  misc_feature: Encodes the peptide sequence at SEQ ID NO. 24322
actatttatgccccaaaatgacgcgacaccccatgggtgtcttgatcttggttcacatccttcttcccctgactgctcgtgctgcatgctctaccgagagtacacttccctccaggttttgtccttcgccccgcttcttcaccttatcactatgaaggcgctgccaacgagggtcaacgtgcacctaccttatgggatactctcactacaccacctgaaccggtgatacatttcaccaatgcagatgtcgctgttccccaccccccccgttaccacgaacatgtggattttctgaaggacattgcaatggatcacgcaccggttctctctctcactgcctccctcatctttcccaatggaactggcgacctcatcgaccaccgcctcaactactacgcctaccccttccatgctctgttatacaaaggcatacacccgtatgtaa

SEQ ID NO: 24322 - protein, 46 aa, Panicum virgatum
  misc_feature: Ceres CLONE 1858170
  misc_feature: Useful for making plants with altered cell wall content and/or composition
MDHAPVLSLTASLIFPNGTGDLIDHRLNYYAYPFHALLYKGIHPYV

SEQ ID NO: 24323 - DNA, 1925 bp, Panicum virgatum
  misc_feature: Ceres CLONE 1858172
  misc_feature: Encodes the peptide sequence at SEQ ID NO. 24324
gttttcgaaccgtcgtacgttgtgctaactgctagcgacaagacaagacaaggcgccgcgctccgagcagagcagcgaagccaaaccaacctcgctcgctgccgcgttgcaggcgaaccactccactaccactaccgcccggcgccgtgctgagcatctgcagctgcaagggcagaacaccgggcccagggtacggtgccggagggaggcgggggagagagagagaggtggggaatggcgggtggcggcggggaatcggagtcgacggcgctggagttcacgccgacgtggatcgtggcgggggtctgctccctcatcgtcgtcgtctccctcgccgccgagaggtgcctgcattacctcggcaagacgttcaaggggaagaaccagaaggcgctcttcgaggccctcctcaaggtcaaagaagaactgatgcttctggggttcatctccctgctcctgacggtgtcccaagggatgatccagaggacctgcattcctccagagtggaccatctacatgctcccatgccataacgctaaggaacaggcagagctgagcccctcggaggctcatggtcttgctgctggaattttaggcctcacccgtcggcgtctgcttaccgagggtgggacaacgatccagcattgccaaaagaagggagaagttcctttgctgtcagttgaagcactacatcagttgcatatcttcattttcattctggccattgcacatgtgattttctgtgttttgactatgcttttaggaaccgcgaggattcgtcaatggaaacactgggaggatgaatttcagaaggattctacagaaaatgggcaaaggaaggtgacctatgtgcatcagtgtgaatttatcagggaacatttcaagggtattggcagagattcggcaatattgagctggctgcattcttttgctaagcagttttatggatcagttactaaatcagattacactacaatgcgacttggcttcatcatgacacattgccaggcaaacccaaaatttgatttccacagatacatgttacgagctttggaggctgattttaagaaggtggttggcattagctggtacttgtggatattcgttgtggtattcatgttgctgaatgtcaatggttggcatacttacttttggatctctttcattccccttcttcttctgctggccgttggcaccaagctagagcatgtcataactcagctggcaattgaggttgccgagaagcactccgcaatcgagggcgacttggtcgtcaatccgtcagatgaacacttctggtttggacggccaaaaatcatcttgtacctgatccacttcatccttttccagaacgcgtttgagattgccttcttcttctggattctcaccacctacggtttcaactcctgcatcatggaccacgtcccattcatcgtgccgaggctcgttgtcggggccatcatccaactcctctgcagctacagcaccttgcctctgtatgcaattgtcacccagatggggaccttcttcaagaaggagatcttcgacgagcacgtgcagcagagcctcgtgggctgggcgcagaaggccaagaagaggaaagcgctcaggaacagcaacggcggcggcggcgcggccgggtcggcgcatccgtctgcgaggctcgagctgatgaggcgggccgccgctctcgaaggaggcagcaccggcggcaatggcagtgaagtctagtgccatccagcgcccagaaaacttgggagaccgtcagaagatgcaagtgtcctcatgcgcgcggcttacgcgagccgtcagtgtttgttagataactcataactagtgtctgatggccagaacgggtgctctggtatggtgtttgtaggctttggatttatgactcgaggcatgttatgaagtgaagagctttc

SEQ ID NO: 24324 - protein, 498 aa, Panicum virgatum
  misc_feature: Ceres CLONE 1858172
  misc_feature (8)..(495): Pfam Name: Mlo Pfam Description: Mlo family
  misc_feature: Useful for making plants with modulated biotic stress sensitivity
MAGGGGESESTALEFTPTWIVAGVCSLIVVVSLAAERCLHYLGKTFKGKNQKALFEALLKVKEELMLLGFISLLLTVSQGMIQRTCIPPEWTIYMLPCHNAKEQAELSPSEAHGLAAGILGLTRRRLLTEGGTTIQHCQKKGEVPLLSVEALHQLHIFIFILAIAHVIFCVLTMLLGTARIRQWKHWEDEFQKDSTENGQRKVTYVHQCEFIREHFKGIGRDSAILSWLHSFAKQFYGSVTKSDYTTMRLGFIMTHCQANPKFDFHRYMLRALEADFKKVVGISWYLWIFVVVFMLLNVNGWHTYFWISFIPLLLLLAVGTKLEHVITQLAIEVAEKHSAIEGDLVVNPSDEHFWFGRPKIILYLIHFILFQNAFEIAFFFWILTTYGFNSCIMDHVPFIVPRLVVGAIIQLLCSYSTLPLYAIVTQMGTFFKKEIFDEHVQQSLVGWAQKAKKRKALRNSNGGGGAAGSAHPSARLELMRRAAALEGGSTGGNGSEV

SEQ ID NO: 24325 - DNA, 745 bp, Panicum virgatum
  misc_feature: Ceres CLONE 1858193
  misc_feature: Encodes the peptide sequence at SEQ ID NO. 24326
cgaacgttgttttcggggagctgggcagaaggaaaagaggctcctagctaaagttgtctcgccctgcttcaaaactacagggcgcgcgctacggctttgacctaacggcctccgtttgctggaatcggaatagttgagaacaaagtggcgaacgggtgcgtaacgcgtgggaatctgccgaacagttcgggccaaatcctgaagaaagctcaaaagcgctgtttgatgagcctgcgtagtattaggtagttggtcaggtaaaggctgaccaagccaatgatgcttagctggtcttttcggatgatcagccacactgggactgagacacggcccagactcccacggggggagcagacgggattcgaggtcgacccggcgaagggggtggaggccgccgatctgtacccggacgtcaagtacaccaccgtcgacgagtaccttgacaggttcctctgaggaagacggcgcgcgcgacgtgtgctcgcggcggctgccgcggctcctgtcgtcgcctctgctctgctgctgccgccgtgcgggtcacctgctggtagctggtgacgctgcggctgcgccgctgccacctacatgcgtgatcatagatgtgtctccgatcgtcgaggtcctgatgccaatttccatggcaataagatcagttccctttggtggatcgcgatccagtttttgttgcatttgtgtactgtatgtgctgctactcttgtaatggacggcccggccatttctc

SEQ ID NO: 24326 - protein, 59 aa, Panicum virgatum
  misc_feature: Ceres CLONE 1858193
  misc_feature: SWISSPROT Homolog: EC 1.3.1.45 2'-hydroxyisoflavone reductase
MMLSWSFRMISHTGTETRPRLPRGEQTGFEVDPAKGVEAADLYPDVKYTTVDEYLDRFL

SEQ ID NO: 24327 - DNA, 1444 bp, Panicum virgatum
  misc_feature: Ceres CLONE 1858195
  misc_feature: Encodes the peptide sequence at SEQ ID NO. 24328
gaaacgcaaaacatccacacgctaaggaaggggcccaggaagccaggagaaacggagcagaagcaccggtccacctgttgctcctacctcgccgggcgccgccgccgccgcctcacgagcccccacgagctcccgcccgcaaacctcgccatgagcgcagccgcacctagccgccgcacccgcagccggccgccctcggcctcctcccgcaagtccgaagacccctcggccgccgccgccgccgccgccaacgggaatgggaacgggaaggtcgcctccaagcccgcctctccccaccagctcacaggggagaggacggtgaagaagctgcgtctgtccaaggcgttgacgattccggaagggacgacggtgtcggatgcgtgccggcggatggcggcgaggcgggtcgatgccgtgctgctcaccgacgcccaaggcctcctctcaggaatagtcaccgacaaggacatagctacaagggtgattgctgaggggcttcaggtggagcaaaccatcatgtccaagatcatgacacacaatccaacttatgtgatgtccgacacgcttgcaattgatgcattgcagaagatggttcaagggaaatttagacacctccctgtagtagaaaatggtgaggttattgctatgctggacattgcaagatgcctatatgacgcaatagcaagactggaaaaggctgcagaacaaggaagtgcgatagcagctgctgttgaaggggttgaacgtcaattaggaggcaacttttcagctccttctgctctaattgaaactctaagagagaggatgttcaaaccatctttgtcaaccatcatcacagagaacacaaaggtagcaattgtttcgcctacagatcctgtgtgtgtagcagcacagaaaatgcgagagtttcgagttaattcggtggttgtctctacaggaaacacattgcaggggatatttacctcaaaagatgtacttatgcgtgttgtcgcacaaaatatttcccctgagttgaccctagtagaaaaggtgatgactgctgacccagattgtgccacattagatacaacaattcttgatgcattacatataatgcatgatggcaaatttttgcatattcctgttattgacagagatggacaaattgctgcttgcctggatgtcctacagcttacccatgcaaccattcaattggttgaaggagggaatggaactgtaaatgatgtagcaaactcagtaatgcagaggttctgggactctgctcttgctttggagcctccagatgaggaatttgatagccatagtgaggtatctttactcctgccgtcagaggctggagatggaaagagtaatgtttaccccactgcgattggcaattcatttgcctttaagcttcaagacagaaagggccgtgtgcatagattcacttgtggctctgagagct

SEQ ID NO: 24328 - protein, 431 aa, Panicum virgatum
  misc_feature: Ceres CLONE 1858195
  misc_feature (59)..(177): Pfam Name: CBS Pfam Description: CBS domain pair
  misc_feature (228)..(346): Pfam Name: CBS Pfam Description: CBS domain pair
MSAAAPSRRTRSRPPSASSRKSEDPSAAAAAAANGNGNGKVASKPASPHQLTGERTVKKLRLSKALTIPEGTTVSDACRRMAARRVDAVLLTDAQGLLSGIVTDKDIATRVIAEGLQVEQTIMSKIMTHNPTYVMSDTLAIDALQKMVQGKFRHLPVVENGEVIAMLDIARCLYDAIARLEKAAEQGSAIAAAVEGVERQLGGNFSAPSALIETLRERMFKPSLSTIITENTKVAIVSPTDPVCVAAQKMREFRVNSVVVSTGNTLQGIFTSKDVLMRVVAQNISPELTLVEKVMTADPDCATLDTTILDALHIMHDGKFLHIPVIDRDGQIAACLDVLQLTHATIQLVEGGNGTVNDVANSVMQRFWDSALALEPPDEEFDSHSEVSLLLPSEAGDGKSNVYPTAIGNSFAFKLQDRKGRVHRFTCGSES

SEQ ID NO: 24329 - DNA, 718 bp, Panicum virgatum
  misc_feature: Ceres CLONE 1858195-R
cttgtggctctgagagcctggatgagcttgtctcttctgtaagacaaagataaaatattacagatgaaaaggaaacagtacaactcttggtaagtatgaagatgatgaaggtgaccgagtgctgctgacaacagactccgatctggccggtgctgtgctctttgccaaatcatctggattgaaggtgctgaagttgcacatcgaagacccgggtttgtatactgaagtgacaaaaccatcacaggagatggctccacctcccagcaggagtgggatatcgccagttcatgttggattgatggccagtgcagttgctctcagtgccgtagcagtgatgctttacttgaaacgatctcagctgtgatttccctttttttcccccatttttctgaagagcggggatcggtggcattccaaattagcattgccattagctaatgctcactcggtaccagctaatatcacatccgtggtctgttgaactcacggtccagggtccagacaggtcacgggacaagattgttgcttttggagtaggtgaatttctggcagaagagcctgcctatgctcgttcattctgcacgaacgtgaacagtttcacgactacggtgtaatgtctaagcattacatattcgttgactgttcattcttatgtgtgcttgtctgtatagataaaccgatgaattgagctcgtttcagcagatgacactgctgtttc

SEQ ID NO: 24330 - DNA, 720 bp, Panicum virgatum
  misc_feature: Ceres CLONE 1858207
  misc_feature: Encodes the peptide sequence at SEQ ID NO. 24331
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataagactggtttgctttatcaaaaacacactcgcagctgatccaccgctgaagtaatttgcagatcgagagagaagcgaaaccatggcgtccaaggcgctcctagtgctcgcgctcctgctcgctgct

SEQ ID NO: 24331 - protein, 102 aa, Panicum virgatum; identical to SEQ ID NO: 11990
  misc_feature: Ceres CLONE 1858207
  misc_feature (28)..(102): Pfam Name: Metallothio_2 Pfam Description: Metallothionein

SEQ ID NO: 24332 - DNA, 1419 bp, Panicum virgatum
  misc_feature: Ceres CLONE 1858219
  misc_feature: Encodes the peptide sequence at SEQ ID NO. 24333
ccttcgtcgatggtcgtcttctccgcgacacctcgatcccccgaatccccaattcgacatctcaaaagaaaaaaaatccccaatccgaagccgtacggccatacccagatctccggaaatccccaactccaatcgaccctccttcgtcgcgatcacccctcccaatacgaccccaattacgcccgatgggtttagcagcgttggcataacgaaccggcgcgttcgctagggttagggtttcgagggtttgcgctagggtttgggtgcgcgatggggcggtcccgtggggtgccgaattccggcgacgacgacaccggccacaggtcgaagcggaggagggtatcgtcgagcggggatgcgactgacaccatttctgcggccatgggaggagcaggcgagggagggggcaagaaggcgctttaccattgcaactactgtaataaggacatttccgggaagatacggattaaatgttccaagtgccctgacttcgatctctgcgtcgagtgcttctccgttggcgctgaagtgaccccacaccggagcaaccatccttacagggtcatggacaacctgtctttcccacttatttgcccggattggaatgcagatgaagaaatcctgcttcttgagggaattgaaatgtatggactgggaaactggcttgaagttgcagagcatgttggtaccaagtcagagttacagtgcattgatcattatacaacagcatatatgaactcaccttgttatcccctcccggatatgtctcatgttaatggcaagaacaggaaggaacttcttgctatggctaaagtgcagggtgagagtaaaaaagggacttcgctgttacctggtgaactgacccctaaggctgaatctccattttctccctccagggtcaagctggaagaggcacttggagatggtccagcaggtcgatccccttcgcacatggctggtggtgcaaataaaaaagcttcaaacgctggacagattaaagatggtgctaacgtatcaaaggttgaagatggtcatgttgatagaagtgttggtgggaagaagcccagatattctgcagatgaaggcccttcattgactgaattgagtggatacaattcaaagagacatgagtttgaccctgagtatgataatgacgctgaacaagcgcttgccgagatggaatttaaagaaactgattcggaaactgatcgtgaactgaaactgcgtgtgctgcgtatttacttgtccaggcttgatgaaagaaaaaggagaaaagagttcatattggaaagaaatttattattccctaatcccttggagaaagatcttacaaatgaagacaaggaagtttatcatcgctataaggtatttatgcgttttctttccaaagaggaacatgaagcccttgtcaggagtgtc

SEQ ID NO: 24333 - protein, 382 aa, Panicum virgatum
  misc_feature: Ceres CLONE 1858219
  misc_feature (47)..(92): Pfam Name: ZZ Pfam Description: Zinc finger, ZZ type
  misc_feature (108)..(154): Pfam Name: Myb_DNA-binding Pfam Description: Myb-like DNA-binding domain
  misc_feature: Useful for making plants with modulated cold sensitivity
MGRSRGVPNSGDDDTGHRSKRRRVSSSGDATDTISAAMGGAGEGGGKKALYHCNYCNKDISGKIRIKCSKCPDFDLCVECFSVGAEVTPHRSNHPYRVMDNLSFPLICPDWNADEEILLLEGIEMYGLGNWLEVAEHVGTKSELQCIDHYTTAYMNSPCYPLPDMSHVNGKNRKELLAMAKVQGESKKGTSLLPGELTPKAESPFSPSRVKLEEALGDGPAGRSPSHMAGGANKKASNAGQIKDGANVSKVEDGHVDRSVGGKKPRYSADEGPSLTELSGYNSKRHEFDPEYDNDAEQALAEMEFKETDSETDRELKLRVLRIYLSRLDERKRRKEFILERNLLFPNPLEKDLTNEDKEVYHRYKVFMRFLSKEEHEALVRS

SEQ ID NO: 24334 - DNA, 675 bp, Panicum virgatum
  misc_feature: Ceres CLONE 1858219-R
agattctcctaaaaccacaggacttacaaatgtgaagcaatgggatgactgggatatagttggtcttcctggggcagagctattaagttctagtgaaaagcttctatattgtcagaaccgattgctacccagtcattatctgagaatgcaggaggtgctaatgcaggagatatttaagagtaatggcctcaagaaagaagatgcccgtgtcttatttaaggttgatcctaccaaagtagatactgtttatgatatggtaatgaaaaagctcggcaaccttgaggaggctccaactgtctagcttatgctgttgagcctgcctgatgtgacttgccaacaaatcctttgcaaccatagcttaagtggaggctgtactaaaattgaatcaaccatagttaaaactgaaattcgtgtccattgtctgaagcacaataaggcattcagccaaattgtaaaattatggtgcggccgataatgtgtagtatgagttgccattgcagttctttccgagagggtagttgccattgttgagagtgtacttttgaggatgtgccagtgccttgttgtaggtatagggcctgagtttatgtatcatcatgtatgtaacattacctgccctatttcatgccattgtaccaatcagacattgattattacaattccatcttgcagcgt

SEQ ID NO: 24335 - DNA, 656 bp, Panicum virgatum
  misc_feature: Ceres CLONE 1858242
  misc_feature: Encodes the peptide sequence at SEQ ID NO. 24336
attttctgcgctcgcgcgctcccgccacacacactccccaaccttcctcgcttcaccagactctaccctcaccaaggcttcctgatcaggttgggagcgcaggagaggagcttggaaggatggcgtcagtttcccgggctgtctgcggcgtgcagatgccgcgcttgaacggcagggaggcgcccgccggccgccgatcgaccgcggcaccgaaggaccggaacgcaccgcggggcgtcatccgctccgtgtcggtctccggctccgtctccggccgcggccagcattgcgcgcctgccgacgccgtcgccgacgccgcgccaattacagcgacaaagagggtgttccccttcggcaagggcaagaacgagggcaacaggggcatgaaggatctgctgggcgggaagggcgcgaacctggccgacatgtctagcatcgggctgtccgcgccgcaggggttcacggtgtcgacggaggcgtgccaacagtaccaagaggccgggcgcgcgctgccggcggggatctgggcggagatcctcgacggcctggcgtggatggaggagtacatgggcgcgcgcctcggcgatccgcagcgtccgctcctgctctccgtccgctccggggccgcggtgtccatgcccggcatgatggacccg

SEQ ID NO: 24336 - protein, 178 aa, Panicum virgatum
  misc_feature: Ceres CLONE 1858242
  misc_feature: SWISSPROT Homolog: EC 2.7.9.1 Pyruvate, phosphate dikinase
MASVSRAVCGVQMPRLNGREAPAGRRSTAAPKDRNAPRGVIRSVSVSGSVSGRGQHCAPADAVADAAPITATKRVFPFGKGKNEGNRGMKDLLGGKGANLADMSSIGLSAPQGFTVSTEACQQYQEAGRALPAGIWAEILDGLAWMEEYMGARLGDPQRPLLLSVRSGAAVSMPGMMD

SEQ ID NO: 24337 - DNA, 707 bp, Panicum virgatum
  misc_feature: Ceres CLONE 1858253
  misc_feature: Encodes the peptide sequence at SEQ ID NO. 24338
gacgagagcgtgactgtgcctgactgccagtgagtggaaggaggagacgcttgagctgagctgcggcggcgctgggatgggcgccgcggggtctgcggctccgccggcggcggcagcgcattgccgccgggtgctgctggccctcgccctcgtgtcgctctgcggccgcgggcttcgcgtgcgtgccgctggggcggacacgggcggcctgagcagggacgcgttccccaaggggttcgtcttcggcacggcgacgtccgcgttccaggtcgagggcgcggcggcgtccggcggccggggggccagcatctgggaccccttcgtccacacccccggaaatattgctggagacgcgaacgcagatgtcgcaactgatgaatatcatcgctacaaggaagatgttgatctcatgaaaagcctgaattttgacgcatatcggttttcaatctcttggtccaggatcttcccagatggtgaaggaaaagttaatgaagaaggtgtacaatattacaacaatcttatagactatatgattaagcaagggcttactccttacgtcaaccttaaccattatgatctcccactcgcgcttcagaagaagtacaaaggctggttaggcccaaaaattgtggacatatttgctgactatgccgatttttgtttcaagacttttggagatcgagtcaagaattggttcacattaaatg

SEQ ID NO: 24338 - protein, 210 aa, Panicum virgatum
  misc_feature: Ceres CLONE 1858253
  misc_feature (46)..(210): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
MGAAGSAAPPAAAAHCRRVLLALALVSLCGRGLRVRAAGADTGGLSRDAFPKGFVFGTATSAFQVEGAAASGGRGASIWDPFVHTPGNIAGDANADVATDEYHRYKEDVDLMKSLNFDAYRFSISWSRIFPDGEGKVNEEGVQYYNNLIDYMIKQGLTPYVNLNHYDLPLALQKKYKGWLGPKIVDIFADYADFCFKTFGDRVKNWFTLN

SEQ ID NO: 24339 - DNA, 2070 bp, Panicum virgatum
  misc_feature: Ceres CLONE 1858267
  misc_feature: Encodes the peptide sequence at SEQ ID NO. 24340
actgatccagaggaaggccagcgtcccatgtcgccgccgccgccacggggaccagctcaccgccgaggtgccccctctcggcttccctgagcggcgctcccggccgcgggaaatggtccaggcgcggcgccgcggcggcagctaccggtgcccgcgccgcgccgcgctggcggcggcggcgctcctgctcttcctcctcgccgccgtcgcgctgctctacgtctccccgccgccggtctcggaccaccccgtggtggcctcctcccgccgccgccgctcggcccatgctttgctgaacagctccggtggcggcagcatggacgagtccgagcgccgcgaaatttctcgtgttccaacgaatggttcgaccgtcagggacaacctttggggttcaaagcttgctagcaaattttatgggtgcagcaactcaagcaacaagttccttgattcaaatattactacacaaacagaccgctgtttgatgattgttacaagtggaggcctgaatcaacagagaacagggataattgatgctgtcgttgctgcgcgcattttaaatgccacacttgttgttcccaaactggaccaggcatccttctggaaagattcaagcaatttttctgaaatttttgatgccaactggtttatctcatccctatcaaaggatgtaaagattgtgaaagagcttcctgagataggaggtaaacttcgggctcctcacagaatgcgtgttcctcgaaaatgtactgagcggtgttacttgaaccgtgtgttacctgcacttcttaagaaacatgttatacgattgacgaaatttgattatagattagcaaacaggttgcaaactgacttgcaaaagttgagatgcagagtcaactatcatgcattgagatttactgctccaatacaggagatgggtgaaaagctaatacaaagaatgagggagaggagcaagtattttattgctcttcatttaagattcgaacctgatatgcttgccttttcgggatgttattatggtggtggagaaaaagagaggagagaacttggtgctataaggaagaggtggaaaggcttgcatcctaacccagagaaaggaagaaggcaaggtagatgcccgctaactcctgaagaggtgggtctgatgttgagagcactgggctacagtaaggatgtccacatttatgtggcttctggagagatatatggaggtgcaaggactctggcatcgcttaaagctctcttccccaatctccacacaaaagaaacaatatctagcaaagaggagctggctccattctctaagtattcatctcgcatggctgcacttgatttcattgtctgtgatgaaagtgatgcttttgtggctaacaacaacggcaacatggctaaaattttggctgggcgaaggagatattttgggcataagagaacaatccgaccaaatgccaaaaggctctatcccttatttttgagcagaggaaacatgtcatgggatgcattctcctcaaaagtacacatgtttcagaaagggtttatgggagagcccaaagagcttaggccagggaggggggagtttcatgagaacccctccagctgtatctgtgaaaggactgatggcaaagccaaatctcgcaaggatcaaattttggatattagtagtgaccgaggcaaagccatggatgagccagcagttcctaattatattggcgaagaggtgggcgaatttgatgatgacgacgaagatgctcctgcagagaaagggatggttgacttggaaatggacgacgatgcgttggtcagaccagaggatcctgagctggaacagattctttcagactagctgctaagttgtaaaaccggcgtcaaagtaatttcccaagcaattttgggctgagtgattagcgaattttgaccccttgaaattgtacatatttctttttttgcaatgtaaatgtacatcctccaaccagacttagccttgcatctcagtagtgcagtgtctgattcctcagtttgtaacatttgtggtttgttgcctgttttagattgtagcatgcgttttgcttc

SEQ ID NO: 24340 - protein, 576 aa, Panicum virgatum
  misc_feature: Ceres CLONE 1858267
  misc_feature: Useful for making plants with modulated nitrogen use efficiency
MVQARRRGGSYRCPRRAALAAAALLLFLLAAVALLYVSPPPVSDHPVVASSRRRRSAHALLNSSGGGSMDESERREISRVPTNGSTVRDNLWGSKLASKFYGCSNSSNKFLDSNITTQTDRCLMIVTSGGLNQQRTGIIDAVVAARILNATLVVPKLDQASFWKDSSNFSEIFDANWFISSLSKDVKIVKELPEIGGKLRAPHRMRVPRKCTERCYLNRVLPALLKKHVIRLTKFDYRLANRLQTDLQKLRCRVNYHALRFTAPIQEMGEKLIQRMRERSKYFIALHLRFEPDMLAFSGCYYGGGEKERRELGAIRKRWKGLHPNPEKGRRQGRCPLTPEEVGLMLRALGYSKDVHIYVASGEIYGGARTLASLKALFPNLHTKETISSKEELAPFSKYSSRMAALDFIVCDESDAFVANNNGNMAKILAGRRRYFGHKRTIRPNAKRLYPLFLSRGNMSWDAFSSKVHMFQKGFMGEPKELRPGRGEFHENPSSCICERTDGKAKSRKDQILDISSDRGKAMDEPAVPNYIGEEVGEFDDDDEDAPAEKGMVDLEMDDDALVRPEDPELEQILSD

SEQ ID NO: 24341 - DNA, 603 bp, Panicum virgatum
  misc_feature: Ceres CLONE 1858277
  misc_feature: Encodes the peptide sequence at SEQ ID NO. 24342
atttcaccttgccaccattgctagcctatagccgtcgtccgtagcttgctgccggggccgccgccgccgccgccgcggagccatggggaggagggcgcacgcgatgctgttcccgttcccgtgctcgggccacatcaacccgacgctgaagctggcggagctgctgcacgcgcgcggggtgcacgtgaccttcgtcaacacggagcacaaccacgagcggctgatgcggcggcagggcgcggcggcggcggggctgcgggggcgggaggggttccggttcgaggcggtccccgacgggctgtcggacgaggaccggcggtgccccgaccggacggtgcggctgtacctgtcgctgcggcggagctgcggcgcgccgctggtggcgctggcgcggcggctcgcggcgtgcgacgacggcgccccgcccgtcacctgcgtcgtgctcagcggcctcgtcagcttcgcgctcgacgccgccgaggagatcggcgtgccggcgttcgtgctctggggcacaagcgcctgcgggttcgtctgcacgctccgcctccgggagctccggcagcggggctacacgccgctcaaagacgagagctacctgac

SEQ ID NO: 24342 - protein, 173 aa, Panicum virgatum
  misc_feature: Ceres CLONE 1858277
  misc_feature: SWISSPROT Homolog: EC 2.4.1.210 Limonoid glucosyltransferase
  misc_feature: Useful for making plants with altered carbohydrate content
MGRRAHAMLFPFPCSGHINPTLKLAELLHARGVHVTFVNTEHNHERLMRRQGAAAAGLRGREGFRFEAVPDGLSDEDRRCPDRTVRLYLSLRRSCGAPLVALARRLAACDDGAPPVTCVVLSGLVSFALDAAEEIGVPAFVLWGTSACGFVCTLRLRELRQRGYTPLKDESYL

SEQ ID NO: 24343 - DNA, 1595 bp, Panicum virgatum
  misc_feature: Ceres CLONE 1858287
  misc_feature: Encodes the peptide sequence at SEQ ID NO. 24344
aatagccccgcccatgctgacccaaccccaccagcaagatcatcaagaagaacccaagctccagtgccgggcaacgccgcagcccgcagcgctagctagctagagcggatcaacgcccgagccagcaccccgcacccgcaccccccgcgatcagatcaccgatcaccatgggctccctcggcggcgccgcgcaggccagcagcaggccgcacgccgtgtgcctgccgtacccggcgcagggccacatcaccccgatgctcaacgtggccaagctgctccacgccaagggcttccacgtcaccttcgtcaacaccgagtacaaccacgcccgcctcgtccggacctgcggcgccgccgccgtggccggcgtcccgggcttccgcttcgccaccatcccggacggcctgcccccctcggaggacggcgacgtcacgcaggacatcccctcgctctgcaggtccaccaccgagacctgcctcggccccttccgccgcctcctcgcggagctcaacgacgtccccgccgccgcgggccacccgcccgtcacctgcgtcgtctccgacgtcgtcatgggcttctccatcgacgccgccaaggagctcggcctcccctacgtccagctctggacggccagcgccatcagcttcctcggctaccaacactaccgcctcctcatgagccggggcctcgccccactcaaagatgccgagcagctgacgaacggattcctcgacacgccggtggacgacgtgccggggctgcggagcatgaggttccgggacttcccgagcttcatccgcacgacggacccggacgagttcatggtgcactacgtcctcaaggagacggggcgctcggcgggcgcgtcggcggtgatcatcaacaccttcgacgagctcgagggggaggcggtggcagccatggagtcgctgggcctggcgcgcaaggtctacacgctgggcccgctcccgctgctggcgcgcgaggacccgcccaccccgcgctcctccatccgcctcagcctgtggaaggagcaggaggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgccgccacggccgaccgagggctcatggcgagctggtgcccgcagcaggaggtgctggaccacccggccgtcggtgcgttcctcactcacagcggctggaactccaccctggaggccatgtgcggcggcgtccccgtcatcagctggcccttcttcgccgaccagcagactaactgccggtaccagtgcaaagagtggggcgtcggcatggagatcgacgccaacgtccgccgcgacgacgtggcgggcctcatcacggagctcatggagggggagcaggggaaggagatgaggaggaaagccckggagggagggacaaggcgaccgaggcggccaaccccgggggcgcgcccgccgcaa

SEQ ID NO: 24344 - protein, 475 aa, Panicum virgatum
  misc_feature: Ceres CLONE 1858287
  misc_feature (16)..(465): Pfam Name: UDPGT Pfam Description: UDP-glucoronosyl and UDP-glucosyl transferase
  misc_feature: SWISSPROT Homolog: EC 2.4.1.115 Anthocyanidin 3-O-glucosyltransferase
  misc_feature (458)..(458): Xaa is any aa, unknown, or other
MGSLGGAAQASSRPHAVCLPYPAQGHITPMLNVAKLLHAKGFHVTFVNTEYNHARLVRTCGAAAVAGVPGFRFATIPDGLPPSEDGDVTQDIPSLCRSTTETCLGPFRRLLAELNDVPAAAGHPPVTCVVSDVVMGFSIDAAKELGLPYVQLWTASAISFLGYQHYRLLMSRGLAPLKDAEQLTNGFLDTPVDDVPGLRSMRFRDFPSFIRTTDPDEFMVHYVLKETGRSAGASAVIINTFDELEGEAVAAMESLGLARKVYTLGPLPLLAREDPPTPRSSIRLSLWKEQEECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCKEWGVGMEIDANVRRDDVAGLITELMEGEQGKEMRRKAXEGGTRRPRRPTPGARPP

SEQ ID NO: 24345 - DNA, 3046 bp, Panicum virgatum
  misc_feature: Ceres CLONE 1858295
  misc_feature: Encodes the peptide sequence at SEQ ID NO. 24346
aaatcttcaagacagagcgaccgggagcggagcgcggcagccgagaagaagaaactccacccccgcggcccgcggctgcgacgatcccggccggcccccgatggagctcctgagcggcggcgcgctcgcgtggcagcagtaccgcgcgctgctccgcaagaacgccacgctcacctggcgccaccgccggtcggcggcgctgcagctcttctcctcgctcgtcttcatcttcctcatcttctgcatcgaccgcgccgtgcgctccaggttctccagcaccaccgcctaccgcaacgtgccggacccggccgcgctcgtcgcgccgccgatcccgccctgcgaggacaagttcttcatcaagtccccctgctacgacttcctctggagcgacggcggcagcgcccgcgtcaggggactcgtcgacgccatccggaggaacaaccccggccggcccatccccgccgacaaggttttaggttttaggactccggatgatgttgatgcttggctgtttcaaaacccaatgcgctgccctggtgctttacattttcaagatataaatgccactcagataaagtatggtatccagacaaactctactccggtagctcggagaggaacatatgaagaccccaccttcaagttccagataccacttcaagttgcagctgagagagaaatggcaaggcttcttattggagatccaaattttagctggactgtggggttcaaggaatttgctcacccagccacagaaaccttctctaccattgctcaagcagggccaactttcttccttgcgatcgcaatgtttggatttgtttttcaaatcagtgccttggtgacagagaaagaattaaaacttcgccaggctatgtctaccatggggctctatgaatcagcctactggttatcatggtttacctgggaggcccttcttacaacaatttcagcactttttactgtgctatttgggatgatgttccagtttgacttcttccgtaataatagctttggaatcctattcctcctattcttcctgttccaactaaacatgcttagttttgccttcatgatatccacattcgtagcaaaggcagcatcagctaccactgttggatttgcaatattcattattgggtttttgactcagcttgttaccacctttgggttcccatattcgagtgactacaaaaaattgtaccgaacattgtggtctctctttcctcctgatgtatttgccaaagccctcgacattcttggaaaggcaacagccactcctgaagataaaggtatcagctggaatcagcgcgggaagtgcccatcatctgagacggactgcgtcattactatagacgatatctataaatggctcatctccacgtttttcttgtggtttgtcttggcaatctactttgacaacatacttccaaatgtaaatggtgtccgaaagtcggttttctactttcttatgccatcatactggacgggtaaaggaggcaagatgcaagagggaggcctctttagtttttttggttcaagtcgtccagctgatgatgctaaccctactgatgaggatgttcttgcggaggaaaacctagtaaaggagcaagctgcaaacaacaaagtagatcctggtgttgcagttcaaatacatggtctgcggaagacatatccaggaactttcagcattggttgttgcaaatgctcaacagcaaagccatttcattctgtcaaaggcttatgggtgaaccttgagaaggaccagttattctgtcttcttgggcccaatggagctggtaaaacaactacaatcagttgtctgactggaatcacacctattacaggaggtgatgcattcatttatggtcattctgtccgaagcactgcggggatggcaaatattcgtaggatgattggagtctgtccacagtttgatatcctatgggatgcattaacagctaaagagcacatggaattgtttgccagtatcaagggattgcctccatcagcaatcatgtcggtagcagaggaatcattagccaaagtgaagctcagccaggtaaccaatgttagagcaggcagctacagtggaggaatgaagcgccgcttaagtgttgcgatagctctaattggtgacccaaaattggtctttcttgatgaaccaactactggcatggatccaataacaaggaggcacgtttgggacatcatagaagaggccaagaaaggaagagctattgtcttgaccacccattccatggaggaggctgatattctgagtgaccggatagctataatggcaaaggggaaactgcggtgcattggtacatcgataaggctgaagtcgaaatttggaacaggatacatcgctaacatcaatttctctggaaatggccacatgcagagccctaacatcaacagcaacaccgaggccccagttaatcctaacatagaagctgtcaaatggttcttcaaggaacggcttgatgttgtcccaaaagaggagagcaggacattcttgacatttatcatcccccatcacaaagagccacttctgacaagattcttcggggaattgcaagacagggagagggaatttggaatatcagatattcaacttggtctcacaacacttgaagaagttttcctgaacattgcaaagcaggcagagctggagagctctactgctgaaggcaccttggtgactcttaacctgtcatcaggagcaacaattcagattccgaagggtgctcgttttgttggtattcctggaactgagacagaagagcgtccaagaggcgtcatggttgaggtttactgggatcaggatgaaaatggatcactctgcatttctggtcactctgacgagatgccagtgccagtcaatgttgagctcaggaggccaccctcgatctctcgtagggcctccatggcccgtgaaggtccagtcgggtatatcattgacccgagccaggtcccataaatagatgagtcggggtgcagagttaggattggttttcatgtaattatcttaggtgtgtct

SEQ ID NO: 24346 - protein, 961 aa, Panicum virgatum
  misc_feature: Ceres CLONE 1858295
  misc_feature (555)..(737): Pfam Name: ABC_tran Pfam Description: ABC transporter
  misc_feature: SWISSPROT Homolog: EC 3.6.3.31 Polyamine-transporting ATPase
MELLSGGALAWQQYRALLRKNATLTWRHRRSAALQLFSSLVFIFLIFCIDRAVRSRFSSTTAYRNVPDPAALVAPPIPPCEDKFFIKSPCYDFLWSDGGSARVRGLVDAIRRNNPGRPIPADKVLGFRTPDDVDAWLFQNPMRCPGALHFQDINATQIKYGIQTNSTPVARRGTYEDPTFKFQIPLQVAAEREMARLLIGDPNFSWTVGFKEFAHPATETFSTIAQAGPTFFLAIAMFGFVFQISALVTEKELKLRQAMSTMGLYESAYWLSWFTWEALLTTISALFTVLFGMMFQFDFFRNNSFGILFLLFFLFQLNMLSFAFMISTFVAKAASATTVGFAIFIIGFLTQLVTTFGFPYSSDYKKLYRTLWSLFPPDVFAKALDILGKATATPEDKGISWNQRGKCPSSETDCVITIDDIYKWLISTFFLWFVLAIYFDNILPNVNGVRKSVFYFLMPSYWTGKGGKMQEGGLFSFFGSSRPADDANPTDEDVLAEENLVKEQAANNKVDPGVAVQIHGLRKTYPGTFSIGCCKCSTAKPFHSVKGLWVNLEKDQLFCLLGPNGAGKTTTISCLTGITPITGGDAFIYGHSVRSTAGMANIRRMIGVCPQFDILWDALTAKEHMELFASIKGLPPSAIMSVAEESLAKVKLSQVTNVRAGSYSGGMKRRLSVAIALIGDPKLVFLDEPTTGMDPITRRHVWDIIEEAKKGRAIVLTTHSMEEADILSDRIAIMAKGKLRCIGTSIRLKSKFGTGYIANINFSGNGHMQSPNINSNTEAPVNPNIEAVKWFFKERLDVVPKEESRTFLTFIIPHHKEPLLTRFFGELQDREREFGISDIQLGLTTLEEVFLNIAKQAELESSTAEGTLVTLNLSSGATIQIPKGARFVGIPGTETEERPRGVMVEVYWDQDENGSLCISGHSDEMPVPVNVELRRPPSISRRASMAREGPVGYIIDPSQVP

SEQ ID NO: 24347 - DNA, 688 bp, Panicum virgatum
  misc_feature: Ceres CLONE 1858310
  misc_feature: Encodes the peptide sequence at SEQ ID NO. 24348
gcatccaacttaaaagtttgttcacgcactaccccttcaaaattcagcagaaacaacagccgtgttctgcgctagctccagcggagcagaggaccaagatgtcaaccaatcaaccagcgaaacctaccatacttatattactgccactgttgctattattccacggctctagtaaaatcagctgctcaacggtccctgataataccaccgatgtcctctcgctgctagctttcaaggcagccaacgatccaactggagtgctcaactcttggaactccagcaccagccactgcatgtggaagggagtcaagtgcagcgtgacgcacccggggcgagtcacggcgctggaattctccgggaataagttggccggttcaatctcctcctcccttggaaacttgactttccttacaacacttgatctatctgcaaatggcttctccggggagttgcctcctctcaaccgtctccacaaacttgaaatcctgaatctaagcagcaacatgttgcaagggagtatcccagattcgattgtaaattgttctaagctaaggactctagacctctctaggaactatctggtaggtgaaattccttctggagttggcctcctgtccaacctatcggtcttacgactatcttggaatagtctcacggggatcattccgccaaccatcagtaacataac

SEQ ID NO: 24348 - protein, 196 aa, Panicum virgatum
  misc_feature: Ceres CLONE 1858310
  misc_feature (35)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MSTNQPAKPTILILLPLLLLFHGSSKISCSTVPDNTTDVLSLLAFKAANDPTGVLNSWNSSTSHCMWKGVKCSVTHPGRVTALEFSGNKLAGSISSSLGNLTFLTTLDLSANGFSGELPPLNRLHKLEILNLSSNMLQGSIPDSIVNCSKLRTLDLSRNYLVGEIPSGVGLLSNLSVLRLSWNSLTGIIPPTISNI

SEQ ID NO: 24349 - DNA, 1967 bp, Panicum virgatum
  misc_feature: Ceres CLONE 1858312
  misc_feature: Encodes the peptide sequence at SEQ ID NO. 24350
ctccaccccgcgcgcctgtccccttggtcgcaaatggttctcgcgcgagtcctcacgctccctctgcccgccccgtcgtccccgccccaccgtcgcttcctcctcccgcctcgggcggcgcgtgtggcacccgttcgggccgccgcctgccgcgcggcgagcgcgatggcggcggtgccggctctggaccccgccgcggccgcggccgtgggcgtcggcgaggagctgccggaggggtacgatcagatgatgcccaccgtggagccggcgcggcggcggcgcgcgggggtgttgctgcacccgacgtcgctccggggcccgcacggcatcggcgacctcggcgacgaggcgctcgccttcctccactggctacgcgacgccggctgcacgctctggcaggttctgccacttgttcctccagggagaacatctggagaggatggatctccttattctggacaggatgccaactgtggtaatacccttttgatatctcttgaagagcttgtaaaagatggccttttgatggaagatgaacttcctagccccgtggatgtggagcatgttgaatttgctaccgttgcaaatctgaaagaacctcttattgcaaaggcagcagagaggctcttacttggccaaggagagctcagaacgcaatatgactgcttcaagaaaaatccgaatatatcaggttggcttgaagatgcagcactttttgctgctattgacaaaagcattggtgcattctcttggtacgagtggcctgaacctctgaaaaatcgccatcttggagccttggaagatatatatcaaaaacagaaggacttcatagagacatttatggctcagcaattcttatttcaaaggcagtggcagcggattcgtaaatatgcacagaagttgggtatcagcataatgggtgacatgcctatatatgttggctaccatagcgcagatgtatgggcaaacaggaaatcatttatgctggacaagaatggtttccccacttttgttagtggtgttccacctgatgcatttagcgaaactggtcagctatggaacagtccgttgtacgactggaaagctatggaagcagatggcttttcatggtggataaagaggattaaacgagcccttgatttgtatgacgagttccgtattgaccatttccgggggcttgtgggtttttgggcagtcccatctggtaagctgaatacatcagggcactacctccctgcatattaaatatttgtactgcaggtgaatttgttttatgggaacatctttccttcatctaacttagcattcgtgcataatgtagacgcaaaagtagcactagttggaagctggagggtgagcatcggcttgatggacgtggtattgcaattttcctttccagaaaatctttgctgctgatatgtgttttcctgctttctttggcagtaggctggaccgaggaacgccttttttgatgcgctcttcaaagctgttggtagcataaatataatagcagaagacctgggcgtgattactgaagatgtggttcagctaaggaaatcaattggggcccctgggatggcagttctccagtttgcttttggaggtggttctgacaaccctcacttgctgcataaccatgaaatggaccaagttgtgtacactggaacacacgataacgatacagttcttggctggtggcaaaatttacctgaggaagagaagcaaattgtgattaagtatctaccggaagccaagaatactgacatctcatggacactgattaccgctgccctttcttctgttgcaaggacttccatggtaaccatgcaggatattcttggcctcgacagttctggtagaatgaacactccagctacccagaaaggaaactggagatggaggataccgagctccgttggcttcgacagcctttgccctgaagcagcaaagctgaaggagttgctttc

SEQ ID NO: 24350 - protein, 403 aa, Panicum virgatum
  misc_feature: Ceres CLONE 1858312
  misc_feature (88)..(403): Pfam Name: Glyco_hydro_77 Pfam Description: 4-alpha-glucanotransferase
  misc_feature: SWISSPROT Homolog: EC 2.4.1.25 4-alpha-glucanotransferase
MVLARVLTLPLPAPSSPPHRRFLLPPRAARVAPVRAAACRAASAMAAVPALDPAAAAAVGVGEELPEGYDQMMPTVEPARRRRAGVLLHPTSLRGPHGIGDLGDEALAFLHWLRDAGCTLWQVLPLVPPGRTSGEDGSPYSGQDANCGNTLLISLEELVKDGLLMEDELPSPVDVEHVEFATVANLKEPLIAKAAERLLLGQGELRTQYDCFKKNPNISGWLEDAALFAAIDKSIGAFSWYEWPEPLKNRHLGALEDIYQKQKDFIETFMAQQFLFQRQWQRIRKYAQKLGISIMGDMPIYVGYHSADVWANRKSFMLDKNGFPTFVSGVPPDAFSETGQLWNSPLYDWKAMEADGFSWWIKRIKRALDLYDEFRIDHFRGLVGFWAVPSGKLNTSGHYLPAY

SEQ ID NO: 24351 - DNA, 2500 bp, Panicum virgatum
  misc_feature: Ceres CLONE 1858318
  misc_feature: Encodes the peptide sequence at SEQ ID NO. 24352
acaccgcctttctgcagcctctctctctctctctcgctcccgttgttttcgctgcagattttggctgcggcgccgcgtcctctgcggttctgtcccccatgcttcaccaccaacccaaccccaagaggggaggctgataccctgcccggcggctcggttctgagctggactgaactgaactggagagagagcacagtccggaatatgtttggtttctcgcggcgccgggtgaaacttggaaggttgaagggtgaccataatgattctttgaatagctccaggagtcttggtggccccacgaaacagctcagcctacctaatggggatgacgctgctacaacatcagtgagcggccgtgcagatgatctttcctaccgctgctcttcagatactttcaatctcgacagtcgttctttcaatatttctgaaaactggactgtgttgtccacagagggagacaaacctattcctcgtttctatcatgcagcggccattgtaagtagcaagatggtagtgtttggtggtgattctggtcgtcacttattaaatgatacaaagatactgaatttagagaagcttagctgggattctgcaccgcctaaagttcggccatcaccaagtggacgttctaccaagttgccagcctgcagaggtcattgtctggttccatgggaaaatagtgtcattcttgttggaggtaaaactgagcctgcttctgatcgtttatcagtatggattttcaatactgaaacagaactttggtcccttgttgaagccaagggtgatatccctgcagctcgaagcggccacacagtgatcagagccggtgctagattgatactttttggcggcgaggacacaaaaggaaagaaacgacatgaccttcacatgtttgatctcaaatcatcaacatggcttccattgaactataaaggcgctggaccttctccgagatccaatcatgtcgctgcactgtatgatgataggatcctcctgattttcggaggccactcaaaatcgaagacccttaatgacttgtattctttagattttgagacaatggtgtggtcaagagtgaagactcatgatcatcacccatcaccccgagcaggttgcagcggagctctgtgtggaaccaagtggtacatagctggcggcgcaagcaagaaaaaacgacacgtggaaacttgggtttttgatatccaacaatctaagtggtctgtttgtgtagtgccccctagttcatcaataacttcaaagaaaggtttcagtatggttcctttctaccacagggacaagatcgctcttattgcttttggagggaacaaaaaggagccgtgcaacaaggttgaagtatttgtggtactgcaaaatgagcattcttttagttggcggtcagccccagaagtggaccatgtgctgtatgagtattctccgagcaataaggagcttgttgatcatctcaacaagtgtgcccccttgtactctaacagttccgttgcaaggtatagtctcacttctgtggtagaacagccacctagaagggaacccctctctgagtcactgttgaagcaacacaatttaggcacttcactccatgtgaatttggatcaagtagaagagtgcagcttagctaaaaaactgcagaaaccgatcgatgatgacagatatgacgatgctgatgactattcttcatgtcaagaaagcactccaaaagggcatcggagcacaaggacaggagctggtattcagaatgacctggcacaaatagaaactatggtgactgggggatcaaatgtaagaaggatcgctagatgctcttcagacgtgagccagagtcacctatacaacacaaagatagcagatttaataagaagaaacaccgtgctccaagaccagctagcgaccgcgttcgcaagcaaagaccagttggagaacagcctatcttcggtcattcaaagcagggagcagctagaaaagatgcttgccaacaaggataaggaggcggagatcttgaaagagaagatagcagccctagagctggctcaagaagagtcaaacagcctttcgaacacggtccatgccgataatgtgcgcctcgagcatgaggtggcgttcctgaaggccgttacagatgagacccagaaggagctgcattccactcgcagggttttggcgggagaacagtcgcgcgcgttccagctccagattgaagtgttccatctcaagcaaaggctgcaaatactagaggggagatcagggacgcccactaaacaaccccaataacatgtgatcgcatctctacatttgtggacaattgttgcgagcactgtaacatcgctatgtaaattgtgtatttgtgcaacaagttttttctcttttttttttgatcttatgcaacaataggtgtcaccatgtcacatctgctgatatgtaatttgcgggtatatgataaaattataaataactgatggattgaatgcaggctctatttgatgtc

SEQ ID NO: 24352 - protein, 693 aa, Panicum virgatum
  misc_feature: Ceres CLONE 1858318
  misc_feature (89)..(134): Pfam Name: Kelch_2 Pfam Description: Kelch motif
  misc_feature (249)..(295): Pfam Name: Kelch_2 Pfam Description: Kelch motif
  misc_feature: SWISSPROT Homolog: EC 3.1.3.16 Phosphoprotein phosphatase
MFGFSRRRVKLGRLKGDHNDSLNSSRSLGGPTKQLSLPNGDDAATTSVSGRADDLSYRCSSDTFNLDSRSFNISENWTVLSTEGDKPIPRFYHAAAIVSSKMVVFGGDSGRHLLNDTKILNLEKLSWDSAPPKVRPSPSGRSTKLPACRGHCLVPWENSVILVGGKTEPASDRLSVWIFNTETELWSLVEAKGDIPAARSGHTVIRAGARLILFGGEDTKGKKRHDLHMFDLKSSTWLPLNYKGAGPSPRSNHVAALYDDRILLIFGGHSKSKTLNDLYSLDFETMVWSRVKTHDHHPSPRAGCSGALCGTKWYIAGGASKKKRHVETWVFDIQQSKWSVCVVPPSSSITSKKGFSMVPFYHRDKIALIAFGGNKKEPCNKVEVFVVLQNEHSFSWRSAPEVDHVLYEYSPSNKELVDHLNKCAPLYSNSSVARYSLTSVVEQPPRREPLSESLLKQHNLGTSLHVNLDQVEECSLAKKLQKPIDDDRYDDADDYSSCQESTPKGHRSTRTGAGIQNDLAQIETMVTGGSNVRRIARCSSDVSQSHLYNTKIADLIRRNTVLQDQLATAFASKDQLENSLSSVIQSREQLEKMLANKDKEAEILKEKIAALELAQEESNSLSNTVHADNVRLEHEVAFLKAVTDETQKELHSTRRVLAGEQSRAFQLQIEVFHLKQRLQILEGRSGTPTKQPQ

SEQ ID NO: 24353 - DNA, 2521 bp, Panicum virgatum
  misc_feature: Ceres CLONE 1858347
  misc_feature: Encodes the peptide sequence at SEQ ID NO. 24354
aaaaaacactctcccacgcacaccacccaccactgcgcccctgctcctcctcctcctcctcatcagtccagtcccagtccctgctcactagctgagcgaatcagactgctcgctcactggctcggctcagctggaaggggttgtggtagtggtcgccggagagaaagagagggtaagagggcggcgttcagctcatcagctgagctgagcttggggaggtgagggggagagcgcgagcttggaggaggaggaggcggaggaagagaggagaggcgtccaagatgattacgggggcggacttctaccacgtgatgacggccatggtgccgctgtacgtggcgatgatcctcgcgtacgggtcggtgcggtggtggcgcatcttcacgccggaccagtgctccggcatcaaccgcttcgtcgcgctcttcgccgtgccgctgctctccttccacttcatctccaccaacaacccctacaccatgaacctgcgcttcatcgccgccgacacgctgcagaagctcctggtgctcgccatgctcaccgcctggagccacctcagccgccggggcagcctcgagtggaccatcacgctcttctccctctccacgctgcccaacacgctcgtcatgggcatcccgctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgcgggggccatcgcctccatcgtcgtcgacccggacgtcgtctccctcgacggccggagggacgccatcgagaccgaggcggaggtcaaggaggacggcaagatacacgtcaccgtgcgccgctccaacgcctcgcgctccgacatctactcgcgccgctccatgggcttctccagcaccacgccgcgccccagcaacctcaccaacgccgagatctactcgctgcagtcgtcgcgcaacccgacgccgcggggctccagcttcaaccacaacgacttctactccatggtcggccgcagctccaacttcggcgccgccgacgccttcggcgtccgcaccggcgccacgccgcgcccgtccaactacgaggacgacgcgtccaagaccaagtacccgctccccgtcgtgaatgcggcgcccggggcgggccactaccccgcgcccaacccggcggtggccgcggcgcccaagggcgccaagaaggccgccacgaacgggcaggccaagggcgaggacctccacatgttcgtctggagctccagcgcgtcgccggtctcggacgtcttcggcggtggcgcgccggactacaacgacgccgcggccgtcaagtccccccgcaaaatggatggagcgaaggacagggacgactacgtggagcgcgacgagttcagcttcgggaacaggggcgcgatagacagggacgcggaggcgggggacgagaaggccgcggcggcggtggcgggcgccgaccccaacgcggtggtcgcgccgacggcgatgcctcccacgagcgtgatgacccggctgatcctgatcatggtgtggcgcaagctcatccgcaaccccaacacctactccagcctcatcggcctcatctggtcgctcgtctgcttcaggtggaacttcgagatgccggccatcgtcctgaaatccatctccatcctgtcggacgcaggactcgggatggccatgttcagtctcgggctgttcatggcgctgcagccgcggatcatcgcgtgcgggaacaaggtggcgacgttcgccatggccgtgcgcttcctgaccgggccggccgtgatggcggccgcgtccttcgccgtgggcctccggggcacgcttctgcacgtcgccatcgtccaggcagctctgccccagggcattgtccccttcgtcttcgcaaaggagtacaacgtgcaccctgacattctcagcactgcagtcatttttggcatgctcatcgccttgccgatcacgctcgtctactacatcctgctcgggctgtgagcgccgaccgccattgctgtaaaaaagactaccaccacccaagatcagggggaggcaaagggaggacagagctgcaacgacactgcttggcgcttgcaaaatgagtgacttgtttctttctttttttcttgtttcatcttttcttttttttactctagaagtaggtgtggggattgggaggagggaaagggtggatgtggacaagacgttagcgctaggacgacaatggtgaggcaaaaccgcaaaaggcaccaaaagcaggtacatgtacaaagcttgaagggaacaggggatcgtccggtttcagcaggtcacggattggggtgtccggtgaggttcttcaacgggttgttttggggattttggttggccgcgctgaccgctgtaaaatggacgccatttctgacaagaggtcgatcttgctttgctcgtctcatgagtttgatggatgg

SEQ ID NO: 24354 - protein, 595 aa, Panicum virgatum
  misc_feature: Ceres CLONE 1858347
  misc_feature (9)..(590): Pfam Name: Mem_trans Pfam Description: Membrane transport protein
MITGADFYHVMTAMVPLYVAMILAYGSVRWWRIFTPDQCSGINRFVALFAVPLLSFHFISTNNPYTMNLRFIAADTLQKLLVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGVRTGATPRPSNYEDDASKTKYPLPVVNAAPGAGHYPAPNPAVAAAPKGAKKAATNGQAKGEDLHMFVWSSSASPVSDVFGGGAPDYNDAAAVKSPRKMDGAKDRDDYVERDEFSFGNRGAIDRDAEAGDEKAAAAVAGADPNAVVAPTAMPPTSVMTRLILIMVWRKLIRNPNTYSSLIGLIWSLVCFRWNFEMPAIVLKSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 24355 - DNA, 1402 bp, Panicum virgatum
  misc_feature: Ceres CLONE 1858350
  misc_feature: Encodes the peptide sequence at SEQ ID NO. 24356
aaccggaaagagagaagaaaaaccccctcactccactccagtctccagtacactcacgcacacagagagagcaaggcgatcatgagaaacctcaggaacatccctagtagctctcagttgtactaggaggcgcttggatcggcgctggggaagaagacaaggcgaccatggtgatggtcctcggtggtggccacagcaagacggacgagaaccgtcaccggaggcgccaccaccgcctctccccgtcgccctttccccggctgcccctcccctgatcgagaaccctctgtgatccttccttccccttggctctggagcagaccagccttcttttcttggaatctctgagaatttcgcgtgaagtcgagcgactggccatgaagagaccgagcagctccgtctccggcggcggcggcggcggcagcggcagtcccggcctccttccgccggttgttcacagtgatgacggctttggcggcgtcggggtggaggaggccgacgaggacatggtgctgtgcggcggcggcggcggcggggaaaagaagcggcggctgagcacggatcaggtgcgcgcgctggagcggagcttcgagacggagaaccgccgccgtccgacgcggccgggtcgggggaggacgccagcaagaaggtgcggaagccgtacaccatcaccaagtcgcgggagaactggacggagcaggagcacgacaagttcctcgaggccctgcagctctttgaccgtgactggaagaagatagaggcttttgttggctccaagactgtcatacagataaggagccatgcacagaagtactttttgaaggttcagaaaaatggaaccagcgaacatgtccctcctccacggccaaagcgaaaagctgctcatccatatcctcagaaggcctctaagaatgaaccaaactatggacttaagacagattcatcttccatccataggaactctggcatgaatgtgactgtttcttcatgggctgttagttccatcccaccagccgttgcctcatcgatggtgaaagaagatttgggtcctggaactctgggtccaaacaatttttgctcaagcagtactgaagtccctccaaggacgtggcaacctggtgaagcaaatgatcaaataaatcaagttccgtcacttcgccttatgccggattttgcgcaagtgtacagcttcttaggtagtgtttttgatccaagcacgagtggtcatttgcagaaacttaaggagatgaatccaattgatgttgaaacggcattgttgttgatgaggaatctctccatcaatttgaccagtcctgattttgaagatcaaaggaagttgctgtcctcatatagcacttctgatggacttgagctagggagttccaggagttcagctctagcg

SEQ ID NO: 24356 - protein, 144 aa, Panicum virgatum
  misc_feature: Ceres CLONE 1858350
  misc_feature: The sequence is a functional homolog of SEQ ID NO 146 in the 10/412,699 US patent application
MNVTVSSWAVSSIPPAVASSMVKEDLGPGTLGPNNFCSSSTEVPPRTWQPGEANDQINQVPSLRLMPDFAQVYSFLGSVFDPSTSGHLQKLKEMNPIDVETALLLMRNLSINLTSPDFEDQRKLLSSYSTSDGLELGSSRSSAL

SEQ ID NO: 24357 - DNA, 685 bp, Panicum virgatum
  misc_feature: Ceres CLONE 1858350-R
tacagctaggtctctcggcgtataatttcagtttgacagaccctctggatggtgctctgccgtagcaccgatgagcaatgaaggcgcttgcacggttgcacctatgtgcttcctgcgcatcaggccttcggctgaagatcgtgtaaaggtgcagccgtgacctgtgtagagaaggcttccgaaaggtgagattggcctgtggcctgatgtgtatatataatttttgccctgaagcgtgtacccttcctatcctattgctaccccaaaagctcggccatatagattcctgaatgctgctttagtaatggaaagagcaatgggaattttgagtgtacagattgctccctcatccctccattgagttctgttactgatatcagttcggttttctggctgccatctggtatggagcttctgcccgatgtggccatctcaacctgagcaagcatgtctgtgacttccacttgaggtgatcatagtgctgtaaagcggtttaccttccccattcaaatgtttcttgttcctatgtattatgtattttgcatcaggtgttagcccgtgtgtaagaggggggaaattcaaaatgtaaaggagacttgtgcactagcattaccatttaaattctatatgtgtaaaggcaaccatcgacatgtcttttccacatttttggtggttactccggcag

SEQ ID NO: 24358 - DNA, 677 bp, Panicum virgatum
  misc_feature: Ceres CLONE 1858356
  misc_feature: Encodes the peptide sequence at SEQ ID NO. 24359
gaacgggcggtggctcctctcctctcctctcctctcctctcctctgctctgcggttcggaacacgggaacagcctgctcctccctgactcctccatcttccttcgcgcgaggcctggtcgaccggttggctggttccatatccggcggggcttggtgctcgaggcgatcgcatcgtcatccgcctctcgcgccgttcgattgggccatggacaacccagcgccgccaacgaatgccgcggccggcgcgccagagccatcgccgtcgccgtcgccgtcgcggcggctgccggacttccagcagtcggtgcggctcaagtacgtgaagctggggtaccactacctcatctcccacggcatgtacctgctgctcaccccgctgatggtgctcgtggccgtgcacctctccacgctctccccgcgcgacgtcgccgacctgtgggcgcacctccgcctcaacctcgtctccgtgctcgcctgctccgcgctcctcgtcttcctcgccaccgcctacttcctcacccggccgcggcccgtgtacctggtcgacttcgcctgctacaagccggggcccgagcgccggtgctcgcgcgacaccttcatgcgatgctcgcgcctcacgggctccttcaccgacgccagcctcgagttccagcgcaagatcctggagcgctcgggg

SEQ ID NO: 24359 - protein, 156 aa, Panicum virgatum
  misc_feature: Ceres CLONE 1858356
  misc_feature: SWISSPROT Homolog: EC 2.3.1.119 Icosanoyl-CoA synthase
MDNPAPPTNAAAGAPEPSPSPSPSRRLPDFQQSVRLKYVKLGYHYLISHGMYLLLTPLMVLVAVHLSTLSPRDVADLWAHLRLNLVSVLACSALLVFLATAYFLTRPRPVYLVDFACYKPGPERRCSRDTFMRCSRLTGSFTDASLEFQRKILERS

SEQ ID NO: 24360 - DNA, 618 bp, Panicum virgatum
  misc_feature: Ceres CLONE 1858379
  misc_feature: Encodes the peptide sequence at SEQ ID NO. 24361
aaaggtctcctgatctatctatctgctcatcaccaccgcaccggggatacaactccactcctctcccctcaacaggaagaaacgacgtagattgttcagccatcatgctgcccaccttctccccgacggctagcgcctcggcggcgacgcctccgccgcggccgataccatgccgctacgggccgccggtgatcggcgcgctccgggaccgcctggactacttctggtcccagagccagaacgagttctttcggcggcgccccaccgccaaccggagcacggtgttccgcatcaacaccccacccacgttccccttcttcgtcggcgtcgacccgcgcgtggtcgccgtcgtggacgccgccgccttcaccgctctcttcgacagcaccctcgtccacgagcgcgacatcctcatcagaccctacaaccccggcgccggcttcacacgaggcacccgcgtcggcgtctacctcgacactgacgagcccgagcacgggacgcgtctaggagttcgccttggccctcctccaccgcggcgcccatgcctggcccgccgagctccgcgccgccgccgacgccatgctcgacgccgggaaggccgacctcctcgccaagcaa

SEQ ID NO: 24361 - protein, 171 aa, Panicum virgatum
  misc_feature: Ceres CLONE 1858379
  misc_feature: SWISSPROT Homolog: EC 4.2.1.92 Hydroperoxide dehydratase
MLPTFSPTASASAATPPPRPIPCRYGPPVIGALRDRLDYFWSQSQNEFFRRRPTANRSTVFRINTPPTFPFFVGVDPRVVAVVDAAAFTALFDSTLVHERDILIRPYNPGAGFTRGTRVGVYLDTDEPEHGTRLGVRLGPPPPRRPCLARRAPRRRRRHARRREGRPPRQA

SEQ ID NO: 24362 - DNA, 2391 bp, Panicum virgatum
  misc_feature: Ceres CLONE 1858381
  misc_feature: Encodes the peptide sequence at SEQ ID NO. 24363
agtcgccactgcccagctcgcaataactccttccaccccatctccacattctcccatccgccgttccccttcctcccctcctcctcctccccctcccatggcgtcgagatctccccgcgcgcttccgccgggctcctgctagccagcttcgtgcgcggccggagcgccggctcccgcagctagctttctcgcatgcgataccgccaccagacgacagattcttcaggcatcatcggcgagcggggatcggagaatgggagcggctgaagaagggcacgaggtagggcttgggaggcactaggagcgggctgccatcgttcatgacgccggcgaggcgcatgccggcggcgatgatcggccggaatggcgtcgcgtatgggtcctcgtcggcgctgtctttgagccaggctgacctgctagacagccatcacctgcagcaagcgttccagcagcaactctatgatcaaatcccagccggtgcagtggacagcggcgacaacatcatccatggccgctccgacacactggcagatgagtttgagagcaagtcgtgcagcgagaatcccgatggcacctctggcgatgacggtcaggaagaccctaaccagcggccgaacaagaagaagcggtaccaccgccacacccagcatcagatccaagaaatggaagcgttctttaaggagtgcccacacccagatgacaagcagaggaaggagctgagccgggagctcggcctcgagccactgcaagtcaagttttggttccagaacaagcgcacacagatgaagaaccagcatgagcgacaggagaacgcgcagctgcgcgcggagaacgacaagctgcgtgccgagaacatgcggtacaaggaggcgctcagcacggcctcctgccccagctgcggtggccctgctgccctcggcgagatgtcctttgatgagcaccacctccggctcgagaatgcccgcctccgcgacgagattgaccggatctcgggcatcgctgccaagcacgttggcaagcccatggtctctttcccggtgctctccagcccgcttgccgccgctgcagcccgctccccactggacgttgttggtgcgttcgggtcggccggccttggccccgaccccttgttcggtgttggcaccggtgcaggagagctgttgaggagcgtgtcaaccggccagctcgatgctgacaagcccatgatcgtggagctggccgtcgccgcaatggatgagctcctacggatggcccggctggacgcaccgctgtggagcaccggcgcggcaggggcacagctcgacgaggagtacggccggatgttcccaggcgggctcgggccaaggcagtacgggctacggccggaggcatcacgcgatggcgctgtggtgatcatgacgcgtgacagcctcgttgagatactcatggacgtgaaccgatttgttgctgtgttctcgagcattgtgtcgagggcttcgacgcacgaggtgctgtcaactggtgtggcagggagctataatggtgcattgcaagtgatgtcaatggagtttcaggtaccgtcgccgctggtgccaacacgagagagctactttgcaaggtattgcaagaacaacccagacgggacgtgggctgttgttgatgtctcgcttgacagcctctgccctaaccctgtcttgaagtgccggcgcaggccgtccggctgccttatccaagaaatgcccaatggctactcaaaggtgacctgggtggagcatgttgaggtcgatgacaggtcagtgcacaatctctacaggcctttggtgaattcagggcttgcgtttggtgcaaaacggtgggttggcaccctggaccgacaatgtgagcgccttgccagcgccatggccagcaacatccccaacggtgaccttggtgtgatcacaagcatagaagggaggaagagcatgcttaagctggcagagaggatggtggcgagcttctgcggtggtgtgaccgcgtccgctgcacaccagtggacgacgctctcgggcagtggtgctgaagacgtgcgtgtcatgaccaggaagagcgtggatgaccccggcaagcccccaggcatcgtgctcaatgctgctacctccttctggctcccagtcccgcccaagagggtcttcgacttcctccgcgacgagacctctcgcagcgagtgggacattctctcaaatggtggtgctgtccaagaaatggctcacattgccaatggccgggaccatggcaactgcgtctcccttcttcgtgtcaatagtgcaaactcgaaccagagcaacatgctgatcctgcaggagagctgcactgatgcgtcagggtcctatgttgtgtacgcgccggtggatgtggtggcgatgaacgtggtgc

SEQ ID NO: 24363 - protein, 690 aa, Panicum virgatum
  misc_feature: Ceres CLONE 1858381
  misc_feature (298)..(515): Pfam Name: START Pfam Description: START domain
  misc_feature (101)..(157): Pfam Name: Homeobox Pfam Description: Homeobox domain
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 130 in the 10/666,642 US patent application
  misc_feature: The sequence is a functional homolog of SEQ ID NO 92 in the 10/666,642 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
MTPARRMPAAMIGRNGVAYGSSSALSLSQADLLDSHHLQQAFQQQLYDQIPAGAVDSGDNIIHGRSDTLADEFESKSCSENPDGTSGDDGQEDPNQRPNKKKRYHRHTQHQIQEMEAFFKECPHPDDKQRKELSRELGLEPLQVKFWFQNKRTQMKNQHERQENAQLRAENDKLRAENMRYKEALSTASCPSCGGPAALGEMSFDEHHLRLENARLRDEIDRISGIAAKHVGKPMVSFPVLSSPLAAAAARSPLDVVGAFGSAGLGPDPLFGVGTGAGELLRSVSTGQLDADKPMIVELAVAAMDELLRMARLDAPLWSTGAAGAQLDEEYGRMFPGGLGPRQYGLRPEASRDGAVVIMTRDSLVEILMDVNRFVAVFSSIVSRASTHEVLSTGVAGSYNGALQVMSMEFQVPSPLVPTRESYFARYCKNNPDGTWAVVDVSLDSLCPNPVLKCRRRPSGCLIQEMPNGYSKVTWVEHVEVDDRSVHNLYRPLVNSGLAFGAKRWVGTLDRQCERLASAMASNIPNGDLGVITSIEGRKSMLKLAERMVASFCGGVTASAAHQWTTLSGSGAEDVRVMTRKSVDDPGKPPGIVLNAATSFWLPVPPKRVFDFLRDETSRSEWDILSNGGAVQEMAHIANGRDHGNCVSLLRVNSANSNQSNMLILQESCTDASGSYVVYAPVDVVAMNVV

SEQ ID NO: 24364 - DNA, 754 bp, Panicum virgatum
  misc_feature: Ceres CLONE 1858381-R
  misc_feature: Encodes the peptide sequence at SEQ ID NO. 24365
actacgtggccctcctgccgtcgggcttcgccatcctccctgacgggccacctggagctcccaatggagagataagcgccggcttggaggccggcggcggatccctcctgactgtggcgttccagatcctggtggactcagtccccaccgccaagctctcactgggctctgtcgccaccgtgaacagcctcatcgcctgcaccgtggagcgcatcaaggccgccgtctgcgcggaaggcaacccacagtagccacccatatgatttcaaggaggggagcagctagatttttggagaattcatcatttgggagtcaagaacgcacctcagactctccttgccatgtggtgctcatactgctagtgttcaagaaaccctgcgaaaacgtcgcggaaaggaaggcggtcaccactatgcaaggggggatggttcgggtattgacttccccgtcgattctactacagaatggatgctgctgagatgatgctatgtatctgggtctcttcccataattttagggttttcgattcgccgctgtgtaccgtgtcatgtttgtgctgttgctgttgttcaggctaaggcgcctgcctgcatgctgctggtagctagagaacagagatttgttgtctctctttttttttggatttgcaaagatttgtagaatctaggtgtttcggtcataaccaatcctgagctaaaacctgcctgtcgttgcttgtagttttttcccaatcgaaacattgcaatttcgattc

SEQ ID NO: 24365 - protein, 82 aa, Panicum virgatum
  misc_feature: Ceres CLONE 1858381-R
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 92 in the 10/666,642 US patent application
  misc_feature: The sequence is a functional homolog of SEQ ID NO 130 in the 10/666,642 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
  misc_feature: The sequence is a functional homolog of SEQ ID NO 1024 in the 10/225,066 US patent application
  misc_feature: The sequence is a functional homolog of SEQ ID NO 2886 in the 10/374,780 US patent application
  misc_feature: The sequence is a functional homolog of SEQ ID NO 434 in the 10/666,642 US patent application
YVALLPSGFAILPDGPPGAPNGEISAGLEAGGGSLLTVAFQILVDSVPTAKLSLGSVATVNSLIACTVERIKAAVCAEGNPQ

SEQ ID NO: 24366 - DNA, 3341 bp, Panicum virgatum
  misc_feature: Ceres CLONE 1858421
  misc_feature: Encodes the peptide sequence at SEQ ID NO. 24367
agggaagctgctgagcctgagtgctgaggagcacccgtcctacagcagcaagaggacgacgaggggaggcgcgaagaaaacccaggccaaacgccccccgagctcacgccgatccgcctcccgcattgcctccaagcctctcgattcggccggacccgtgccgccctgcccgccggagggctcgatctgggcccagatcggcctgcatttcggacccgtgaaggccccggttccggcggtgagggatggggaacgtggacggcgagtacggcgagttccatgcagccaatcggcgtgctgaggtgatagattggcttggtgggttgctgccggagttcgacttgccattggattcttcagatgaggagctgcgggagttcctcatcgacggtaccgcgctctgctacattgcggagaagctcatgcctgatgttcaggagggaatgtggggtggtaacgcatcagaccagaggtcgaatgtgaagaaattcctctctgttgtcgcggagatggggctaccaggattcagcgtcaaggatctggaggagggatcagtatcttctgtagtggagtgtctcttgactctaaaggataatgtgactacaggatcaggtcaaaacatttcaaacaatgttaagacaccccttagaaggagactggaacttcgagaatccgatgggcctataatttcggttgtgacgccagggaaaagatctcccatggaagaaagacagaagggccactgggatctgaagtctcaacaaagaaacaatcttcattcaggacaaaaggtccatgatgctttccaacttaagcggggcccctacactgatcttcctgctgccaaaatttcagagatgatgcatccaagtagtctagataacgcacctactcaatcacttcttagaattgttaatggcattctagatgagagcattgagagaaaaagaggagaaataccaaatcgtgttgtttacttgctaaggaatgttgttcaagagattgagcaccgcattgctattcaagcagatcacataagaaatcaaaatagcatcataaagacacgggaagacaagtaccgttcaaagattaaagcactcgagacattagtaaatggaacaaatgaagaaaatgagatgacagtaaatcggcttgagctaatggaggtagagaaatcaaaaattgatgagaaaagaaaactaggcgaacaagatatggttcggctgatccgggaaaaggagagtgcagagaatacaatagcttctcttcagaaagaaatacagatcttgagtaggatgcatgaacagtaccgtgagagaacggaaacagaagctaggcagatggaggaacacttgacttcgagaattaaagaagccgagtttcttctaatgcaatcaaaaaagaaagctgaagagattgagtctgcttcccaactgaaatctcaactttggagcaggaaggcaaacattttccagagttttatggataatcaaaaaatgtcaattaaggatataaggttatcatctcagtccattaagcaggaaatgtttacccttcaaatgaaatggagggacgaaatatctaacattggacatgatctaaaaggtttagtaggtgctgccaacaattaccataaggttcttgctgaaaatcagaagttatttaatgaagtacaggaactaaaaggtaatatccgagtctattgccgtgtcagaccatttcttcctggtcaagatgggaaaacaactacagttgattatattggtgaaaatggtgagatcctcatcacaaacccattcaaacaagggaaggatgggggtcgaatgttcaagtttaacaaggtgtttaaaacgcatgcttctcaagctgaagtgttctcagacatccagccattgatcagatcagtacttgatggatttaatgtgtgcatttttgcctatggtcaaactggttcaggaaaaacttacacaatgagtggaccgggcacatcgaaagaagattggggtgttaactatcgagccttaaatgacttgttcgacatctctttaagtagaaggaatgctttctcatatgaggtggaagtgcaaatggttgagatttacaacgaacaagtgcgggatcttctatccaataatattgcacaaaaaagacttggaatttggagtacctctcagccgaatggacttgtcgtcccagatgcaagcttacatccagtcaaatcaacatcaggtgtgctagacttgatggaaattggacaatcaaatagagcagttggatcaacagctctgaatgaaaggagcagtcgatctcacagcattctaactgtgcatgttagagggttggatttgaagaatggttctacttctcgaggatgtctccatttgattgatcttgctgggagtgaaagagttgagcgatctgaagcaattggagaaagattaaaagaagcgcagtatataaacaaatccctgtctgcccttggtgatgtgatttttgctttggcacaaaaaaatgcccatgttccgtacagaaacagcaagctgactcaagttctacaaagctctttaggtggacaagcaaagacactgatgtttgttcaaataaatcctgataccgaatcattttcagaaacaatgagcactttgaagtttgctgaaagggtttctggagtcgagttaggtgctgcaagaagtaataaagagggcaaagatataaaggagctgctagaacaggtttcatatctgaaagacacgatatcacggaaagatatggaaattgagcagctcctgaaggagaaatccaaatctccaagttcatcaacagatagaaatgacagtagacaacagatccggcgattatcaggggctgcgggatcaggtgaagccgaatgtgaagataatgtgtctgatgacggctgctcagtagcaggaacagagtattccgttggcggtgcttccgaggcagcagcagatcagatgcagaagaccccatcaaggatagccagactgttcctcacaaagaatgggcagccggcaaactccaagccaaaaccaagggagtttgctctaaaacctccaggaagccaggttacaggagagagtttcttcactgaaaccccccaaaaggcggtagaggaataaagactccagcgtatgtgtcaggcccccaaatgccatttccacgcgtctgtaatctgacgctgacagattgtgctgaaacacaacgggtggtttggtgtagggtatatgtgtatcgctgtaccggaatcacctgtcaacgatctgcgtgagtaatgataatgggcattcatccgattatagacaggctggccatttgatcgg

SEQ ID NO: 24367 - protein, 964 aa, Panicum virgatum
  misc_feature: Ceres CLONE 1858421
  misc_feature (488)..(810): Pfam Name: Kinesin Pfam Description: Kinesin motor domain
  misc_feature (15)..(119): Pfam Name: CH Pfam Description: Calponin homology (CH) domain
  misc_feature: SWISSPROT Homolog: EC 2.7.11.1 Non-specific serine/threonine protein kinase
MGNVDGEYGEFHAANRRAEVIDWLGGLLPEFDLPLDSSDEELREFLIDGTALCYIAEKLMPDVQEGMWGGNASDQRSNVKKFLSVVAEMGLPGFSVKDLEEGSVSSVVECLLTLKDNVTTGSGQNISNNVKTPLRRRLELRESDGPIISVVTPGKRSPMEERQKGHWDLKSQQRNNLHSGQKVHDAFQLKRGPYTDLPAAKISEMMHPSSLDNAPTQSLLRIVNGILDESIERKRGEIPNRVVYLLRNVVQEIEHRIAIQADHIRNQNSIIKTREDKYRSKIKALETLVNGTNEENEMTVNRLELMEVEKSKIDEKRKLGEQDMVRLIREKESAENTIASLQKEIQILSRMHEQYRERTETEARQMEEHLTSRIKEAEFLLMQSKKKAEEIESASQLKSQLWSRKANIFQSFMDNQKMSIKDIRLSSQSIKQEMFTLQMKWRDEISNIGHDLKGLVGAANNYHKVLAENQKLFNEVQELKGNIRVYCRVRPFLPGQDGKTTTVDYIGENGEILITNPFKQGKDGGRMFKFNKVFKTHASQAEVFSDIQPLIRSVLDGFNVCIFAYGQTGSGKTYTMSGPGTSKEDWGVNYRALNDLFDISLSRRNAFSYEVEVQMVEIYNEQVRDLLSNNIAQKRLGIWSTSQPNGLVVPDASLHPVKSTSGVLDLMEIGQSNRAVGSTALNERSSRSHSILTVHVRGLDLKNGSTSRGCLHLIDLAGSERVERSEAIGERLKEAQYINKSLSALGDVIFALAQKNAHVPYRNSKLTQVLQSSLGGQAKTLMFVQINPDTESFSETMSTLKFAERVSGVELGAARSNKEGKDIKELLEQVSYLKDTISRKDMEIEQLLKEKSKSPSSSTDRNDSRQQIRRLSGAAGSGEAECEDNVSDDGCSVAGTEYSVGGASEAAADQMQKTPSRIARLFLTKNGQPANSKPKPREFALKPPGSQVTGESFFTETPQKAVEE

SEQ ID NO: 24368 - DNA, 627 bp, Panicum virgatum
  misc_feature: Ceres CLONE 1858426
  misc_feature: Encodes the peptide sequence at SEQ ID NO. 24369
aaatctgttcggcaccattgctgaagctcacagttcctcgcaaaaaaaaaaaaaaaaagctcacagggtgccatggaaggagcagcacatgacaggccactgattcctcatctaccctcacaggatgaagaaggttcgctttatactagcgatggaacggttgatgttaacaatcagcctgctctgaagcgaaccacggggaactggagagcgtgcttcttgatcttaggtaccgaattcgtcgagtgctttgtcttcttcggagttgcaaagaacctggtcacctttctcacgggtgaactccacgagagcaatgtcgatgccgcgaagaatgtgtctacctggatcggcacttgcttcttcacaccactcatcggagccttcttggccgacacctactggggaaaatactggacactagtaatcttcctctcaatctacaccattggtatgctaacactgacagtctcagcatcattacccctgcttatgggcacaatacacaacaatggcattcgtcatttcacggtgtacctggggctctaccttgtcgcccttggcgaaggtggcattaagccctgcacctctgccctcggtgccgaccagtttgatggcgccgacccggtg

SEQ ID NO: 24369 - protein, 184 aa, Panicum virgatum
  misc_feature: Ceres CLONE 1858426
  misc_feature: Useful for making plants with altered carbon content
  misc_feature: Useful for making plants with altered nitrogen content
MEGAAHDRPLIPHLPSQDEEGSLYTSDGTVDVNNQPALKRTTGNWRACFLILGTEFVECFVFFGVAKNLVTFLTGELHESNVDAAKNVSTWIGTCFFTPLIGAFLADTYWGKYWTLVIFLSIYTIGMLTLTVSASLPLLMGTIHNNGIRHFTVYLGLYLVALGEGGIKPCTSALGADQFDGADP

SEQ ID NO: 24370 - DNA, 1823 bp, Panicum virgatum
  misc_feature: Ceres CLONE 1858428
  misc_feature: Encodes the peptide sequence at SEQ ID NO. 24371
atcctttcatccactgacaaaaccctagctcgttccccacgctcgcctcgccttaaacctcaccctgccgccggccgccatttcgaattcgcaatcgtagaaggcgaagcaaggcgaagcgctgaagcggcggcgcggcgcggcgagcggccaccatggcggagctgaagcggctgtcggagagccgcgacctgacgcggatcgagcgcatcggcgcgcactcccacatccggggcctggggctggactcctccctcgaggcccgcgacgcctcggagggcatggtcgggcagctcccggcgcgccgcgctgcggggctcatcctccagctcatccggcaggggaagattgccggccgtgccgtcctcctcgcgggccagcccggcaccggcaaaaccgcgctcgccatgggcatcgccaagtcgctcggcgccgagacgcccttcgcctccgtcgccgcctccgagctcttctccctcgacctctccaagaccgaggcgctcacgcaggccttccgccgcgccattggcgtccgcatcaaggaggaggccgagatcatcgagggcgaggtcgtcgagatctccatcgaccgccccttatcagccgccgccggctcggccgcaccgtccggtgccactgcgcccggcaagaccgggcggctcacactcaagaccacggacatggagacggtgtacgaacttggggggaagatgattgaggctcttgggaaagagaaggtgcagagcggtgatgtggttgcgcttgacaaggcctccggtaaggttacaaagcttggccgatcgattggtaggtcgcgggattacgatgctgttggcccgcacaccaagtttgtcaagtgtccagagggtgaactccagaagcgcaaggaggtcgtgcattgtgtcaccttacacgagattgatgtcatcaatagcaggacacagggttttcttgcattgtttactggtgatactggtgaaattcgtgcagaggtccgagagcagatcgacacaaaagttgcagagtggagagaggaagggaaggctgagattgttcctggcgttctgtttattgatgaagtgcacatgctggatatcgaatgcttctccttcctaaaccgtgcattggaaaacgatatggctccaatcctagtcattgcaacgaaccgcgggatcacatccattcgggggacaaactaccggtcaccacatgggataccgccagacttcctcgatcgcctcttgatcatcacgacgcagccctactcagaggatgatatccgcaagatcctggacatcaggtgcgacgaggaggatgtggagatgtctgcagacgccaaggtcctgctcacgaagattggcgtggagacctcccttaggtatgctatccacctgatcacctctgctgcgctagcctgccaaaagcgcaagggcaaggtggtggagatggacgatattagccgggtgtaccagctctttctggacgtgaagaggtcgacgcagtacctgatggagtaccagagccagtacctgttcaatgaagtaacaggggaagcggatggaaatgatgccatgcagtcttaaagtgggttggtatgtactggctggtgtattttttatgcttagttcctcgtttagattgatgttaccctgacgtgtggtggatgcagagtagctgctgtaggtgactttacagttcaatatattttttatcaaatttgatcccagctgggattaatgattagtttggattatgcaacctatctatacgtgtatatttgctgtaggtgactaaagtgcttttaaaaaccttcgctttgcagc

SEQ ID NO: 24371 - protein, 475 aa, Panicum virgatum
  misc_feature: Ceres CLONE 1858428
  misc_feature (121)..(444): Pfam Name: TIP49 Pfam Description: TIP49 C-terminus
MAELKRLSESRDLTRIERIGAHSHIRGLGLDSSLEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPLSAAAGSAAPSGATAPGKTGRLTLKTTDMETVYELGGKMIEALGKEKVQSGDVVALDKASGKVTKLGRSIGRSRDYDAVGPHTKFVKCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYSEDDIRKILDIRCDEEDVEMSADAKVLLTKIGVETSLRYAIHLITSAALACQKRKGKVVEMDDISRVYQLFLDVKRSTQYLMEYQSQYLFNEVTGEADGNDAMQS

SEQ ID NO: 24372 - DNA, 684 bp, Panicum virgatum
  misc_feature: Ceres CLONE 1858437
  misc_feature: Encodes the peptide sequence at SEQ ID NO. 24373
atctccctccccccgccccgccccccgtctccccgatcggacacgcgatcccattcccgttctctcgcccagttccagtgctacctcctggaagccgcgccgccaagccgccaaagagcagagcacgcaacagagggagccgggaaggaatggggcggcacggcgtggcccggatcggcgccgcgggggcgcccgcctgggccgccctcctcctgccgccgctgctgctcctgctgcttgcgggcgcccgcgccggccagaccagcgagtaccggcgccacctcggctccgccatcgacatgccgctcgacgccgacgtcttccgcccgccgcccggccacaatgcgcccgagcaggttcacatcacacaagggaaccatgatggcgcagccatgataatctcatgggtgacaacaagtgagcctggctcgagcactgtggtgtacgggacttcagaggacaacctcaactatactgcaaacggaaagcacagtcagtatacgttctacaactatacctcaggatacattcatcattgcacaataaaaaagctggaggtaaccggctcatcgaaattcttataggatgtttccttgttttccccccttatatggaagcctgaatacttatctttgttgcagtttgacacaaagtattactatgctgttggaattggacaaacag

SEQ ID NO: 24373 - protein, 144 aa, Panicum virgatum
  misc_feature: Ceres CLONE 1858437
  misc_feature: SWISSPROT Homolog: EC 3.1.3.2 Acid phosphatase
MGRHGVARIGAAGAPAWAALLLPPLLLLLLAGARAGQTSEYRRHLGSAIDMPLDADVFRPPPGHNAPEQVHITQGNHDGAAMIISWVTTSEPGSSTVVYGTSEDNLNYTANGKHSQYTFYNYTSGYIHHCTIKKLEVTGSSKFL

SEQ ID NO: 24374 - DNA, 1287 bp, Panicum virgatum
  misc_feature: Ceres CLONE 1858443
  misc_feature: Encodes the peptide sequence at SEQ ID NO. 24375
attacaagtgagcacacggaacggaaacccgccaccgccgcttcgccagcgatgatcctccggcggatacatctacatgcctgcgcctcccgccgatccctcgcgcccgccgccctctgcggaacctcaccgcgcgccttgccttctgctggggctggcctcctccgtcgcctccacggcgcggcgggagacggtccttcggattccgagcacggccgcaagccaggtccgcttacgctctacaggaatctagtaagccaagggaaactcacttatgacagctaccaggaaaatgtagcttctgacttagacaacttactcacaagactccaacaatatgagatagaaatggaggattaccatgcgcagctgtacatatgggagaatagcagggagaaagagaggcgaaggcttcttgttgaagaagctgaagataagcagagtgatggtgtatggatagatgagaaaaggggatttcttgacaagttggttacacggagaagaagaggaagcatagaacctggagttgggaagtgggtctcatacctgaaccgagagaagaaattagataaactagttggccagagaccagttgctcctgttgctcctaaaggattgtatctctatggaaatgttggaagtgggaggacaatgttgatggacatgttctatggggccactgaaggtgttatcaaacacaggaggaggtttcacttccatgaggccatgcttgaaatacacgatcatatgcatgatgtatggaagagacgtgatgatgacaaatctgttcagtcaagtgcttttagctggatatcaagcctcccttttgatgcaaaaattaaggaatggctgatcggggaagagaagtacaaacaagagacacagcaaaagcatatccttttggctgttgctgacaagtttttggttgatagacaagcaaataaaactggagcaagcattctatgctttgatgagatacagactattgatgtattcgcagttgtggccctgtctggcattctaagcagattgttaagcacaggaactgtgctggtagcaactagtaataaagcacccgaagatctgaatcaggatgggatgcaaagggacatcttccttgagttattatctaaattagatgaaaattgcaataagattcttgtgggaactgaaaaggattatcgtcgcctaattccaacagaaggctcaactcaggttcactatttttggcctgttacttctgatacttgcagcatgtacgaggctatgtggcatggcataactaac

SEQ ID NO: 24375 - protein, 411 aa, Panicum virgatum
  misc_feature: Ceres CLONE 1858443
  misc_feature (140)..(409): Pfam Name: AFG1_ATPase Pfam Description: AFG1-like ATPase
MILRRIHLHACASRRSLAPAALCGTSPRALPSAGAGLLRRLHGAAGDGPSDSEHGRKPGPLTLYRNLVSQGKLTYDSYQENVASDLDNLLTRLQQYEIEMEDYHAQLYIWENSREKERRRLLVEEAEDKQSDGVWIDEKRGFLDKLVTRRRRGSIEPGVGKWVSYLNREKKLDKLVGQRPVAPVAPKGLYLYGNVGSGRTMLMDMFYGATEGVIKHRRRFHFHEAMLEIHDHMHDVWKRRDDDKSVQSSAFSWISSLPFDAKIKEWLIGEEKYKQETQQKHILLAVADKFLVDRQANKTGASILCFDEIQTIDVFAVVALSGILSRLLSTGTVLVATSNKAPEDLNQDGMQRDIFLELLSKLDENCNKILVGTEKDYRRLIPTEGSTQVHYFWPVTSDTCSMYEAMWHGIT

SEQ ID NO: 24376 - DNA, 650 bp, Panicum virgatum
  misc_feature: Ceres CLONE 1858443-R
gctatgagtatgaagatccgtgacaaggcaagaagttttatcacccttattgatgagctgtacaatcaccactgccgtcttgtatgtctagctgcctcatccattgatgatcttttccaaggaactgaggaaggacccctttttgatttagaaagttttcaatttgaaactgaggccgaggggacaaagctaaggagggatgttttagcagaaggcaatgttggtttgaggtcttctactagtgggcttgtggcaatattgtctggtcaagaagagatgtttgcgttccgcagggcgatatctcggcttatcgagatgcagaccccactgtatctggagcgtgtgcagcatgcccatccctccttccaactgcagggtccggctgtagcaagcaacaataggactcgtgtttctcagtgtgctccatcggtctgacaagaggcagctctgctttctggatgtaccatagttaagtttgtttgccggaacgccgacaattaataagggcaaatctgaaacgatagtaatgctgatacccagcgcccatgtaaatgataagagtaatcacagcccgtggcataaaacatgtatatggggcacagccctttcgttgattgcttagaagaagaaatgcagcagctctctctctt

SEQ ID NO: 24377 - DNA, 2014 bp, Panicum virgatum
  misc_feature: Ceres CLONE 1858447
  misc_feature: Encodes the peptide sequence at SEQ ID NO. 24378
accactggcgtgttcccacctggggccagacgccgccaccgctgaccccgtctacaccgaatccctccccgcgatttaacccctcgcctcgcttcgccgccctcgctctctgcaaccggcacaccaaacgcgcacgcgctgttcgtttctcggccgctttctctgtctctctccccctctacctcgcagatctccgcgggccgtgcggtttcttgattcagccttccccgagctgtcggatctccgcggcggcgggggatgggcaactgctgcgtgacggcggggggagccgccggtgagggcggcggcaagaccaagaagcccaaggagccgaagcagaagaagggcaagaagccgaaccccttctcgatcgagtacaaccgctccgcgccgccgggcgccgcgccgcggctggtggtgctgcgggagcccacggggcgggacatcgcggcgcggtacgagctgggcggggagctcgggcgcggcgagttcggggtcacatacctctgcacggaccgcgactccggggaggcgctggcctgcaagtccatctccaagaagaagctccgcacccccgtcgacgtcgaggacgtgcgccgggaggtggagatcatgcgccacctccccaagcaccccaacatcgtcacgctcagggatacgtacgaggacgacaatgccgtgcacctcgtcatggagctctgcgagggcggggagctcttcgaccggatcgtggcgcgggggcactacacagagcgcgccgccgccttggtcacgcgcaccatcgtcgaggtcgtgcagatgtgccataagcatggagtgatgcacagggatctcaaaccagagaatttcttgtttgcaaacaagaaagaaacagcggccctaaaagcaattgattttggcctgtctgtatttttcactccaggcgaacgattcactgagattgtcggaagcccttattacatggctccagaggtgctaaagaggaactacggcccagaagttgatgtttggagtgcaggagtgattctttacattcttctttgtggcgtccctccattctgggcagaaaccgaacagggtgttgctcaagcaattatccgttctgtcattgattttaaaagagacccatggccaagggtctcagataatgcaaaagatcttgtcaggggaatgctcaatccagatccaaaacgacgattaacagctcagcaagtgctcgatcacccatggttacagaacattaagaaggctccaaatgtcaatttgggtgaaactgttaaggccagacttcaacagttctctgtgatgaacaagktcaagaagcatgcacttagggtcatagctgaacatctttcagtagaagaggctgctgacataaaggacatgtttgaaaagatggatcttaacaaggatcaaatgcttagttttgatgaactgaagcttggtctgcataagtttggtcaccaaatgcctgatgctgatgtccaaatactaatggaagctgcggatgctgatggaaatggatccttggattatggagaatttgttacattatctgtccacctaagaaagattggcaatgatgagcatctgcataaggcatttgcgtactttgaccggaaccagagtgggtatattgaaatcgatgaactccgtgagtcattagctgatgacctgggacaaaatcacgaggaagttatcaatgccattatccgtgatgtagacactgataaggatggcaagatcagctacgatgagtttgcggtgatgatgaaggctggaacggactggaggaaagcctcaagacagtactcaagggagcggttcaccagcctgagcctaaagctgcaaaaggacggatcattgcagatgacaagtacccaatagccgataacacaaataggcaagttgtgaattccagatgaaaaccctgtgtagattcttcaggttgttcgttgacaactatttttttcttctgtttgtcccgatgttcaattgctttctattcttcgct

SEQ ID NO: 24378 - protein, 542 aa, Panicum virgatum
  misc_feature: Ceres CLONE 1858447
  misc_feature (67)..(325): Pfam Name: Pkinase Pfam Description: Protein kinase domain
  misc_feature (480)..(508): Pfam Name: efhand Pfam Description: EF hand
  misc_feature (372)..(400): Pfam Name: efhand Pfam Description: EF hand
  misc_feature (444)..(472): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
  misc_feature (353)..(353): Xaa is any aa, unknown, or other
MGNCCVTAGGAAGEGGGKTKKPKEPKQKKGKKPNPFSIEYNRSAPPGAAPRLVVLREPTGRDIAARYELGGELGRGEFGVTYLCTDRDSGEALACKSISKKKLRTPVDVEDVRREVEIMRHLPKHPNIVTLRDTYEDDNAVHLVMELCEGGELFDRIVARGHYTERAAALVTRTIVEVVQMCHKHGVMHRDLKPENFLFANKKETAALKAIDFGLSVFFTPGERFTEIVGSPYYMAPEVLKRNYGPEVDVWSAGVILYILLCGVPPFWAETEQGVAQAIIRSVIDFKRDPWPRVSDNAKDLVRGMLNPDPKRRLTAQQVLDHPWLQNIKKAPNVNLGETVKARLQQFSVMNKXKKHALRVIAEHLSVEEAADIKDMFEKMDLNKDQMLSFDELKLGLHKFGHQMPDADVQILMEAADADGNGSLDYGEFVTLSVHLRKIGNDEHLHKAFAYFDRNQSGYIEIDELRESLADDLGQNHEEVINAIIRDVDTDKDGKISYDEFAVMMKAGTDWRKASRQYSRERFTSLSLKLQKDGSLQMTSTQ

SEQ ID NO: 24379 - DNA, 2369 bp, Panicum virgatum
  misc_feature: Ceres CLONE 1858473
  misc_feature: Encodes the peptide sequence at SEQ ID NO. 24380
aaccagagttccgatccggttaatcggcgacgaggaagacgacggaggcggcagatctttggggatccgacggcggctgagggggagatggtggtgaacggccggccgctgaagagggcgagggcgcgggtggaggccagggacatcgccgggttcccggcggccggagacggcggggcggccgggacgttcagggaggcggtgagggggttcctcgcaaagcacgcgaggctgctcccgcttccgtccatcttctcgccggcggccgccgccgccccgccgcacctgctgatctggagggtgtccctgagggtcggggaggcgggggaggagaccggcggcggcagggtggagctcaacgtcgttgaggaggatgtgctccgatcgcgatctgtgtattgtgatcagtgcagagtcgtgggatggagtgggcacccagtctgcgggaagcgataccatttcatcatcgagaacgactgcaaccagctcaccggccaccggcgcacctgctgcctgcgctgcgggactcccatggtcgctggagaatcaaggtgtgccctctgcaactttgatatggatggtgaggaagtcgaagagtgtgcatacctgcatctggatgactcctctcacttgctgcacgctgtagtgcatgccaacgggtatgggcacctcctcagggtaaatggccgtgaaggtggctcaagagtcctcactggccgtgacataatgagcttatgggatcgcatgtgcaaggtgttatatgtgaggaaggtcactgtcatggacatctccaagaaacatggaatggactacagacttttgcatgcagtcacaagtgggcacccatggtatggtgaatggggatacaagtttggtgctggcagctttgcactaacctcagacacctaccaaacggcagtagacatgctttccaatatacatctggcactgtacttctccaaccgtagccccatcaggactccactgcagaacacaattgctctttattgggcactctctgatcgccaactggtgaccctacgggaccttttccgcttcattatgcacctgcttcatcaagttcagatgtcaaaaccctcaacttataagcgcatggatcttgcatcttatgtgctttgtgcgtggactaaagacgatcttgatcgagcagaagctgcaatgcttaaggttctccgggttgtgcaaactggacaatgggtatcttggcgtgcacttaggggtgctgcatcaaaggctgttggttcacaggagctgcttgattattctcttcgagaactaggtggaaaacaactggatgatggccattttgttgctgtccgctgcaacgctgagacaaatgcaattgagtacaggctggaatcttcctccattcagtcaccagttgatgcactgatgtttgagccttctgttgaacatctcctgcatgatcttagattcctctacgacgctctgctcaacccagaatccatgctatcttcacaaccagaggtgatgggtgcatcatcacatagtgcagcagcaaagattattgattgcaagcagttcatcaagcattatgacgagcatgctctaaggactccttcaaacccattcttgctctgcgtgccgtgctccattgaactacttgatcacccaaaagactacacagcacctccagaggaacttgtacatgtacctgcaagtgctacccttgctgaactcaaagtgcaggcttcaagggcattccaagagacgtacctcatgttccaaagcttccaggctgaacagctccctgactttccaaacttcagtgatacaacccctgtgaagcatgtgcttggatcaggccagcttgttcggttaaggggacgttgcaccggagattaccggaggattgtacagtttaggatggagaggggtttggagaactggactgtggactgctcatgcggtgccaaggatgatgatggtgaacgtatgctagcatgtgacgtgtgtggagtctggcagcacaccaggtgctcagggatcagtgattttgaagaagtccctgaaaatttcatctgcaggaagtgtgctagcccacgcaaaggtcgccgtggtggtgggggtagcaatggtggtggaagagtggaggttagtgcaggggcagggaactggtgcaaggacgagattggatcatcagttggtggtggcaagtttgggcgcatggcaacagttggatgactgtacataatgtagtgaaatgtaaatagtgagatggagagtagtaagctgcacctaaaggcctttgtggaccttgagtggttaatggatcttgtttatgaccactgatgtgatgtaaatctattctcctctcagttgcaccc

SEQ ID NO: 24380 - protein, 712 aa, Panicum virgatum
  misc_feature: Ceres CLONE 1858473
  misc_feature (618)..(666): Pfam Name: PHD Pfam Description: PHD-finger
MVVNGRPLKRARARVEARDIAGFPAAGDGGAAGTFREAVRGFLAKHARLLPLPSIFSPAAAAAPPHLLIWRVSLRVGEAGEETGGGRVELNVVEEDVLRSRSVYCDQCRVVGWSGHPVCGKRYHFIIENDCNQLTGHRRTCCLRCGTPMVAGESRCALCNFDMDGEEVEECAYLHLDDSSHLLHAVVHANGYGHLLRVNGREGGSRVLTGRDIMSLWDRMCKVLYVRKVTVMDISKKHGMDYRLLHAVTSGHPWYGEWGYKFGAGSFALTSDTYQTAVDMLSNIHLALYFSNRSPIRTPLQNTIALYWALSDRQLVTLRDLFRFIMHLLHQVQMSKPSTYKRMDLASYVLCAWTKDDLDRAEAAMLKVLRVVQTGQWVSWRALRGAASKAVGSQELLDYSLRELGGKQLDDGHFVAVRCNAETNAIEYRLESSSIQSPVDALMFEPSVEHLLHDLRFLYDALLNPESMLSSQPEVMGASSHSAAAKIIDCKQFIKHYDEHALRTPSNPFLLCVPCSIELLDHPKDYTAPPEELVHVPASATLAELKVQASRAFQETYLMFQSFQAEQLPDFPNFSDTTPVKHVLGSGQLVRLRGRCTGDYRRIVQFRMERGLENWTVDCSCGAKDDDGERMLACDVCGVWQHTRCSGISDFEEVPENFICRKCASPRKGRRGGGGSNGGGRVEVSAGAGNWCKDEIGSSVGGGKFGRMATVG

SEQ ID NO: 24381 - DNA, 1384 bp, Panicum virgatum
  misc_feature: Ceres CLONE 1858479
  misc_feature: Encodes the peptide sequence at SEQ ID NO. 24382
agccgcaagcctgcagcgaaaaggaaagcacagcagcacaggcacagcacagcacagcggcggttttcaaaagaacccgccaccgtcccctcaatcccctccctctctctcatctcgaattaatttcgtggtgcctgccaccatcctccatttttcttgggtgcagtgcgagctccaagtacccctgtctccctcccatctcagttggtatagtgtttgcttcaatgcgagacggcgtcgggaggagctgtcctcgacgagcttgattgcccttgaaagcgaagttgttggtgccggactgccggtgaggaggaagaagggagaggatatatggctcccaaggaagaggcaggggaggacgagcggctgctcaaggatcttcctggttcttcagataaggaaggagaggatcaagagaacattaagagcaaccctgatgaaacgaccaaggaggattgtgatatcggtgggtccgtaatggaagccaccaccgtatcgagtgaagatctcaacgataggcatggcagtgacagcaacagccagtgtgctgaatctaatggtgcttgtaaactagtgccagaaatgagctccaagagcatcaagagtgagtgcgccagtgaagtgcctgaaatgggatccaagagcagtaatgatgacaacagtgggagcaccgatgaaatgccaagaattggcaccaagagcaatagcgacgacaacagcgagtgtgctgaccggagctctccacgtgccgtgctagatatgtcggtatctggcagtgtggactctgatgacagtgcctcagttgagcaatcagcagaatcaagccacaatgttcagtggaggaacctcatcagcgggctattacttcggagaaagaagtccatgggaagagcagtgacgttccctcagagatccaagagcagagggcttagagggtatctggagagaatgcggagtggtaagaaccaaatggactgcagtgccattgctcctgagatccttcctgagattgggaagtggagaccatcatggcgaagctttgactatgatgagctttgtgctgcaactgacagatttagtccagaaaaattgatcggcaagggtgggcatgctgaggtatacaaaggacagcttgctgatggacaatttgtcgcagtgaagagattaacaaaaggcggtaacaaagaggacagagttagcgacttcttgtccgagcttggaataatagcccatgttaatcacccaaacgcagcacagctcctggggttcagtgtggaagggggcttgcacttggttcttcagttctcacctcatggaagcctggcttctgttctgcatggtacaaaggaacccctgaagtggaaagtcaggttcaacattgcac

SEQ ID NO: 24382 - protein, 351 aa, Panicum virgatum
  misc_feature: Ceres CLONE 1858479
  misc_feature: SWISSPROT Homolog: EC 2.7.11.1 Non-specific serine/threonine protein kinase
MAPKEEAGEDERLLKDLPGSSDKEGEDQENIKSNPDETTKEDCDIGGSVMEATTVSSEDLNDRHGSDSNSQCAESNGACKLVPEMSSKSIKSECASEVPEMGSKSSNDDNSGSTDEMPRIGTKSNSDDNSECADRSSPRAVLDMSVSGSVDSDDSASVEQSAESSHNVQWRNLISGLLLRRKKSMGRAVTFPQRSKSRGLRGYLERMRSGKNQMDCSAIAPEILPEIGKWRPSWRSFDYDELCAATDRFSPEKLIGKGGHAEVYKGQLADGQFVAVKRLTKGGNKEDRVSDFLSELGIIAHVNHPNAAQLLGFSVEGGLHLVLQFSPHGSLASVLHGTKEPLKWKVRFNIA

SEQ ID NO: 24383 - DNA, 714 bp, Panicum virgatum
  misc_feature: Ceres CLONE 1858479-R
  misc_feature: Encodes the peptide sequence at SEQ ID NO. 24384
cccagaatactttatgcatgggatcataagtgagaagacagatgtgtttgcatatggagttttacttcttgagttagttacagggcggaaagcggtggactcctccagacagagcctagtgatatgggcaaaaccactgcttgatgccaacaacatcaaagagctggtggacccttccctcggcaacgaatatgaccccgaagagatggtgtacaccctagcagtggcatccttgtgcattcaccacagctcaaccacacggccgagtatgaaatcggtggtctgtttcttgaagggagaccggaagtcacttgagctagtgagaaggcctaaagtcgtaaaacccctgatgtttgactcatgtgattcagaagattacacgcgctcaagctacctcaacgatcttaaccggcacaagcagcttgccttggagcagtgaccttgaaattgagtttggacagattcgccgtaattttgtacatcattcaccatctagctacactgtgatcctcccgctttccacataggttttaaagattgtatggattgatgtgagggatcagttatcattcactctctggttgctgatctatgctgtaattttgccctgagttttagcggatgttgcagccctgttatctgtatcaccaggatcgtaatgtcaggtgatgctgccactagcgaccagtttactattcctgaaatggtggtcgg

SEQ ID NO: 24384 - protein, 145 aa, Panicum virgatum
  misc_feature: Ceres CLONE 1858479-R
  misc_feature: SWISSPROT Homolog: EC 2.7.11.1 Non-specific serine/threonine protein kinase
PEYFMHGIISEKTDVFAYGVLLLELVTGRKAVDSSRQSLVIWAKPLLDANNIKELVDPSLGNEYDPEEMVYTLAVASLCIHHSSTTRPSMKSVVCFLKGDRKSLELVRRPKVVKPLMFDSCDSEDYTRSSYLNDLNRHKQLALEQ

SEQ ID NO: 24385 - DNA, 1202 bp, Panicum virgatum
  misc_feature: Ceres CLONE 1858480
  misc_feature: Encodes the peptide sequence at SEQ ID NO. 24386
agaaagcgctcgctcgcgcgacgcgaggagacactcgaagacactggctatcgacacgcaagctcgtcggccgcgacccgcgagcgggcgccaccagagcccaccaccccgcactccaccgcagctagcttagcccccgcgcagctcgttccatccccctcgtccgccggcgccatgtcttcggcggctccgctgctgggctcccgcccagccgacgacggccaccagcaggagcggcggcggtgcccgtcgtggctcggccgcgtggtggacacggaggaggcgtgggcgcagctgcgcttctccgggccgatgatcctcacgaacatgttctactacggcatcccgctagtgtccgtcatgttctccggccacctcggcgacgtccaactcgccggcgccacgctcggcaactcatgggtcaccgtcaccggatacgccttcgtcatcggcctgagcagcggcctggagacgctgtgcgggcaggcctacggcgccgggctgcaccgccggctgggcctgtacctgcagtcgtcgctcatcgtggcggcggcggcgtccgcgctcgtctccgcgctgtgggtgttcacggagccagcgctgctgctcctgcggcaggagccccgggtatcccgcgccgcggccgggttcgtccgcgcccagatcccggggctcttcgccttcgcctccctgcagtgcctgctccggtacctgcagatgcagtccgtcgtcctgccgctcgtcgccttctccgccgcctcgttcgcgctccacgtcgcgctcgcgtacctgctcgtcggcgtgctcggcctcggcgtcgccggcgcgtccgccgccgtctccgccaccttctgggccgcctgcctcatgctgctcgcctacgtgctgcgctccgaggcctgcagcgagacatggaagggcttctccgccgaggcgttcggatacgtgctgcccaccgtgaagctcgccgcgccgtcggccatcatggtctgcttagagtactgggcgtttgagctcctggtcctggtcgccggattgctccccaattccacagtcagcacgtcgctgatcgccatctgcaccagcacggagaccatcgcctacatgatcacgtacgggttcaatgccgctgtcagcacccgggtgtcgaacgagatcggtgcggggaacgtggacaggccaagaacgccgtgtcggtgacg

SEQ ID NO: 24386 - protein, 341 aa, Panicum virgatum
  misc_feature: Ceres CLONE 1858480
  misc_feature (46)..(206): Pfam Name: MatE Pfam Description: MatE
MSSAAPLLGSRPADDGHQQERRRCPSWLGRVVDTEEAWAQLRFSGPMILTNMFYYGIPLVSVMFSGHLGDVQLAGATLGNSWVTVTGYAFVIGLSSGLETLCGQAYGAGLHRRLGLYLQSSLIVAAAASALVSALWVFTEPALLLLRQEPRVSRAAAGFVRAQIPGLFAFASLQCLLRYLQMQSVVLPLVAFSAASFALHVALAYLLVGVLGLGVAGASAAVSATFWAACLMLLAYVLRSEACSETWKGFSAEAFGYVLPTVKLAAPSAIMVCLEYWAFELLVLVAGLLPNSTVSTSLIAICTSTETIAYMITYGFNAAVSTRVSNEIGAGNVDRPRTPCR

SEQ ID NO: 24387 - DNA, 662 bp, Panicum virgatum
  misc_feature: Ceres CLONE 1858480-R
cggcctctccttcgtcctgttcctggcgctctgtcacgacctgtgggcgagcctctacagcgggagcgcggtgatcgtgtcggagttcgccgccatcgcgccgctcctgatagtatccatcgtgctcgactccgcgcagggcgtcctgtcaggcgtgtcgaggggctgcgggtggcagcatctcgcggcgctcaccaacctggtggctttctacctcgtcggcatgccgctggcgatcttcttcgctttcaagctcaagttgtacaccaagggcctgtgggctggcctgatctgcgggctggtgtgccaagcctgctcgctgctggtgatcaccgtccgcaccaagtggtccaagatcgcggaggcgatgcagcaggagaaggccaactacggcgggctcgcatagaatcaagttgctgctggacacgagactagcgccactcccattttacaggatcttctgcggagagaatagcatgcccagtgtcttttccccctcccttttggaaccgacatgcacccagtgtagacggtaaacggtgcgcgagcttaattttgttccatccaggtcggcctggtgttgcaccgttagccgtccattttgtttccactagcgttactaacagcattaataatgttggggcaaatgtaccctattggac

SEQ ID NO: 24388 - DNA, 696 bp, Panicum virgatum
  misc_feature: Ceres CLONE 1858483
  misc_feature: Encodes the peptide sequence at SEQ ID NO. 24389
ttccgcgttctaagccatttctttcgctttccccctcggcgctcgcccaccgttctccacccaccattttctccaccctcctggcctcctcttccttccttgtccacctcgccctcctcctcctcctcctgctgggctgcccatgaacctgtggacggacgacaacgcctccatgatggaggccttcatggcctccgccgacctccccgccttcccctggggggcgccggccgggggcggcgcctcgtcggccgccgccacgccgccgccgccgcaggtgccgccgggcttcaaccaggacacgctgcagcagcgcctgcaggccatgatcgagggctccagggagacctggacctacgccatcttctggcagtcctccgtcgacgccgccaccggcgcctcgctgctcggctggggggacggctactacaagggctgcgacgacgacaagcgcaagcagaggccgctcacgcccgccgcccaggccgagcaggagcaccgcaagcgcgtgctccgcgagctcaactcgctcatctccggcgctgccgccgcccccgacgaggccgtcgaggaggaggtcaccgacaccgagtggttcttccttgtctccatgacgcagtcgttcctcaacggctcgggcctcccggggcaggcgctcttcgccggccagcccacctggatcgcctccggcctctc

SEQ ID NO: 24389 - protein, 184 aa, Panicum virgatum
  misc_feature: Ceres CLONE 1858483
  misc_feature: The sequence is a functional homolog of SEQ ID NO 1238 in the 10/412,699 US patent application
  misc_feature: The sequence is a functional homolog of SEQ ID NO 943 in the 10/374,780 US patent application
  misc_feature: The sequence is a functional homolog of SEQ ID NO 116 in the 10/374,780 US patent application
  misc_feature: The sequence is a functional homolog of SEQ ID NO 386 in the 10/412,699 US patent application
  misc_feature: The sequence is a functional homolog of SEQ ID NO 596 in the 10/225,066 US patent application
  misc_feature: The sequence is a functional homolog of SEQ ID NO 894 in the 11/479,226 US patent application
  misc_feature: The sequence is a functional homolog of SEQ ID NO 184 in the 10/666,642 US patent application
  misc_feature: The sequence is a functional homolog of SEQ ID NO 1842 in the 10/412,699 US patent application
  misc_feature: The sequence is a functional homolog of SEQ ID NO 2082 in the 10/374,780 US patent application
  misc_feature: The sequence is a functional homolog of SEQ ID NO 746 in the 10/412,699 US patent application
MNLWTDDNASMMEAFMASADLPAFPWGAPAGGGASSAAATPPPPQVPPGFNQDTLQQRLQAMIEGSRETWTYAIFWQSSVDAATGASLLGWGDGYYKGCDDDKRKQRPLTPAAQAEQEHRKRVLRELNSLISGAAAAPDEAVEEEVTDTEWFFLVSMTQSFLNGSGLPGQALFAGQPTWIASGL

SEQ ID NO: 24390 - DNA, 470 bp, Panicum virgatum
  misc_feature: Ceres CLONE 1858483-R
ggggcagccagatagggacgatactgttaccgttatcgcaaccggattgtcgccgtcgtcacctccatggtcacaacacaatagctggagagattggcgaggaggaagacgacgatgacgccggtgttgttgtaaactttagaagggaggatggatggtgatccttagctgctgctgctgctgctgctgcggttgctcatcatcttcttgtgttttttgctagtagcgtgttactaattagcaggattgagcaatcagcaggcgtccatccgtccttgttaattacctaccgtattgttatgagctgcggtgatggatcgatcgacgctagcgttggttgaatcagaaactgtatataggaataggatggattgaccgtctttgtaccgggcgcacgatgatgcccagatatgtattttacaccaacaccaggatctcgcctgaaaatggagtcagttttttgatctcgc

SEQ ID NO: 24391 - DNA, 629 bp, Panicum virgatum
  misc_feature: Ceres CLONE 1858498-R
  misc_feature: Encodes the peptide sequence at SEQ ID NO. 24392
ccggtgacaacactggtaggttgttgaaatatgacccaaagagcaatgaagtggaagtcttggttgatggtctagcttttgccaatggcttggctatgagtacggatggcaattacttgctccttgcagaaaccacaacgggcaaaattctaaggttctggatcaagacaccaaaagcttcaacacttgaagaagttgtccagctaccttggtttccggataacatcaagatgagccctagaggagggttctgggttggcctccatgcgaagagagggaagatcgccgagtggtcgatttcttacccttggctaaggcgattgatactaaagttgccgatgcgacatgtccaacgtgcctcctggctcttgaatcggcttggtcgtcaggttatagcgttgaggttgaatgaggatgggaaaacaatggaggcaattagtgttcacggtgctatccaaaagattttcaagtcggttagcgaggtggaagaaagggatggaagcctatggataggttctgttatggccccatttcttggaatatacaagttgtagaagcattcagatgatatgataatatgcatttgcatatatggtagttgtttaatagaggaaaataacagtgtatac

SEQ ID NO: 24392 - protein, 183 aa, Panicum virgatum
  misc_feature: Ceres CLONE 1858498-R
  misc_feature (1)..(57): Pfam Name: Str_synth Pfam Description: Strictosidine synthase
  misc_feature: SWISSPROT Homolog: EC 4.3.3.2 Strictosidine synthase
GDNTGRLLKYDPKSNEVEVLVDGLAFANGLAMSTDGNYLLLAETTTGKILRFWIKTPKASTLEEVVQLPWFPDNIKMSPRGGFWVGLHAKRGKIAEWSISYPWLRRLILKLPMRHVQRASWLLNRLGRQVIALRLNEDGKTMEAISVHGAIQKIFKSVSEVEERDGSLWIGSVMAPFLGIYKL

SEQ ID NO: 24393 - DNA, 620 bp, Panicum virgatum
  misc_feature: Ceres CLONE 1858498
aagccaagcagtggcgcaccggtagcggtagctcacctacaacaaatctgcagcaggcagcagcctgcaccgttgcacagtgctccgaaatttactctgctgcggtgctgcctgctgccttaccttcctcttcagcatcatcagcgtcttcttcttctccagctagtcgcgatgcggacggaggtgctgctgctggccgtgctcgtcgcggccgcggccctcctgtcgtcgctcgactcgcgcaacgacgtgcggctgctggagataggggacggcgacctcgagctggtcccgctcgacggcgccgcggggccggagagcatcatcttcgacaagggcggcgaggggccgttcacgggcgtgtcggacgggagagtcctcaggtggcggccggaggagcggcggtgggaggagcactcctgctcggcgccggagctgtaagttcctttgcccgtctccatccatcatggtagctctctgatgcgctccggctgcaaaatatgcaaagctacagtttcggttgggccgtcaaattaatggtgcgtattacactgatcgtgccatcttccctgctgaaaatgactgaaaaactcatctctccctctctctctccactcttc

SEQ ID NO: 24394 - DNA, 2256 bp, Panicum virgatum
  misc_feature: Ceres CLONE 1858527
  misc_feature: Encodes the peptide sequence at SEQ ID NO. 24395
gtccccgcatatctgaccacatcttcttcccccacctctccccaagctcgctcacctcagctgctggcctcctcctctcccgtccctttccaccgatcgagcttcttctaactgctggtatgctgccttcgtgttcaactcgagccgtcgctttgcaattctttgcatactttcttgcaaaaaaaaatctttgtatgcatgtttcatgtttctgaagctgtacgattgatcttgctgctcttattcggctcatcatccgcacatctgtccatgcatgtcgtcagcttgtgttgtgtagcttctgtttccctggtgtctggtcgatcgatcgtgcgcgcacggattgtctagtggtaggctcttggccctgcgcctacagtacgcccacacatggatcaagggccctgtaaaccctgttctgcagcgacccaccgtgtcgatcattaaccgggcggcgacactctggctgttctggatcaattcgccttcgccttcttggagtaggtaggtagacgcatgttcgacagttctctcccctcttttctgatgcacctcgcactcatctctggcattcaggcagagccgaccagccagctcctgaataaactgaatgtttgctgacctctagtcctgcctctgttcgtcctgctttgctcaccgatcgccggcgtggcgcaggcgaagccgaaatttttctgttatttgctttgcagttttgttttactcctccgttccgttttgtgcttttcgccctttcccctgtgctttgcttcagactttccgtgtaggcgtcagttcttgcatgtctgctaaggatcagcggcctcagtcctcaggtgctctagacttgaaatcccactaccggttgataggtactactaggtggccgctagctccgacctgaaaccctagttcattcagaatatctgatccgtcctagctctgctggccggccaagaacagacgaagcgactgtttcttgtccgatcggcccttttgcatacgatcagtattattgtttcttgtccgaccattggtcgaagcgttggactaacaggcatggcacatggtgccggtgcaggtgcagatctgggttggccttcgtggacaggctgcggcgaaggagctatggagatggccggcgcggcgaacagcccgggcccggcagcggcgcggccgagccggtacgagtcgcagaagcgccgggactggcagacgttcgggcagtacctgcgcaaccaccggccgccgctggagctggcccggtgcagcggcgcgcacgtgctcgagttcctccgctacctggaccagttcggcaagaccaaggtgcacgcgccggggtgccccttcttcggccacccgtcgccgccggcgccgtgcccgtgcccgctcaagcaggcgtggggcagcctcgacgcgctcgttggccgcctccgcgccgccttcgaggagcacggcggccgccccgaggccaatcccttcggggtgcgcgccgtccggctctacctccgcgaggtccgcgacacccaggccaaggcgcgcggcatcgcctacgagaagaagcgccgcaagcgccacccgccggcacacaggcaggccaagcagcagcaggacgccggccagcagcagcagcagcagcactaccacccccaccaccaccaccaggcgtcgcccgccgcggctgcggtgaccgagagtaggcgcgtgctggcggacatggccgagccgctggcgccgcacttcctgatcccgcacgcgcagttcctccacggccacttcctggtgccggtcaccgagccgaccgaccccgccgcgggcatgggcggcggcggcaccggcgaggacttggtgctggcaatggcggccgccgccgaggcgcacgccgccgcggccgggttcttgatgccgctgtccgtgtttcactagctagcttgctgggtccactctccgctgcctctatagctccaggggcagggatgcaaggctaggtaattaggcgtaatcaagcatgcaggttttgctaatggcgatcggcctgatctctgcgcgccgtttggtcgtccatccggcttttggtgtttatgcgcttgcatcaaccgctgctgccttttggttgtattttgggtgcgtggttttgtgtacgcagtgatagaatggctggattagaccgctgtgtgtgtttttctccatgacttggatcttgtgggaatttcatgtactacagctgatctcaatcgacttaacattgttcctggt

SEQ ID NO: 24395 - protein, 265 aa, Panicum virgatum
  misc_feature: Ceres CLONE 1858527
  misc_feature: Useful for making plants with modulated low light sensitivity
  misc_feature: Useful for making plants with modulated nitrogen use efficiency
  misc_feature: Useful for making plants with modulated flowering time
  misc_feature: Useful for making plants with modulated biomass
  misc_feature: Useful for biocontainment applications
MEMAGAANSPGPAAARPSRYESQKRRDWQTFGQYLRNHRPPLELARCSGAHVLEFLRYLDQFGKTKVHAPGCPFFGHPSPPAPCPCPLKQAWGSLDALVGRLRAAFEEHGGRPEANPFGVRAVRLYLREVRDTQAKARGIAYEKKRRKRHPPAHRQAKQQQDAGQQQQQQHYHPHHHHQASPAAAAVTESRRVLADMAEPLAPHFLIPHAQFLHGHFLVPVTEPTDPAAGMGGGGTGEDLVLAMAAAAEAHAAAAGFLMPLSVFH

SEQ ID NO: 24396 - DNA, 665 bp, Panicum virgatum
  misc_feature: Ceres CLONE 1858545
  misc_feature: Encodes the peptide sequence at SEQ ID NO. 24397
atccatatgcttagctcccagccccgcacccatgggcgcctgcttctcctccgcctccgctgcccccgccggcgccgccgagcgccgcccctccaaggagggcgagaagaggcgccgcggcggcgcgtctcccgaaggcgcggcgaaggcggcagcccccgtgcgggcagagttcggctacgagagggacttcgaggcgcgctacgaggtcggccgcctgctcggccacggccagttcggctacaccttcgccgccaccgaccgccagtccggggaccgcgtcgccgtcaagcgcatcgacaaggccaagatgacccgtcctgttgctgtggaggatgtgaaaagagaagtgaagattcttaaagcacttaaaggacatgagaatattgttcacttctataatgcatttgaagatgattcatacgtgtatattgtcatggaactatgtgagggtggtgagctattggaccggattttggcaaaaaaaaatagccgttacagtgagaaagatgctgcagtgatagtgcgccaaatgcttaaagtagctgctgagtgtcatctgcgtgggctagttcaccgagatatgaagcctgaggtcatgtaagactacctattttccttcccagaacttccttctcaaatcaaataaggaggactcaccacta

SEQ ID NO: 24397 - protein, 190 aa, Panicum virgatum
  misc_feature: Ceres CLONE 1858545
  misc_feature (58)..(190): Pfam Name: Pkinase Pfam Description: Protein kinase domain
  misc_feature: SWISSPROT Homolog: EC 2.7.11.1 Non-specific serine/threonine protein kinase
MGACFSSASAAPAGAAERRPSKEGEKRRRGGASPEGAAKAAAPVRAEFGYERDFEARYEVGRLLGHGQFGYTFAATDRQSGDRVAVKRIDKAKMTRPVAVEDVKREVKILKALKGHENIVHFYNAFEDDSYVYIVMELCEGGELLDRILAKKNSRYSEKDAAVIVRQMLKVAAECHLRGLVHRDMKPEVM

SEQ ID NO: 24398 - DNA, 692 bp, Panicum virgatum
  misc_feature: Ceres CLONE 1858548
  misc_feature: Encodes the peptide sequence at SEQ ID NO. 24399
aaagcatttgctgaggttcataaagtccaaactaagaaaagaacctgacgaggtggtcattttcagggatggtacttatatgactttaaaagaggtttttgagagtttggatttaactgggtatgatttgaatgttgatttgctagatgtgcatgcagacaaaagtacgtttcatcgttttgacaaattcaacctaaaatacaatccgtgcggccaaagtaggctcagagagatttttctcaaacaagacaatctcattcaaggccgtttccttgctgagttgacaaagcaagttttcacagatctttctgctagtaaatatcagatggctgaatataggatttcaatctatggaaggaagcaaagtgagtgggaccaacttgcaagttggatagtgaacaatgaattgtacagtgaaaatgttgtctggctggttcagattccacgcttatataatgtgtacaaggaaatgggtattgttacatcatttcaaaatcttcttgacaacattttccttcctctatttgaggttactatcgatccagcttcacacccacagctccatgtcttcctaaagcaggttgtagggttggatctggttgatgatgaaagtaaaccagaaaggcgtccgacaaaacacatgcccacacctgaacaatggaccaatgtgtttaaccctgcattttcgtatt

SEQ ID NO: 24399 - protein, 230 aa, Panicum virgatum
  misc_feature: Ceres CLONE 1858548
  misc_feature (1)..(230): Pfam Name: A_deaminase Pfam Description: Adenosine/AMP deaminase
  misc_feature: SWISSPROT Homolog: EC 3.5.4.6 AMP deaminase
KHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFTDLSASKYQMAEYRISIYGRKQSEWDQLASWIVNNELYSENVVWLVQIPRLYNVYKEMGIVTSFQNLLDNIFLPLFEVTIDPASHPQLHVFLKQVVGLDLVDDESKPERRPTKHMPTPEQWTNVFNPAFSY

SEQ ID NO: 24400 - DNA, 2159 bp, Panicum virgatum
  misc_feature: Ceres CLONE 1858553
  misc_feature: Encodes the peptide sequence at SEQ ID NO. 24401
atcacgagtagcggcgtctccccgtccctgagcaggctgcggaggcggccatcatcacgccgactcgccgaggtctccttgccgtcggcgccaataaaagcgagaggagccctcccgctctggaaaccgccagccagcccgttcccacccgtttccccagctcgccccccacctcaattccacccccgcggcgaggtccgtcgccgcggggcgcgcccaacccaaaaccctagctccgccgacgatcccgagtcctcgtcgccgcgcgctgcccggcctcccgcccgcccgcggctccttcgccgcttgtctcggggggtagggggcggcacgtcctcgcggatgcgcgcggcctgctcgtggaccacgacgacatcccgctcgcgcgccgcgggtcctccatggacgggcccgaaggcgtgagggggaaggaggaggcggcgccgggccgcgaggctggcgacgccgaggaggcgggggacgggttccagctcgtgacgcatggcaagaagaagaagagggccagtggtcaggagggtgggggcgctggctccggcgccgtcctcggtgccgggtcggtgggggcgttgaccaaggacaagggagccgcgccggggacgaagccgaaggtgcccttccacgatccaagcattccccggccgcaggatgtgtacaaaatcagagtggataactacaaaccgttcgagcatgtctggctggagcgcagcgaggatggcacccgacctgttcacccgctggaaaaactgcctgttgaacacttcgtcgacagaaatgtccctgaatgtgaaccagtgaagccagctgatatagaggatacaccatttacgctggttgaagatcacaaaggcttgatggaattagctaaaaagctgaagagtgtaactgaatttgctgtagatttggagcacaatcaatataggtcatttcagggtttgacctgcttgatgcagatttcaaccagaagagaagacttcattgtggacactcttaagcttcgcatatacatcggtctctacttgcaagaaccttttaaagatccaaccaagagaaaggtaatgcatggtgtggatcgtgatataatgtggctccaacgggatttccacatctatgtatgcaatctttttgacacaggacaggcttctagggtcttacagatggagagaaacagcctagagcacctattgcttcacttttgtggagtgacagcaaagaaggaatatcaaaatgcagactggaggtcgaggccacttcctgaagaaatgatcaagtatgctagagaagatacacactatctgctgtacatatatgacttaatgaaacagagactacaaagggagtcgacacctgaaaatgatcttcttctagaggttcataagcgcagtaatgaaatttgcttacagttctatgaaaaggagctgctgacagatacatcctatctccatatatatgggttgcaggaacatgagttgaatgcaaaacagctggctgttgttgctgctctacatgggtggagagatcgtatagctcgtcaagaagatgagagcactggttatgtattaccaaataaggctttaattgagatagcaaagcagatgcctacagataatgggcatttaaaaagaatagtaaaatcaaaatatccatttgttgagagcagtctcgatgaaatcatatacaccatttggaatgcgcttgaatattcttacgcatttgaaggaatagctgagcaactaaagaaggaacggttggaacagttggcattgaagagtgttccggccagtgatgaaacaactattttggatgctgagagtgataggagtaatattgatccagcctgtcagtcttctgtggctccttcatcaactgcaaatgtcaatgttgcttctgacggtggggctggttttatgaacgaaacagctttgatcagcagcatccacctagaggacaatactcagaccatatcatcaactaagatcttcgagaccttgccagggctgaccagaccaattaataaggatgccctgagcaataatagatatcagcaggctactgaagaacttaagagacccactttaggagctttgggaaattcagcacctggaagacagacagagaattttggagggttttcaaacgag

SEQ ID NO: 24401 - protein, 585 aa, Panicum virgatum
  misc_feature: Ceres CLONE 1858553
  misc_feature (148)..(317): Pfam Name: 3_5_exonuc Pfam Description: 3'-5' exonuclease
  misc_feature (367)..(436): Pfam Name: HRDC Pfam Description: HRDC domain
  misc_feature: SWISSPROT Homolog: EC 3.1.13.5 Ribonuclease D
MDGPEGVRGKEEAAPGREAGDAEEAGDGFQLVTHGKKKKRASGQEGGGAGSGAVLGAGSVGALTKDKGAAPGTKPKVPFHDPSIPRPQDVYKIRVDNYKPFEHVWLERSEDGTRPVHPLEKLPVEHFVDRNVPECEPVKPADIEDTPFTLVEDHKGLMELAKKLKSVTEFAVDLEHNQYRSFQGLTCLMQISTRREDFIVDTLKLRIYIGLYLQEPFKDPTKRKVMHGVDRDIMWLQRDFHIYVCNLFDTGQASRVLQMERNSLEHLLLHFCGVTAKKEYQNADWRSRPLPEEMIKYAREDTHYLLYIYDLMKQRLQRESTPENDLLLEVHKRSNEICLQFYEKELLTDTSYLHIYGLQEHELNAKQLAVVAALHGWRDRIARQEDESTGYVLPNKALIEIAKQMPTDNGHLKRIVKSKYPFVESSLDEIIYTIWNALEYSYAFEGIAEQLKKERLEQLALKSVPASDETTILDAESDRSNIDPACQSSVAPSSTANVNVASDGGAGFMNETALISSIHLEDNTQTISSTKIFETLPGLTRPINKDALSNNRYQQATEELKRPTLGALGNSAPGRQTENFGGFSN

SEQ ID NO: 24402 - DNA, 733 bp, Panicum virgatum
  misc_feature: Ceres CLONE 1858553-R
tgcttccttaccagcagttctctggtgggatgaaacattcagctgctattggccccacagaatcattttatccaaatactggaatacagagtgacaatgcttggattcaatcaactcagatgaatgaagcgatgcagctgggcaatgcgacttactacacacagtttccggggtatagcactgaagttgtagggagccaatatgaacctgagggcatgcagatgtccagctacctgtctggttttgagcctgcctttcaatcagtaagccaaagtccgggaacaggagtacctcctggtagaaataaggaaggaagtttccagaatccgatgagacgacaatcttacccgccttctggtaacagatatgatagaccataccagtaaccgctctgatgtatagcagaagtaaaggaaagatggtcacgccacattgatccttcctgtgcagaaattgtctgtgtagagaacaaaaacttgggctgttttagttgccctctgaatgcctccctggattttcggcatcccactaactcaaaggtgagaaaccaaacattgacagtagatgcagggtatgggaattgccatcacattggctcatgtaacaggactaacaaacatgtgttgtggttcactggtgaatatcggctttgcacaaagtggtatactgtaatactggtaaagtgtagctcctgaatacagaagaccttgaacacaaacagctttgttctgtc

SEQ ID NO: 24403 - DNA, 662 bp, Panicum virgatum
  misc_feature: Ceres CLONE 1858556
  misc_feature: Encodes the peptide sequence at SEQ ID NO. 24404
acacacggctccgccacggccactgccggccgcctgctccgagcctcacccatcccgtaggcggcggcggcggcggcatcagcagcggaggagaaaaggccttctggctgcggaagccagcggaccagccacgcgcccccctccgatccgcgagacgcttccctccaaattcccaaaaaagcacgcgcgcgcggcgccatggcggagcgcctcgccgcctccctcctcccagcggcctccccctccccgtcggcccgccgcgccacggtcggggccgcggccgccgcgtccttcccttgctcgtgccccgcccgcgcggggctgcgcctccgctcctcctcccgtggcccggcccgcttctccaaggcagccggccgcggcggcgcgctgcgggtggtccggtgcatggcggcgtcggacgcggcgcagctcaagggcgcgcgggaggacatcagggagctcctcaagaccacgtactgccacccgatcatggtccgtcttgggtggcatgattctggtacgtatgacaagaatattgaggagtggccccagcgaggcggagctgatggaagcttaaggtttcaacctgagttgaatcatggagccaatgcaggtctgattaatgctttgaagcttatccaacctatcaaggacaaataccc

SEQ ID NO: 24404 - protein, 154 aa, Panicum virgatum
  misc_feature: Ceres CLONE 1858556
  misc_feature: SWISSPROT Homolog: EC 1.11.1.11 L-ascorbate peroxidase
MAERLAASLLPAASPSPSARRATVGAAAAASFPCSCPARAGLRLRSSSRGPARFSKAAGRGGALRVVRCMAASDAAQLKGAREDIRELLKTTYCHPIMVRLGWHDSGTYDKNIEEWPQRGGADGSLRFQPELNHGANAGLINALKLIQPIKDKY

SEQ ID NO: 24405 - DNA, 662 bp, Panicum virgatum
  misc_feature: Ceres CLONE 1858560
  misc_feature: Encodes the peptide sequence at SEQ ID NO. 24406
acccagagctctgtagaagaagcggcgagggggcgaaccggagccactcagccgccacctcaccgcgccacgccgctcctgctcgccgccgcccgctgctctcgccatttcagctgcagcgctcgccgccgccgcagggccgcagcgcctctcctcctccgcccgcctgccggctgccttccggatgagaagcggcgcaaccggggcggcggaagcgtggtcggcgtgaggcttcgtcggagtccgtgaacgcgccgacaaggatcctggagatcaagcgcatgggttccttggaggcccggtaccggccggccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtctctactgccaacattccatgggaagatgtatataaaagtattcaaaaactgaatggtggtgaacaaaagctcaaagttgcactcctg

SEQ ID NO: 24406 - protein, 126 aa, Panicum virgatum
  misc_feature: Ceres CLONE 1858560
  misc_feature: Useful for making plants with altered carbohydrate content
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIPWEDVYKSIQKLNGGEQKLKVAL

SEQ ID NO: 24407 - DNA, 1340 bp, Panicum virgatum
  misc_feature: Ceres CLONE 1858569
  misc_feature: Encodes the peptide sequence at SEQ ID NO. 24408
actgcccaaacccccgttaaaatcccgcaccagccagcccgcgataccgaggacgatgacgaccgagcaaacccacgcccacgcccccacccccaccccctccccactcggctccacctccgcctcggcgagcgagatgcgggacggcgcggcggcggtgaaggcggggagccggccgccgtggctggggctgggcgcggcggtgtggctgcaggtggcgggcggcggcagctccacgttcgcgctctactcgcacgcgctcaaggtcgcgctcggcgccgaccagcgccgcctcgcgctgctcggggtcgcctgcgacgtcggcgagaacctgggcctgctccccggggtgctctgcaaccgcctccacccggcgctgctgctcctcgtcggcgcgggggcgtgcctgctcgggtacggcgccgcctggctcctcgtctccggcgccgcgcccgcgctgccgtactggctgatatggtttgcattaactctttctgcgaacggtggtgcatggttggggactgctgttctcgtgaccaacatgcggaacttcccactcagcagaggtgctgttgctgggattcttaaagggtactctggtttaagtgctgctgtctacactgaaatatacactggagtgcttggtgattcacccaccaaacttttgctctttctcactctgggaattcctgctatatgccttctgacaatgtacttcgttcgtccttgtgcaccctctctggtagagaccaacgcagagcaagtccattttatgtttgtgcaaatggcgagtgttgttcttgggatttatctggttggggctacgctattggatcatgtggtgactctcaatgagattataaactattctctgcttgccattatggttcttctcatttttgctcccctggcaataccattgaagatgacattattcccaaggagcaaaaatccagcaactgataatgatcagaaagaatcacttttgccttcttcctctgaatcaaaccttaattttgaggatgaagattcttttgatatcgacattcttttagctgagggtgaaggggctataaagccagagagaaggagaccaagaagaggagaagatttcaggtttcgtgaagctattctgaaggcagatttctggcttctctttgcaatatattttgttggggttggatctggaatcactgtgctcaataatctagcacaaataggaatcgcagcgggtgctgtcgacacaaccatctcactatccgtcttcagcttctgcaatttttttggacgcttgggaggtggtgctgtttctgagtatcttgtcagggcaaggacacttt

SEQ ID NO: 24408 - protein, 401 aa, Panicum virgatum
  misc_feature: Ceres CLONE 1858569
  misc_feature (15)..(262): Pfam Name: Nodulin-like Pfam Description: Nodulin-like
MRDGAAAVKAGSRPPWLGLGAAVWLQVAGGGSSTFALYSHALKVALGADQRRLALLGVACDVGENLGLLPGVLCNRLHPALLLLVGAGACLLGYGAAWLLVSGAAPALPYWLIWFALTLSANGGAWLGTAVLVTNMRNFPLSRGAVAGILKGYSGLSAAVYTEIYTGVLGDSPTKLLLFLTLGIPAICLLTMYFVRPCAPSLVETNAEQVHFMFVQMASVVLGIYLVGATLLDHVVTLNEIINYSLLAIMVLLIFAPLAIPLKMTLFPRSKNPATDNDQKESLLPSSSESNLNFEDEDSFDIDILLAEGEGAIKPERRRPRRGEDFRFREAILKADFWLLFAIYFVGVGSGITVLNNLAQIGIAAGAVDTTISLSVFSFCNFFGRLGGGAVSEYLVRARTL

SEQ ID NO: 24409 - DNA, 694 bp, Panicum virgatum
  misc_feature: Ceres CLONE 1858569-R
cacttcatgtctccgtcgccttactcggcgtatgctatggtgtccaattctccgtgataatctcaacctcatcggagctgtttggactgaagcactttggaaagatatacaacttcattgcgctggcaaatccagttggtgcgttcctgttcaacacccttgcagggtatgtctatgatctcgaagtggagagacagaaagctggagtggtagacacagatatcgcgtgccatggccctaattgcttcagactcacattttatgtcttctctggcgcggcttggttgggcacattgctgagcacggttcttacagtgagggtccagccagtgtatcagatgctctacgcaggtggatcctttagccagccgaggaactctggacattgatcaaaggtgatacgagctgtagtgttttctgcatctccgctaaatccagtattcagttctgaacagcttcattaatgatctattgtaattcatgagaacgcaccccatatttgcgctgccttgtaattttgggtctagtttggtgtaagatgaggaaggagagatggttctgtgcagttacttgtacgagacgctcgcgctgctgttctaggttaacgcgctgaggcaagaattctagggtgtacaataattggaactcctccttgtgtagaataataaagcttatatatgacacgtttatgcgg

SEQ ID NO: 24410 - DNA, 652 bp, Panicum virgatum
  misc_feature: Ceres CLONE 1858582
  misc_feature: Encodes the peptide sequence at SEQ ID NO. 24411
attgcatcgcgtcctcctccacaccctgccttccgtagcttccacacaagcgcgtcgttctttctcctttctctgtcgccgggaaagcgccgccgccgccgcgcgccctcgcttgcgtcccgttccctcgggggcccgatccggcaaaggcccgaccttccatggccatcgcctcccgcgtctcgaagcgcgcgctgtccaccttcgccgccgccaagctcccggaggcggtcgccgccgcggaaccgctgccgccggccgcgccggcgccgtgcgagagggccgccggcagggtgctggggttcgaggacaccgggcggctgttcgccggggagcccacgtcggcgctcgtgcgcacgctcgccgcgctgcaggcgctctccgtggggccgcttgtcgacgccgcgaccgccgcgctgcggtcgccggcggtggccggcagcgcgctcggccgcgccgccgccaaggccacggcgtaccgccacttctgcgccggcgagaacgcggacgaggccgcggcagtcgtgcgccggctctggcgcggcggcatgggcgggatccttgactacagcatcgaggacgccgaggacggccacgcctgcgaccgcaacgccgtcgggttcatcgccgccgtcaacgtcgccgcctcgct

SEQ ID NO: 24411 - protein, 163 aa, Panicum virgatum
  misc_feature: Ceres CLONE 1858582
  misc_feature: SWISSPROT Homolog: EC 1.5.99.8 Proline dehydrogenase
MAIASRVSKRALSTFAAAKLPEAVAAAEPLPPAAPAPCERAAGRVLGFEDTGRLFAGEPTSALVRTLAALQALSVGPLVDAATAALRSPAVAGSALGRAAAKATAYRHFCAGENADEAAAVVRRLWRGGMGGILDYSIEDAEDGHACDRNAVGFIAAVNVAAS

SEQ ID NO: 24412 - DNA, 488 bp, Panicum virgatum
  misc_feature: Ceres CLONE 1858602
  misc_feature: Encodes the peptide sequence at SEQ ID NO. 24413
ctactgcccaggttgtcctcgccggcgacttgtgcgcggcctttgttttctccggccaggcggccacaccacaccacaagcgcaggcacagagaggccccggagaagatgcatctgagcgcgaacgaggggatcgagggcgtgcgggtcgcggcgaaccggcgggcagggcttcctcggcgccgccctcttccctgagctgcgcccccgcggcgcgagaggggagggtccggtccctcgacctccgcgccgcctcctcctggtcccagcagctcctcgacgccggcgtccgcatcatccaaggggacattaaaaagaaggatgatgtggggagggctttatgcggagtggactgtgttttccaccttgcttcttatggcatgtccggaaaggaaatggtgcaggctggtagagctgacgaggttaatataaacgggacctgcaatgtactcgacgcttgccatgagcatggtgacaaaaggcttgtgt

SEQ ID NO: 24413 - protein, 162 aa, Panicum virgatum
  misc_feature: Ceres CLONE 1858602
  misc_feature: SWISSPROT Homolog: EC 1.1.1.170 Sterol-4-alpha-carboxylate 3-dehydrogenase (decarboxylating)
YCPGCPRRRLVRGLCFLRPGGHTTPQAQAQRGPGEDASERERGDRGRAGRGEPAGRASSAPPSSLSCAPAAREGRVRSLDLRAASSWSQQLLDAGVRIIQGDIKKKDDVGRALCGVDCVFHLASYGMSGKEMVQAGRADEVNINGTCNVLDACHEHGDKRLV

SEQ ID NO: 24414 - DNA, 672 bp, Panicum virgatum
  misc_feature: Ceres CLONE 1858606
  misc_feature: Encodes the peptide sequence at SEQ ID NO. 24415
aaacgtcgcgacgctgctgatttcggccggctacaagaaagagcctcgacaaaatagctagttgccggaatcccggagtcacgagtcggagatcggagctcgaaacagggccggaagaactcacacagctgcatgcccgcatacataacaggcgcgtttagaccaaacaacaagcaagcctgtgtacaaggagcaaacatggcgttgagaggcttggcaacagcgctgctcctaatcaacttgtcctcttgttatctctctactccatccttcgccacctctgatggcttcatccagtgcctgacgcagaagatacccagtgagctgatcgtcacgccgggctccagtaacttcaccagcgtgcttgtctcaaccagcaagaactccaacttcttaaccaatgccacggtgaagccgatttgcatcgtcaccgtgacagacgcctcccacgtgcagaccgccgtggtgtgcgggcgtcagaacggcgtgcgcctccgcgtgcgcagcggcgggcacgactacgagggcctgtcctaccggtcggcgcgggccgaggtgttcgcggtggtcgacctcgccaacctccgcgccatcaccgtgtccaccgacgaggagtgtgggccgactgtgtgggtcgactccggcgccaccgtcggccacctctactacacc

SEQ ID NO: 24415 - protein, 157 aa, Panicum virgatum
  misc_feature: Ceres CLONE 1858606
  misc_feature: SWISSPROT Homolog: EC 1.21.3.3 Reticuline oxidase
MALRGLATALLLINLSSCYLSTPSFATSDGFIQCLTQKIPSELIVTPGSSNFTSVLVSTSKNSNFLTNATVKPICIVTVTDASHVQTAVVCGRQNGVRLRVRSGGHDYEGLSYRSARAEVFAVVDLANLRAITVSTDEECGPTVWVDSGATVGHLYY

SEQ ID NO: 24416 - DNA, 722 bp, Panicum virgatum
  misc_feature: Ceres CLONE 1858613
  misc_feature: Encodes the peptide sequence at SEQ ID NO. 24417
aacacaccaaacgcacatcgcggccagcgcaagtgcagagagctagacaacctcccaccagcttctcttcttcttcttctccaagcctgaaccagatccttcaagagcaggcttgcggcttgccggggtcgatcgatcgcagccgccatggtgctctccaaggccgtctccgagagtgacatgtccgtgcactccacgttcgcgtcccgctacgtccgctcctcgctcccgaggtaccgcatgccggagaactcgatccccaaggaggcggcgtaccagatcatcaacgacgagctgatgctggacgggaacccgcgcctgaacctggcgtccttcgtcaccacctggatggagcccgagtgcgacaagctcatcatggccgccatcaacaagaactacgtcgacatggacgagtaccccgtcaccaccgagctccagaaccggtgcgtgaacatgatcgcgcatctcttcaacgcgccgctgggcgagtccgagacggcggtgggcgtcggcacggtgggctcgtcggaggccatcatgctggccgggctggccttcaagcgccggtggcagaacaagcgcaaggccgagggcaagcccttcgacaagcccaacatcgtcaccggcgccaacgtccaggtttgctgggaaaagttcgcgaggtacttcgaggtggagctccgggaggtgaagctgcgcgacggctactacgtgatggaccc

SEQ ID NO: 24417 - protein, 191 aa, Panicum virgatum
  misc_feature: Ceres CLONE 1858613
  misc_feature (33)..(191): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRKAEGKPFDKPNIVTGANVQVCWEKFARYFEVELREVKLRDGYYVMD

SEQ ID NO: 24418 - DNA, 674 bp, Panicum virgatum
  misc_feature: Ceres CLONE 1858629
  misc_feature: Encodes the peptide sequence at SEQ ID NO. 24419
tactattacatgttacactgaagtacttcgtatagatcctacagcagctgatgcactagttaatagagggaatacattcaaggagattggtagagttaatgaagcaattcaggattatattcaggctgcacggatcagaccaaacatggcagaagcccatgccaacttggcctcagcttacaaggatagtgggcacgtagagacagctataattagctacaaacaggctctacagctgcgtcctgattttcctgaggcaacctgcaatcttcttcataccttacagtgtgtctgtgactgggaaaacagggatgccatgttctgtgatgttgaagaaattataagaaggcaaataaggatgtcagtacttccaagtgtgcaacctttccatgcaattgcttatcctatcgatccaatgcttgcgctggaaataagccgtaagtatgcagctcattgttccttgattgcttctcgttttgggctcccgccttttgtgcatccatcacctgttcctgtaaaagtggagggtaaacactgccgacttagggtgggatatgtgagtagtgatttcggaaatcatcccctctcccatctcatgggttcagtatttggaatgcatgatcgtgacaatatcgaggtcttttgctatgcactgagtcaaaacgatggtactg

SEQ ID NO: 24419 - protein, 224 aa, Panicum virgatum
  misc_feature: Ceres CLONE 1858629
  misc_feature (16)..(49): Pfam Name: TPR_1 Pfam Description: Tetratricopeptide repeat
  misc_feature (50)..(83): Pfam Name: TPR_1 Pfam Description: Tetratricopeptide repeat
TITCYTEVLRIDPTAADALVNRGNTFKEIGRVNEAIQDYIQAARIRPNMAEAHANLASAYKDSGHVETAIISYKQALQLRPDFPEATCNLLHTLQCVCDWENRDAMFCDVEEIIRRQIRMSVLPSVQPFHAIAYPIDPMLALEISRKYAAHCSLIASRFGLPPFVHPSPVPVKVEGKHCRLRVGYVSSDFGNHPLSHLMGSVFGMHDRDNIEVFCYALSQNDGT

SEQ ID NO: 24420 - DNA, 1761 bp, Panicum virgatum
  misc_feature: Ceres CLONE 1858640
  misc_feature: Encodes the peptide sequence at SEQ ID NO. 24421
gtccagttccgcgatccacacgaccccgtccgcctcggcctgcgcccgcccgcccgcccgcctctcgctacaagaatccgcccgcccgcgccgcggtcccagcgagtccctccctgcggtgcggagatcctgcgcccgaggacgagagcggaaccgagccggcggcgttcgcgggggagatcggatatggaggccgcggccgtgggtgcgggcggcgcggggctgaccaggtggcaagcggcggcgctgtcggcggtgggcgggtgggtctgggcggcctcgttctacgacctcacgcgccgggcgcgcgcgctggtccagccgtgggtcacgcgccgagtgcacgccgagacgacggccatcctcaggttccagaggttgcagcacaagttgctggacaatttcttctctgtgctatcctgcgttgtctctgttcccttctacacgggattcctccctctcctcttctggagtggacacggcaagctggctaggcagatgaccctcctcatggctttctgtgattacctcggcaactctgtcaaggatatagtgtcagctcctcgtccatgctctcctcctgtaagaagagtaacagctacagaagatgagaaggaaaacgccatggaatatgggctgccatcatcacatgctctcaatactgtttgtctgatgggatatctattacattatgtcctcgcatatggagaacatggcagtgttatggttgctgcgggtttatctctagctgtcttgcttgttatgctagttggcattgcaaggatatatttgggtatgcacagcttgactgatgttattgctgggattggttttggctttgtcatcctttcattctggttggctgtccatgaccatgttgacgccttcgttgtgtctggacaaaacgttgcatccttctgggcaggcctctctctattgatgtgctttgcatacccgaagccagaattcccaactcctagctttgaataccatacagcattcaacggagtcgcttttggaattgtctacggcatccagcaaacctacttccatttccacacccctgacgcccccctcgtcttcagcccgcaattgcccctgctcgcattcgccgggcgcgtccttgtcgggataccgaccatcctggtcatgaagttctgcagcaaggcactgtccaaatggctgctgcccgtcatgtgcagcaccctgggcatccccattgtatcatcttgctatgttcctgccctgaaagttgacaacagcaagagcaagcctgacgtgaagcaaggtgtcgggtacctccagagggtgttctccctcttcccccagaaggcatacgacgtggacacaggcatcaggttcgtccagtacgccagcctcgcgtggtccgtggtcgacctggtgccggccatattcacccatctgaatttgtagcccaggtactcaataacctaccagggtgcagtttcgtttttagtctttctcgagctcccaatggggtgttcctgctcgtaaggcatggatcatcttatgaggctgtaaatccaatgatctctccctcgtcattttgtattctatgattgcctaggtgttttcgccatggggtgatgtttctgtagaggttgagtagtagtaagcaggaagtattaatgtgtcgctatcactattattgttccatgacaagtggccactatagtgccacgtctaacactgcagcgaattctgattcttgaccgcaaagaatgcctttccttgccttgc

SEQ ID NO: 24421 - protein, 415 aa, Panicum virgatum
  misc_feature: Ceres CLONE 1858640
  misc_feature (101)..(233): Pfam Name: PAP2 Pfam Description: PAP2 superfamily
MEAAAVGAGGAGLTRWQAAALSAVGGWVWAASFYDLTRRARALVQPWVTRRVHAETTAILRFQRLQHKLLDNFFSVLSCVVSVPFYTGFLPLLFWSGHGKLARQMTLLMAFCDYLGNSVKDIVSAPRPCSPPVRRVTATEDEKENAMEYGLPSSHALNTVCLMGYLLHYVLAYGEHGSVMVAAGLSLAVLLVMLVGIARIYLGMHSLTDVIAGIGFGFVILSFWLAVHDHVDAFVVSGQNVASFWAGLSLLMCFAYPKPEFPTPSFEYHTAFNGVAFGIVYGIQQTYFHFHTPDAPLVFSPQLPLLAFAGRVLVGIPTILVMKFCSKALSKWLLPVMCSTLGIPIVSSCYVPALKVDNSKSKPDVKQGVGYLQRVFSLFPQKAYDVDTGIRFVQYASLAWSVVDLVPAIFTHLNL

SEQ ID NO: 24422 - DNA, 690 bp, Panicum virgatum
  misc_feature: Ceres CLONE 1858646
  misc_feature: Encodes the peptide sequence at SEQ ID NO. 24423
atactcacccccacaccacgaatccgcagtccacccgcagcccgtctccgccctcgcgaaagctcgccgctgctgcgtcccggcgccccgtggcggcacggcactcggggggaaaggcggtaggcggagaggcttcggcgagccttcgggaggaggcggttcttggtgccgtctctgcagcggggccggggataattgataagggcgcgggcgtgctcttcagtcttgactcgccggggctgtcgcggcggctggattggattcggttcgtcctctccggtcacggcggcggcggttcaggacatggtagaagtcaatgagcatcagtataatgcttgtgttgatatcataagtgcaagctgaagttatcgagctgacagcactactgcagatataatactttgagaatctcaaatgagttgcttttctatcttttgcaagaagagaaggacaaggcgcctaccaagttcccaccataatgaagacgtccctggtggcccaaatataaaaagatacacttatagggagctagtaagggcaacagaaaactttagcccatcaaacaagattggtgagggtggttttggttcggtatacaagggacagctcaagaatggaacaattattgctgtcaaggttctttcgtcagagtcaagacaaggagtaagggagtttcagaatgaacttgtg

SEQ ID NO: 24423 - protein, 91 aa, Panicum virgatum
  misc_feature: Ceres CLONE 1858646
  misc_feature: SWISSPROT Homolog: EC 2.7.11.1 Non-specific serine/threonine protein kinase
MSCFSIFCKKRRTRRLPSSHHNEDVPGGPNIKRYTYRELVRATENFSPSNKIGEGGFGSVYKGQLKNGTIIAVKVLSSESRQGVREFQNEL

SEQ ID NO: 24424 - DNA, 2188 bp, Panicum virgatum
  misc_feature: Ceres CLONE 1858648
  misc_feature: Encodes the peptide sequence at SEQ ID NO. 24425
acgctccattattcctcccttctctcctccctcccctcccccaccgccccacgctcctcttcctccgccgccgccgtcgccggcgacctccggagccgcgtggagaaactctccggtgagattcgttttccgtcagcgcgggtagagatcaaagcttgagcgtggtgagtgtgccagccaaggcgtggctgcattcggcctcctgctccctcatccacgcgcgcccacggccttcctgcaaggctggctctggaggctcaacctaggctcccagctcgccaccgccagcttttcgtgccgccgccgcacagtcactccctccctcagccggatcctcggtccactgccaccgccggcgcggagctcctccctcggtccggtggagtggcgtcgggtggagatccgtcctgccgaggagtaatttcttctttccttgatgttggagctcaggtagcagtcaacaatggatgcaatagaggccgaagaaggtccttttctggctaatgatgccaagttgcacgcaggaatttgtagagcatttctccctgctgtatctaagctttccaccattttccctttcatcgaagcatcaagaccaagaagcaagtctggtatacaggcattgtgttcactacatgtcgctctagataaagccaaagggctccttcaacattgtgcagacagcagcaggctctacttggccatcacctcggaaactgtgcttttgaagtttgaaaaatctaggagccaacttcaggaaagtctaaggcgcgttgaaagcatagtaacagaagatatcagctgtaagattacagagattgttagtgagttggaggagattgtctttacattggatcgatcagagaaggaagctggtgacaatgtgatcaatttgctccagaggaacaacaaaacaaatggttccagtgatagtggggagcttgaggtcttccacatggctgctctgaaattgggaattacatcttctagggcagcacttacggagagaagagccctcaagaagctaatcgagaaggctcgttctgatgaagacaagaggaaggagcttgttgtgtcgtacttgtacaatctcatgaggaaatactcaaaattcttcagaagtgaggctggtgacgatacagattctcaaggatcatctccctgctcgcctacagtattaggcatggatgatatgtatggaccctacggcaatggccgagcattcagtagacagctttcgagcattcaatcattgaattcgaggtttggatctttcaattctaggctcggatcattcaattgcaagcgtggtggtggtccaaggtctgaaaatatgtcaatgcctcctgaagaacttaggtgccctatttccttacagctcatgtatgacccagtcatcatttcatctggacagacttatgagcgtgtttgcattgagaagtggttcaacgatggtcacagcacatgtcctaaaactcagcagcaacttgcccacctgtcattgactccaaactattgtgtgaaggccctgattgccagctggtgtgagcagaatgattttccagttcctgatggtccaccaggatcttttgatgtaaattggagacttgctttctcagacactgaggctacaggttgtgtgcctgctgaaagttttgattctaccaatgtgaagagtgtcaaggttgtcccaatggagaatatgagaaaggaggagctggcaaacagtgaatcaggaacgctggatgacagctcttgtaacgattttgatttgaatgagggatatgggaacttgctgctcttacttcatgaaagaagcaacatgaacaagcagtgtaggttggtggagcagataaggtatcttttgaaagacgatgaagaagcaaggatccagctgggctcaaacgggtttgccgaggcgctagttgagttcttgagaaatgctgtgagtgatggaaatgagaaggcacaggaagttggcatcatggctcttttcaacctcgcagtgaacaacaacagaaacaaaggactcctgttatctgctggagttgtcgacctactcgagcagatgatatcaaattcacgcctaactggtccagccacggcactgtaccttaacctttcctgcctatctgatgcgaaggctgtcatcggttctagccaagctgtgtcattcctagtcgaccgt

SEQ ID NO: 24425 - protein, 574 aa, Panicum virgatum
  misc_feature: Ceres CLONE 1858648
  misc_feature (295)..(367): Pfam Name: U-box Pfam Description: U-box domain
MDAIEAEEGPFLANDAKLHAGICRAFLPAVSKLSTIFPFIEASRPRSKSGIQALCSLHVALDKAKGLLQHCADSSRLYLAITSETVLLKFEKSRSQLQESLRRVESIVTEDISCKITEIVSELEEIVFTLDRSEKEAGDNVINLLQRNNKTNGSSDSGELEVFHMAALKLGITSSRAALTERRALKKLIEKARSDEDKRKELVVSYLYNLMRKYSKFFRSEAGDDTDSQGSSPCSPTVLGMDDMYGPYGNGRAFSRQLSSIQSLNSRFGSFNSRLGSFNCKRGGGPRSENMSMPPEELRCPISLQLMYDPVIISSGQTYERVCIEKWFNDGHSTCPKTQQQLAHLSLTPNYCVKALIASWCEQNDFPVPDGPPGSFDVNWRLAFSDTEATGCVPAESFDSTNVKSVKVVPMENMRKEELANSESGTLDDSSCNDFDLNEGYGNLLLLLHERSNMNKQCRLVEQIRYLLKDDEEARIQLGSNGFAEALVEFLRNAVSDGNEKAQEVGIMALFNLAVNNNRNKGLLLSAGVVDLLEQMISNSRLTGPATALYLNLSCLSDAKAVIGSSQAVSFLVD

SEQ ID NO: 24426 - DNA, 718 bp, Panicum virgatum
  misc_feature: Ceres CLONE 1858648-R
ggttggacagagaaggccctcgctgtgctcatcagcctcgcagccactcaggcgggcaggaaggagatcatgtccaccccgggtttggtcagcacattagcaatgctgctcgacacgggtgagccgactgagcaggagcaggccgtgtcgtgccttctggtgatgtgcacggctgatgacaagtgcatagcgccagtgctccaggaaggagtggtcccgtccctggtctccatctcggcggccggtactgggaggggcagggagaaggcccagaagcttctgaagctgttccgggaacagaggcagcgggacgcaccaccaccccagcagccccagcagcagcagcagcagagccagttaacagaggccaggaatggtggtgccatcgtgtgccaccagtggaagccgctgtgcaagtccaaatcgcggaagctggggcgaacgctgagctcgctgtggaagaacaggagcttctcgctgtaccagtgctaggatgctagagtaggtttgagttgatcagtggatatgtacatctcctttctcccttatttccctcctgatcatttcctttctttttttttgggggtgttgttttccacgggtaaagcaaagaccttgatgttctcccccccccccctgctcggtggggtgatgtagggcattttccacttctacagttctacctatgtcaagagatgtgtacagttgtttcttctcc

SEQ ID NO: 24427 - DNA, 1858 bp, Panicum virgatum
  misc_feature: Ceres CLONE 1858656
  misc_feature: Encodes the peptide sequence at SEQ ID NO. 24428
acgcagtcaccagtacagcgcccaaccacctcccctcccctcccatcccctccccctctccgctctccctcatcatcactccccacccgcctgcgcgccatggtgtcgctcgccggctcccagatcccctcgccctcgccggggcagagcccctgcgcggccgcggggccgctgcgccgcccggggcggtccatgcgcaccatccgctccgcgctgctgcagccggactccgcccctggctccccggcggccccgcgcgatggcggcggcgacgcgggcgactccgacattgagaacctcaccgactccgtcatcgacttccacctcagcgagctcgcctccactgcggggcccgcgcacccggcggcagtcgcaaagtcgtcctccgccatcaacgcggccgccacggagctgctcgagctatcgcgggacttctctgactactccagcttcaactccgacatctccggggagctcgagcgcctcgcgatggcggcggcgggggcggcgcccagatccgacgcgccggacccggcgcgcgccgccgtggatctgaacgacctcgagtccatggatctgttgccggacgccgcgccgctggagcgcgttgagcccttcgtgctcgcgtgcgtgcaggcgctgggccccgatgcagcgccggacgcgcgccgcgcggccgccgccaggatacggctgctggccaagcaccggtccgacatccgggacctgatcggggtgtcgggcgccatcccggcgctcgtgccgctgctgcgcagcaccgacccggtcgcgcaggagaacgcggtcaccgcgctgctcaacctctcgctggaggagcggaaccgctcggccatcacgtcggcgggcgccatcaagcccctcgtctacgcgctccgcaccggaacgaccgcggccaagcagaacgccgcctgcgcgcttctcagtctgtccggcatcgaggagaaccgcgcaaccatcggagcctgcggcgccatcccgccgctcgtagcgctgctttccgcgggctccacgcgcggtaagaaggacgcgctcaccacgctctaccgcctctgctccgcgcgcaggaacaaggagcgggcggtcagcgccggcgccatcgttccgctcgtgcacctcatcggcgaacgcggcagcgggacgtgcgagaaggcgatggtggttcttgggagcctcgcgggcatcgccgagggccgtgaagctgtggtggaggctggcgggatccccgcgttggttgagacgatcgaggacggccctgccaaggagaaggagtttgccgtggtggcgctgctgcagctgtgctccgattgcccgcataaccgtgcgcttcttgtacgcgagggcgccatcccgccgcttgtcgcgctatcacagtctggttctgcccgtgccaagcacaaggccgagactttgcttggttacttgcgggagcagcgacaaggagttggatgcagagctggatctgtggcagctacaagcttggctaggtaaatcaggaattatatggtcaaagtctgctccattctctgttggagtcttgagagcggagcagctgcccgaggggtgtgatgtgatgatcatctgtaaataacagctggtttgggtcggtttggttatgtcttatgtgaatacacatgtggtttggagtgagatgctttggttggtcactaacatcagtgaagagaggtgtcagggtttcaggggatgtcagcggagaatttgggtgctaaggttaatgatatgctggattgtagctgtgtacaggatgctagagtatgcttgcttgccttgtcaggttataggagaatgttggatcgtcaaccatgtgtttttttgctgg

SEQ ID NO: 24428 - protein, 469 aa, Panicum virgatum
  misc_feature: Ceres CLONE 1858656
  misc_feature (204)..(244): Pfam Name: Arm Pfam Description: Armadillo/beta-catenin-like repeat
  misc_feature (286)..(326): Pfam Name: Arm Pfam Description: Armadillo/beta-catenin-like repeat
  misc_feature (410)..(450): Pfam Name: Arm Pfam Description: Armadillo/beta-catenin-like repeat
MVSLAGSQIPSPSPGQSPCAAAGPLRRPGRSMRTIRSALLQPDSAPGSPAAPRDGGGDAGDSDIENLTDSVIDFHLSELASTAGPAHPAAVAKSSSAINAAATELLELSRDFSDYSSFNSDISGELERLAMAAAGAAPRSDAPDPARAAVDLNDLESMDLLPDAAPLERVEPFVLACVQALGPDAAPDARRAAAARIRLLAKHRSDIRDLIGVSGAIPALVPLLRSTDPVAQENAVTALLNLSLEERNRSAITSAGAIKPLVYALRTGTTAAKQNAACALLSLSGIEENRATIGACGAIPPLVALLSAGSTRGKKDALTTLYRLCSARRNKERAVSAGAIVPLVHLIGERGSGTCEKAMVVLGSLAGIAEGREAVVEAGGIPALVETIEDGPAKEKEFAVVALLQLCSDCPHNRALLVREGAIPPLVALSQSGSARAKHKAETLLGYLREQRQGVGCRAGSVAATSLAR

SEQ ID NO: 24429 - DNA, 2081 bp, Panicum virgatum
  misc_feature: Ceres CLONE 1858679
  misc_feature: Encodes the peptide sequence at SEQ ID NO. 24430
gaactgctgaagcaggtcgagcaatgccgtagactgaagcagagcagcgccgcccccgcccaccatgtcgatccgcgccgcgctccacctccgccgtttcttctccacggacgctgccctcgcgccgccgaagctgcggaacctaccctaccgcctccgccacggcgccgtcccggccgcgcgcgccgccgtctccgagtacctccacttcacgcgctgcctcccgtcctcccacgccgactccatcgtcgcgcactccccgcgctccctcctctccttcctcgccgcactccccgccgtgccgggttccctccccaccgcggagctccctgcgctcctccgccgccacctcaactttcacccgctcaacgagctccccttcttcctcgaatcaatcggcgcgcccgccgcggcgtccccccgctccgacctcatgttcgtcgccgaccaccccactctgctcgacgccgtcgccgcgctcgcgcacttcggattcccatggtcacgcctcggtctcctcttccccgccgtcctcctcggcgtgcccccggaccgtatctcatctcgcctcgctgctctcgaggcccgtctcaaccggctcccgcgcgccgccatcatcgcagcctgcctcaccttcccatcgcttcttgagcgggatctatccgattgcgacacactcgttaaggatctcggcgccacgttcagaggattgggtccggatttgggggcaagcaatgacattgacgcgttctcgggtgtgtgccggaggatgcggatgttctatgatgccgggacagagattggtagcattgggggacttgccggcagcagttggagagtgtttcttgagctcagggaaaagagaattgctgagagattatggttcttcaaggagctggggatgcccgggaaggagctgggaaggttcttgctaagcaatgccaagcttttttatcatgatttctctgatgttgtgatctcggtgccagagtatctgctgagggttggtttggtggacgatgaggttaatgcggctatagagaaacatccatatgttgttgggaagaaccagctggagaacctccccagggtgttgcgggcaatgaagctggagcatcggttcctggagaagatttcagttggtgcggagaacttgcgttatttatcaccttattttgctttggaggatgatagctatgatgcagaggttgagagggctttcttggatgggatgactaaggtcaaggctgacaagaaagcacagcatgtggacagcaagctggagttcttgaaaagcattgggtatggtgagaatgagatagccaccaaggtgattcctgtccttcacagcaccaaggatttcctgcaggagcggtttgactaccttctggaaagaggggtggagtatacaatgctgtgtcggatcttgactgtttttccaaaggtgctgaaccagggcaaggatatgctcaatgagaagttgaattatctcacagaggagctgggctactccatagagtacctggattgcttccctgcatttctgtgctttgatttggagaacagggtcaagcctaggtatacaatgcttcggtggctccgaaagcatggcctacttagaaaacatttagcccctgcaacagtgcttgctaactcggagaagagattcattactactctccaccttgtgcatcctgcagttccaaagttgtggcttgagaacttctcttcaagaatgcatatggagtgttatctcaagaacatttatcatcagcattcagacaacaaatagttagatgtctggaaccatgttgacacgattgttagaggtgcaaagcattttttcatgtgcatcctttccctgttagacatagtagctctacatttgggaaaattctttgctcctgcatatatagcagcaagctgcaggatgtaggatgaaatgggatatataccaactagatagcaaaacttgatttttggtaaaactgtgctgtaaatttgaactttgttcagttttccactagccctcctgtggctatacagtatgcactgattggaacatgtaacatgttgtattc

SEQ ID NO: 24430 - protein, 452 aa, Panicum virgatum
  misc_feature: Ceres CLONE 1858679
  misc_feature (113)..(414): Pfam Name: mTERF Pfam Description: mTERF
MFVADHPTLLDAVAALAHFGFPWSRLGLLFPAVLLGVPPDRISSRLAALEARLNRLPRAAIIAACLTFPSLLERDLSDCDTLVKDLGATFRGLGPDLGASNDIDAFSGVCRRMRMFYDAGTEIGSIGGLAGSSWRVFLELREKRIAERLWFFKELGMPGKELGRFLLSNAKLFYHDFSDVVISVPEYLLRVGLVDDEVNAAIEKHPYVVGKNQLENLPRVLRAMKLEHRFLEKISVGAENLRYLSPYFALEDDSYDAEVERAFLDGMTKVKADKKAQHVDSKLEFLKSIGYGENEIATKVIPVLHSTKDFLQERFDYLLERGVEYTMLCRILTVFPKVLNQGKDMLNEKLNYLTEELGYSIEYLDCFPAFLCFDLENRVKPRYTMLRWLRKHGLLRKHLAPATVLANSEKRFITTLHLVHPAVPKLWLENFSSRMHMECYLKNIYHQHSDNK

SEQ ID NO: 24431 - DNA, 518 bp, Panicum virgatum
  misc_feature: Ceres CLONE 1858682
  misc_feature: Encodes the peptide sequence at SEQ ID NO. 24432
ctggtccactcttatcatcctctccccttcgcggccttcaccaaatttcaagtctgtcaaaggtgaccttgcccatgccgatctggtccacccccctctgacccccgactccagcgtcaccatcatgcattccgctgctcctactcgtgtcgacaactactccgtcaattcggtccacttcacacccaacaagacatatgacacccacctgatggaggaggcgtgccacgtcactggccagatcatgacgtatatccttgtccgcactgccgacgcgtccgcccaagacgatgaggatgctgcggctggttatcacaacgcatctcaactgatttcctccaatccctattcacccgcacaccctggagctgaaatgcttgtgatggcatatggaaggtcttctggccttacagtaattaccactcgggggaacaatgtgtctaggtctaatcccttcactgacaatgctcattccctaattcattcttttggccttgacaactctacctcttcctatt

SEQ ID NO: 24432 - protein, 172 aa, Panicum virgatum
  misc_feature: Ceres CLONE 1858682
  misc_feature: SWISSPROT Homolog: EC 4.2.1.46 dTDP-glucose 4,6-dehydratase
  misc_feature: Useful for making plants with altered cell wall content and/or composition
  misc_feature: Useful for making plants with altered carbohydrate content
WSTLIILSPSRPSPNFKSVKGDLAHADLVHPPLTPDSSVTIMHSAAPTRVDNYSVNSVHFTPNKTYDTHLMEEACHVTGQIMTYILVRTADASAQDDEDAAAGYHNASQLISSNPYSPAHPGAEMLVMAYGRSSGLTVITTRGNNVSRSNPFTDNAHSLIHSFGLDNSTSSY

SEQ ID NO: 24433 - DNA, 2293 bp, Panicum virgatum
  misc_feature: Ceres CLONE 1858683
  misc_feature: Encodes the peptide sequence at SEQ ID NO. 24434
gtgggcgtgtgggaaagggaggggaaaaggtggccttttttgggggcacccagattccattccttgcgcgggggggctcctactaggctgctgtggaatttgctagagcagcagcagcagcccaccatttctctctccctctcggctctctctcgccccctgctttctccgctgccatcgattcttccctccttccttccttcctcgtgaaggagagttccttctgctactctacaagaagactccttcggtgtgcgccggagaatctgattctttcctatccgggagtttcttggagcttgctcgcctgctttctgccactgacggtgccagcggagtgaggaggagtatcggtttctcggcagccgccgccgggacagcagcggaagggacaggatggccgccgcgccgccgcccaaggccgacgagctgcagccgcacccgcccaaggagcagctcgccggcgtctccttctgcatcaccagcccgccgccatggcccgaggccattatactaggattccagcacttcatcgttatgctgggcaccactgtcatcatacccagcgcgctcgttccgcagatgggaggcagaaatgaagagaaagctcgtgtggttcagacgatattgttcgtagctggcataaacaccctgttacaaacatttttcgggacacgtcttcctgttgtaatgggcggctcgtatatcttcgttgcacctaccatctccatcatcttggccgggcggtacagcaacgaagcagaccctcgcgagaaattcttgcggacaatgcggggaacgcagggtgctctcatcattgcatcgacaattcagatcatacttggtttcagtgggctctggcgcaatgttctcaaattattaagtccattgtcagctgttcctttggtatcacttgttggatttggactttatgagcttggctttccaggggtagctaaatgtgttgaagttggccttccagaactcctcctgttggttgtattttctcagtatttgcctcaagttctgcatttcgggaaggatgtctttggacggtttggtgttcttttcactgtccctatcgtgtggctctatgcatacattctcaccatcggtggtgcctacaagaattctccaccgaagacgcaggtgcattgccgtgttgatcgttcaggtcttgttgcaggagctccttggataagtgtcccctatccctttcagtggggtgctccaacatttgatgctggagaagcttttgcaatgatgatgacttcattcattgctcttgtagagtcaactggcgctttcattggtgcttcaagatatgcaagtgcaactatgattcctccatcaattattagtcggggcattggatggcagggcattggcatcttgcttgattcattttttgggacagccaacgggacatcggtttcagtggagaatattggattgcttgcattgacacgtgttggcagccgaagagtagtacaaatatctgctgggttcatgattttcttctctgtccttggaaaatttggagctctgttcgcatccattccattgcccatatttgccggcatgtactgtctcttcttcgcatatcttggtggcgtcggtctgagcttccttcagttctgcaacctaaacagcttcaggaccaagttcatcatggggttcgctttcttcatgggattatcagttcctcagtacttcaacgagtacacagcagttgcaggctatggtccagtgcacactggcgccagatggttcaacgacatgattaatgtgccgttctcatcgaagcccttcgtcgctggcctcgtggcctacgtcctggacaacacgctacaagtgaaagacgcgaggaaggacaggggctaccactggtgggacaagtttaggagctacaagaaagacgcgaggagcacagagttctactcgctgccattcaatctgaacaagttcttcccctcggtctgacctttgatccccgagcggttttcaggagggtactcttcccttgttcatacggtgaacataattctgctggcctggcctgtggaagctttctgtgtcgctggtgttcgtcaattttgtgtatttttggatgaaatggggtaattcgacagtagaaatggagtaatactcgtgttctttttcggaccaacacggatcaagtgtctgataacctgttagtttcttttgtcaggctggcattgtacatcagtatatgtggctttcatagcccaggtagaatgataaattattaaacattaatgtttcataactg

SEQ ID NO: 24434 - protein, 528 aa, Panicum virgatum
  misc_feature: Ceres CLONE 1858683
  misc_feature (35)..(442): Pfam Name: Xan_ur_permease Pfam Description: Permease family
MAAAPPPKADELQPHPPKEQLAGVSFCITSPPPWPEAIILGFQHFIVMLGTTVIIPSALVPQMGGRNEEKARVVQTILFVAGINTLLQTFFGTRLPVVMGGSYIFVAPTISIILAGRYSNEADPREKFLRTMRGTQGALIIASTIQIILGFSGLWRNVLKLLSPLSAVPLVSLVGFGLYELGFPGVAKCVEVGLPELLLLVVFSQYLPQVLHFGKDVFGRFGVLFTVPIVWLYAYILTIGGAYKNSPPKTQVHCRVDRSGLVAGAPWISVPYPFQWGAPTFDAGEAFAMMMTSFIALVESTGAFIGASRYASATMIPPSIISRGIGWQGIGILLDSFFGTANGTSVSVENIGLLALTRVGSRRVVQISAGFMIFFSVLGKFGALFASIPLPIFAGMYCLFFAYLGGVGLSFLQFCNLNSFRTKFIMGFAFFMGLSVPQYFNEYTAVAGYGPVHTGARWFNDMINVPFSSKPFVAGLVAYVLDNTLQVKDARKDRGYHWWDKFRSYKKDARSTEFYSLPFNLNKFFPSV

SEQ ID NO: 24435 - DNA, 1247 bp, Panicum virgatum
  misc_feature: Ceres CLONE 1858692
  misc_feature: Encodes the peptide sequence at SEQ ID NO. 24436
ctcctcctcagctcaggcgagcggcagagccgagcagagctcttaccctcctcaaaatcccgaccaggcgaccacctccatttgcccgtccggggggagccaaccacttgaccggcccagcgcgatggggtccgtcccggaggacgccgcggcggccgtgttccgctccaagctgccggacatcgagatcccgcgcggcctctcgctgcaggcctactgcttcgagcggctccccgaggtgtcctcccgcccgtgcctcatcgacgggcagacgggcgccgtccacacctacgccgacgtggagctcctctcgcggcgcgcggcggcggcgctccgcgcgctcggggtgggcaggggcggcgtggtcatgagcctgctccgcaactgccccgagttcgccttcgtcttccttggcgccgcgcggctgggcgcgtccaccaccacggccaacccgttctacaccccgcacgagatccaccgccaggcggccgcggcgggggcggcggtcatcgtcaccgaggcctgcgccgtcgacaaggtgcgcgccttcgccgccgagcgcggcgtgcccgtggtgtccgtcgacggcgcccccgggggtggctgccccctgctccgggacctcatggacgccgccgagccgctcgccgccgacgaggacgtcgaccccgacgacgtcgtcgcgctgccatactcctccggcaccaccgggatgcccaagggcgtcatgctcacgcaccgcagcctcgtcaccagcgtcgcgcagcaggtggacggcgagaacccaaacctgtacttcaggcaggacgacgtggtgctctgcgtgctgccgctgttccacatctactcgctcaactcggtgctgctggcggggctccgcgccgggtgcgccatcgtgatcatgcgcaagttcgaggtcggcgcgctggtggagctggtgcgcgcgcacggcatcaccatcgcgcccttcgtgccgcccatcgtggtggagatcgccaagagcccccgcgtcgccgccgccgacctcgcctccatccgcatggtcatgtccggcgccgcgcccatgggcaaggacctccaggacgccttcatggccaagatccccaacgccgtgctcggccaggggtacgggatgacggaggcagggcccgtgctggccatgtgcctggccttcgccaaggagccgttcgaggtcaagtccggctcctgcggcacggtggtcaggaacgccgagctgaagatcgtcg

SEQ ID NO: 24436 - protein, 374 aa, Panicum virgatum
  misc_feature: Ceres CLONE 1858692
  misc_feature (55)..(374): Pfam Name: AMP-binding Pfam Description: AMP-binding enzyme
  misc_feature: SWISSPROT Homolog: EC 6.2.1.12 4-coumarate--CoA ligase
  misc_feature: Useful for making plants with altered carbohydrate content
  misc_feature: Useful for making plants with altered lignin content
  misc_feature: Useful for making plants with altered cell wall content and/or composition
MGSVPEDAAAAVFRSKLPDIEIPRGLSLQAYCFERLPEVSSRPCLIDGQTGAVHTYADVELLSRRAAAALRALGVGRGGVVMSLLRNCPEFAFVFLGAARLGASTTTANPFYTPHEIHRQAAAAGAAVIVTEACAVDKVRAFAAERGVPVVSVDGAPGGGCPLLRDLMDAAEPLAADEDVDPDDVVALPYSSGTTGMPKGVMLTHRSLVTSVAQQVDGENPNLYFRQDDVVLCVLPLFHIYSLNSVLLAGLRAGCAIVIMRKFEVGALVELVRAHGITIAPFVPPIVVEIAKSPRVAAADLASIRMVMSGAAPMGKDLQDAFMAKIPNAVLGQGYGMTEAGPVLAMCLAFAKEPFEVKSGSCGTVVRNAELKIV

SEQ ID NO: 24437 - DNA, 1782 bp, Panicum virgatum
  misc_feature: Ceres CLONE 1858707
  misc_feature: Encodes the peptide sequence at SEQ ID NO. 24438
gttttcccaaaaaaaaaaaaaaagtacccaacccgtccgtcgccccccacatcctcccgtcccagcccgtcgaaaccctagcccgcaatcccggcaaaagtctcgctctcgccgcctccccggcgccatgggcaagaagcggaagctggagagcaaatcagcggcagccgctaagtctaccccggccgctgcagccaagtccgccactgctagggccgccggcctatctgaggtcatcgcccccgccatggcgcggaaggaggagaagcttccccaggaggcaggcgtcaaggaggaggaggtcgaggaggaggttgaggaggaggtggaggtcgaggaggaagtggaggtggaggaggaggaggaggacgaggtggaggagggcgagagcgacccggcctcgattcaggcgctgctggattccttccccaaggaccagctcgtcgagctgctccgcgacgcggccgtcgcgcacagcgacgtgctaagcgccgtccggcgcgtggccgacgccgacccggctcagcggaagatattcgtccacgggctcggctgggacgccaccgccgacaccctcaccgaggcgttcggcccctacggcgagattgaggacctcagggtcgtcagcgaccgcaacaccggcaagtgcaaggggtacggcttcatcctcttccgccaccgctcgggcgcccgcgccgctctccgcgagccccagaagaagattgggaatcgcaacactgcctgccagctcgcctctgtcggccctgtccctgctggtggtgcggccagcaactctgtgcctgccccggcgcagttgcagctgccaccggtatcagagtacacgcagcgcaagatatttgtcagcaatgttggtgcagatatcgatccccagaaactgtttcagttctttgcaaggtatggtgagattgaggagggtccgcttggacttgacaaggtcactgggaaacccaagggatttgctctctttgtctacaagactattgagagtgccaagaaggctcttgaggagccacataagcattttgaaggagttgtgctgcactgccagaaggcgattgatggaccaaagcccaacaaattggcaggacctggaggcttctacggtgctggggcttcaagtggcagcaagggggttcctggttatggagctactggtcatactctacccggaagtgttggtattggccagccaatgtcaccattggctcccagcttggcttcactgcctggaggtattgctgcagccccaggggtggatcctgctctgggacaggccttgacagctttgcttgccacccagggtgctggactgaatttgaatagcatcctgggagttggtggtaatggctcaggggtgcctcctcagggggcatctggtgccctgagtggtagcagtttgccggggatgcaaggtggttatatgggaggctatggtagttctggtgggtacgggggtgcaccgtcaggaggccctggaagaaattacatgggtcactaggatggttgtaactattttactgtggccagatgattctacatgttcctgattggcacttataaacttgctcttttaagctgtttctggctactcaattatgctgtggtcaaagttttcataaggacttcgatttcctcccctgctgtttcgaaatgaaacagtatttcgtacaactatttagattttcaaaaggccatcttgtggctagcaagacagttgtaaaatacttaattcatgtggatttaaatcactgcgatatttag

SEQ ID NO: 24438 - protein, 463 aa, Panicum virgatum
  misc_feature: Ceres CLONE 1858707
  misc_feature (136)..(206): Pfam Name: RRM_1 Pfam Description: RNA recognition motif. (a.k.a. RRM, RBD, or RNP domain)
  misc_feature (243)..(313): Pfam Name: RRM_1 Pfam Description: RNA recognition motif. (a.k.a. RRM, RBD, or RNP domain)
MGKKRKLESKSAAAAKSTPAAAAKSATARAAGLSEVIAPAMARKEEKLPQEAGVKEEEVEEEVEEEVEVEEEVEVEEEEEDEVEEGESDPASIQALLDSFPKDQLVELLRDAAVAHSDVLSAVRRVADADPAQRKIFVHGLGWDATADTLTEAFGPYGEIEDLRVVSDRNTGKCKGYGFILFRHRSGARAALREPQKKIGNRNTACQLASVGPVPAGGAASNSVPAPAQLQLPPVSEYTQRKIFVSNVGADIDPQKLFQFFARYGEIEEGPLGLDKVTGKPKGFALFVYKTIESAKKALEEPHKHFEGVVLHCQKAIDGPKPNKLAGPGGFYGAGASSGSKGVPGYGATGHTLPGSVGIGQPMSPLAPSLASLPGGIAAAPGVDPALGQALTALLATQGAGLNLNSILGVGGNGSGVPPQGASGALSGSSLPGMQGGYMGGYGSSGGYGGAPSGGPGRNYMGH

SEQ ID NO: 24439 - DNA, 2027 bp, Panicum virgatum
  misc_feature: Ceres CLONE 1858712
  misc_feature: Encodes the peptide sequence at SEQ ID NO. 24440
gaacccgaaaaacccgcgtcatctggcggcacggtcgccgccgccgttgtccccgagaccagtccgccaggatgctccgcgccgccatctcacgcctcggcgcacgcctccgcctccaccacgacccccgagcccaccacccattcccgccctcccctcacctccgcgctttctccacccgccgcggcaagcagtcctcccccaccgcgtcgcccgcggactacgacgacgagggccccctacgcggcctctttgtgctctcccgcgatcccgagagccctccgcggctgctggtggtgcaaccgcgcctccggcccgggagcctgctcgactccaagctcgccgaggcgctcaacctcgccaactccctggaggagccccgcgacggcttctacgaccgggagttcagctccaagggtgcgccgccgcacctcgtcgtccagaatcccgcttcccgcggccgctcacacgcagatacatatttcggacctggaactgtggataatgtcaagtgcttcctgagggcatcagagtcagaggaagatgtggatgcagtttttgttaatgcaattctctccggaatccaacagagaaacttggaggttgcgtggggaaagccagttttggaccgtgttgggctcataattgaaatattcaatgctcatgccgaaacaaaggaagcaaagttacagtcagagttggcagctctcatgtacatgaagactaggcttgttcgagtacgtggcccaggtgggcgattaacttttggtccaagtggggaagctgaggttgtcagtgcaagagggagaggaagtgggggacggggcttcatgagtggtgctggtgaaacagaacttcaactacaacggaggagaatccaagaacggcgcgtgagcttgttagctcaaattgaagatgtacgccgtactagagccatacaacgttcaagtcggaaaaggcacggtggctcatttggtcaagagcttgtaactgttgcagttgttggatatacaaatgcagggaaatctacgctagtgagtgcactttctgaaactgacctgtacagtgatgataggctgtttgcaacagtagatccccggttacaaagtgtgattcttccatcagggagaaaagcacttcttagtgataccgttggcttcatctcagatttacccatacagctagtggaagcatttcatgccaccctggaagaagtgattgaagcagacatgttagtgcatgtgttggatgcaagtgcacctgatcttgaggagcatcgatctactgtattgcaagtactgcagcagataggtgttacacaggagaagatcaacagtatgattgaagtttggaacaagattgatcttgtggatgagaatgctgcatctgatggggttgaggatgagatattcctgactgaaggtgaagaggagtatgacatattctctgaagatgatgttccatcagaacaatcatctttggattccttagataatggagcagatacagaatttttacccgaagaaaatttcgaagatagcatcgatgaagtatcatctaaagagtcatctgagatgaaagcagtaaacccagagttatcatcaagagaatgttttggagagcttcgtgtcccagatgcaaatggatgtgctttgacacaacaaatgcccatttgtcatgtgaaaacttctgctgtgacagggataggattgcaagagttgttgacattgatagatacgaaattgactgaacaacaaaatgttgtgcaaagaagctatgggcctttagatagaaaatggagacctacttgctctatggatgacgaaaaggctgcagaacagtaggtatgctgtgccttcttatttcccctgtctatatgttactgagatcaatagcagtatagtactcagtttctgtgtttgcctccagtagacagggaaattatgcaatgcttttggatatgcacttatgcatgttgtacgatttgtattaatagtcattcaaagagtacattgatactcttcccg

SEQ ID NO: 24440 - protein, 590 aa, Panicum virgatum
  misc_feature: Ceres CLONE 1858712
  misc_feature (306)..(431): Pfam Name: MMR_HSR1 Pfam Description: GTPase of unknown function
MLRAAISRLGARLRLHHDPRAHHPFPPSPHLRAFSTRRGKQSSPTASPADYDDEGPLRGLFVLSRDPESPPRLLVVQPRLRPGSLLDSKLAEALNLANSLEEPRDGFYDREFSSKGAPPHLVVQNPASRGRSHADTYFGPGTVDNVKCFLRASESEEDVDAVFVNAILSGIQQRNLEVAWGKPVLDRVGLIIEIFNAHAETKEAKLQSELAALMYMKTRLVRVRGPGGRLTFGPSGEAEVVSARGRGSGGRGFMSGAGETELQLQRRRIQERRVSLLAQIEDVRRTRAIQRSSRKRHGGSFGQELVTVAVVGYTNAGKSTLVSALSETDLYSDDRLFATVDPRLQSVILPSGRKALLSDTVGFISDLPIQLVEAFHATLEEVIEADMLVHVLDASAPDLEEHRSTVLQVLQQIGVTQEKINSMIEVWNKIDLVDENAASDGVEDEIFLTEGEEEYDIFSEDDVPSEQSSLDSLDNGADTEFLPEENFEDSIDEVSSKESSEMKAVNPELSSRECFGELRVPDANGCALTQQMPICHVKTSAVTGIGLQELLTLIDTKLTEQQNVVQRSYGPLDRKWRPTCSMDDEKAAEQ

SEQ ID NO: 24441 - DNA, 693 bp, Panicum virgatum
  misc_feature: Ceres CLONE 1858729
  misc_feature: Encodes the peptide sequence at SEQ ID NO. 24442
acgaggagtcgactggcggtggaggcggagttccaagaacagccacccacgcgcgagaagtactcccaggtcgtcttctccctcgatcccatctcgtcaccccccttctccgatccgatcggtcgcggagcgctgcgtttcccggctgcacaggtttcttgggggctttctttatggcatttgggaactgtgcgagtgattgggtttaactacgaatctaggggacaccgtcatggcatacttcccagaggaagtggtggagaagatccttggctatgtaacctcgcacagggatcgcaacgccacgtcgctagtgtcccgggcatggtaccacattgagcgccgtagccgccgctcggtgcttgtaagcaactgctatgcagtgcgcccagagcgtgtgcttgtgcggttccccagcatgcgctcgctgagcgtgaagggcaaaccacactttgctgacttcgaccttgtcccggcggggtggggcgccacggctgatgcatggatggattcgtgtgcccgtgcgtgccctggccttgaggagctccggctgaagcggatggttgtgactgatgagtgcctcaagctgattgctggctcttttaccaactttaaatcacttgtccttgtcagctgcgaggggttcagcactgctggccttgctactatcgccaccaattgcaggtttcttag

SEQ ID NO: 24442 - protein, 153 aa, Panicum virgatum
  misc_feature: Ceres CLONE 1858729
  misc_feature: Useful for making plants with altered carbohydrate content
MAYFPEEVVEKILGYVTSHRDRNATSLVSRAWYHIERRSRRSVLVSNCYAVRPERVLVRFPSMRSLSVKGKPHFADFDLVPAGWGATADAWMDSCARACPGLEELRLKRMVVTDECLKLIAGSFTNFKSLVLVSCEGFSTAGLATIATNCRFL

SEQ ID NO: 24443 - DNA, 716 bp, Panicum virgatum
  misc_feature: Ceres CLONE 1858733
  misc_feature: Encodes the peptide sequence at SEQ ID NO. 24444
aagaatctgaatctctccgcgcagctcaagaatccgccgcagcagagagagagaggaccaggccacccacgcagggttgcgttttataagccatccacctcgggttgtccggcacgccgtcgcgagttcttggcggccggctacctctcccaaggagacgaagtgaggaagaggagaggaacgcgctcgtcgccgtcggcgtcggcgtcgtccgactctgaggtgctccaaggccctctcctgagctccttgtcctccatcagagccggcctcacgatgtacctgatcgaggacaagggcggcgccatcgccgtcatgctggcgtcgctcctgttcctgggcacctggccggccgtgctcacactcctggagcgccggggccggctgccgcagcacacctacctggactactccctcaccaacctccttgccgccgtgctcatcgcgctcaccttcggccagctcggggacagcaaggacggcatgcccaacttcttcacccagctcagccaggacaactggccttcggtgctgttcgccatggcaggaggtgtggtgctcagcgttgggaacctgtcgacccagtatgcttgggcatatgtgggtctctcggtgactgaggttatcagctccagcatggtggtggtaataggcacaacactgaactacttcctggacaaccgcatcacaaggcagagattctgtttgccggtgtg

SEQ ID NO: 24444 - protein, 146 aa, Panicum virgatum
  misc_feature: Ceres CLONE 1858733
  misc_feature (14)..(145): Pfam Name: FAE_3-kCoA_syn1 Pfam Description: Fatty acid elongase 3-ketoacyl-CoA synthase 1
MYLIEDKGGAIAVMLASLLFLGTWPAVLTLLERRGRLPQHTYLDYSLTNLLAAVLIALTFGQLGDSKDGMPNFFTQLSQDNWPSVLFAMAGGVVLSVGNLSTQYAWAYVGLSVTEVISSSMVVVIGTTLNYFLDNRITRQRFCLPV

SEQ ID NO: 24445 - DNA, 1338 bp, Panicum virgatum
  misc_feature: Ceres CLONE 1858734
  misc_feature: Encodes the peptide sequence at SEQ ID NO. 24446
aggcaaagcagagagggagagagagagagaggtgtgcagtaatgaagtttgctctttgataggccgcggctaagcaccaaaccttggggaaatggagccgcgcggtggcgcagcgggagcttggggaagcggaggctcgcgagcagccagaggagaggaggaagccattacccattagctcagcgctaccctacactatccatcgaaccgatcgcgctgccgcgcagtgcagcgcgtgtgtacaaaaggccgtgaaggcggtaagaccgggcaggcagcagcactaggccagccagccaggtaaaggcgtgtaaggaagaagcgagaagcccgtgagctcctcctgcggtgcggtgcgagggtttcgcctcgtctcgcccttcccctggcgctgccatggacgcctacgaggcgaccaaggtggtgttctcccggatccaggcgctggacccggaccacgccgccaagatcatgggcctcctcctcatccaggaccacggcgagaaggagatgatccgcctcgccttcggtccggagtcgctgctccacgccgtcatggccaaggcgcgcaaggacctcggcctgctcctcccggcctcgcccacctccgtcgccgccgcgggccacgtgccgttcctgcagctcccgcgccagaactccggccgcgccgccgcgccgtcgcccctgtcggtgtcctcgccgtcgtcgtgggcgcaggcgccggtgttctcgaggagcaacagcacgagtaatggcaccgaggaggaggcggcggcgggggctggggaggagctgcctagtcccgttaacggcggggcggcgccgttctttcctcagggcggggacgcgctcctggacgatttgcagttgcaggagcagctcgcgttcctcaacgagggcggcgtgaacccggcgcaccagctcccggggctcgacgccggggagtgctggagccccggcccgggggatggcggtgggatgctcccgttcggcctcgggtggcccaacggcggccccgtgcaccgccgaagcgcatcagtgaacgagctctgcctcggcgggggcggcggcggtgacggattcgggtggaagccctgcctctactatgctcgcgggttctgcaagaacggtagcagctgcaggttcgtccacagcggcctccccgacgacgcagctgcgctcgccgccaccaagatggaagccgccgccgatcaacagcagcagtgccagcaggacttcctcctctccaagagccagcgcctcggccccgccgccttcccctactcctccaccggctccctcccgggctcgccctccgccgccagcaagtgcctcagc

SEQ ID NO: 24446 - protein, 313 aa, Panicum virgatum
  misc_feature: Ceres CLONE 1858734
  misc_feature (229)..(254): Pfam Name: zf-CCCH Pfam Description: Zinc finger C-x8-C-x5-C-x3-H type (and similar)
MDAYEATKVVFSRIQALDPDHAAKIMGLLLIQDHGEKEMIRLAFGPESLLHAVMAKARKDLGLLLPASPTSVAAAGHVPFLQLPRQNSGRAAAPSPLSVSSPSSWAQAPVFSRSNSTSNGTEEEAAAGAGEELPSPVNGGAAPFFPQGGDALLDDLQLQEQLAFLNEGGVNPAHQLPGLDAGECWSPGPGDGGGMLPFGLGWPNGGPVHRRSASVNELCLGGGGGGDGFGWKPCLYYARGFCKNGSSCRFVHSGLPDDAAALAATKMEAAADQQQQCQQDFLLSKSQRLGPAAFPYSSTGSLPGSPSAASKCL

SEQ ID NO: 24447 - DNA, 613 bp, Panicum virgatum
  misc_feature: Ceres CLONE 1858734-R
catatgcagtattgctagatatatataatatatatatacaagtaatccagtgttacccctagttattagaagacatatatactactagttgtccttagttttaccagtagctgattccatcagcacaaatgattttactgtcccaagatccttgttgtactctgcaaccacagccacctccactaggtttactaaactgtgaggttaatccacaatgctggtactagccaacagccacaggtcacatgtaacaccagtacagctacagcctgctgcaagctgcagataattgtatacaggggcggcccagggactggagaaggagcacatggccctggcagtggtctgtggtattttaactgcaagatcccaagccattcctatggactaatgtatattacaagagttgtgtgagatctcatatgtctataatcttctgtcgctccctgtgttttatgtctcatagtatcaacccctgatcggcagaggcaggtcgctacaaaatatgtgattattttgcttttgttcccatctggtggagtggatcccacatcccagtgtagttgacacctctacagaaagaatgaaaataaagtgaaagaaaattcccccg

SEQ ID NO: 24448 - DNA, 400 bp, Panicum virgatum
  misc_feature: Ceres CLONE 1858770
  misc_feature: Encodes the peptide sequence at SEQ ID NO. 24449
atcccctgtgctacacatctcatcgcatcttcttctttgccaactaagctctctcgcgttcttgattttgcctgggaaccaagggccaccctccccgatctcgttcacccccacccccgagggtgccaccaacacatatccccacaatatatgggggggagaggggggcccggcatacacctcaggagcaaaggaaggacggtgaacggccccatcaccagtgcgagccagctcccaaaatggaactacgatggctccagcaccgggcaggctcccggagaggacagcgaagtcatcctctaccctcaagccattttcaaggacccgttcaggaggggtgacaacatccttgtgatgtgcgactgctacacgccacaaggcgagccaatccccactaaca

SEQ ID NO: 24449 - protein, 133 aa, Panicum virgatum
  misc_feature: Ceres CLONE 1858770
  misc_feature (55)..(125): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Useful for making plants with modulated water use efficiency
IPCATHLIASSSLPTKLSRVLDFAWEPRATLPDLVHPHPRGCHQHISPQYMGGRGGPGIHLRSKGRTVNGPITSASQLPKWNYDGSSTGQAPGEDSEVILYPQAIFKDPFRRGDNILVMCDCYTPQGEPIPTN

SEQ ID NO: 24450 - DNA, 1365 bp, Panicum virgatum
  misc_feature: Ceres CLONE 1858772
  misc_feature: Encodes the peptide sequence at SEQ ID NO. 24451
aaacccccgcgccgagtccgccgacgaccgagaccctgagctcaccccgacgaccatggcctcctccaccctctcctcccccgctaaaccctgctactccgccgccaaaacccccgcccccatcgccaaccgcttaccaccccaaaatcccgcaaccacaaccctcccctccagcgccgccgccccccgcttcgcccatggcctctccgccgccgccgtccgagcgagccccagcgcccgccgcctccgcgcgctggcccgccccgtccgggcgtcgcagccgccgccgcggcggcggcccgagtacgtccccaaccgcatccacgaccccaactacgtccgcatcttcgacaccacgctccgcgacggggagcagtccccgggcgccaccatgaccagagccgagaagctcgtcgtcgcccgccagctcgcccgcctcggcgtcgacatcatcgaggccggcttcccggcatcctcccccgacgacctggacgccgtgcgctccatcgccatcgaggtcgggaacgcgcccctcggggaggacggccacgtgcccgtcatctgcggcctctcgcggtgcaacaggaaggacatcgacgccgcgtgggaagccgtcaggcacgcgcgccgcccgaggattcacaccttcatcgccaccagcgagatccacatgcagcacaagctcaggaagacgcccgagcaggtggtggcgattgccagggagatggtggcctacgcccgcagcctgggatgtcctgatgtcgaattcagccctgaggacgccggcaggtcaaatagagagtttctgtatcatatattagaggaagtcataaaagctggagctacaactctgaatatcccggacactgttggatacacccttccatatgaatttgggaacttaattgctgacataaaggcaaacactcctggaattgaaaatgctatcatttccacccattgccaaaatgaccttggtcttgcaaccgccaacacattagcgggtgctcgtgcaggagcacgtcagttagaggtgactattaatggtattggtgaaagagccggaaatgcttctttggaggaggttgtcatggcaattaaatgccgtggggaactcttagatggtctatatactggaatcaattcccaacatattactttgacaagcaaaatggtacaagagcacagtggacttcatgtacaaccacacaaagctattgttggtgccaatgcctttgctcatgaaagtggaattcatcaggatggaatgcttaaatataaaggaacttatgaaataatatcgcctgatgacattggtttaacacgtgcaaatgaatttggtattgttcttgggaaactcagtgg

SEQ ID NO: 24451 - protein, 436 aa, Panicum virgatum
  misc_feature: Ceres CLONE 1858772
  misc_feature (103)..(380): Pfam Name: HMGL-like Pfam Description: HMGL-like
  misc_feature: SWISSPROT Homolog: EC 2.3.3.13 2-isopropylmalate synthase
MASSTLSSPAKPCYSAAKTPAPIANRLPPQNPATTTLPSSAAAPRFAHGLSAAAVRASPSARRLRALARPVRASQPPPRRRPEYVPNRIHDPNYVRIFDTTLRDGEQSPGATMTRAEKLVVARQLARLGVDIIEAGFPASSPDDLDAVRSIAIEVGNAPLGEDGHVPVICGLSRCNRKDIDAAWEAVRHARRPRIHTFIATSEIHMQHKLRKTPEQVVAIAREMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLS

SEQ ID NO: 24452 - DNA, 700 bp, Panicum virgatum
  misc_feature: Ceres CLONE 1858772-R
  misc_feature: Encodes the peptide sequence at SEQ ID NO. 24453
tcccttgctgatgtacaggcaacatgtggaacccttggtttgtctacagcaactgtgaaactgataggaccagatggcgaggagaaaatagcatgctctgttgggacaggtccagtcgatgcagcttataaggctgttgaccaaattatccagattccaactgttctccgagaatatggtatgacctcagtcacagaaggcattgacgcgattgcaacaactcgagtggttgtcactggagacgtgaccaacaactccaagcatgccttgactggtcactctttcaatcgctccttcagtgggagcggggcatcaatggacgttgtggtgtccagcgtcagagcttacctgagtgccctgaacaagatgtgcagttttgctggcgctgtaaaagccagcagcgaggtatctgagagcacacgtgtgcaaagcaaagagtgagaccgtcgtcatccgattctcatatgggccgagcaatgtaagagctcttgagcaacttttcagagccacatttcatttcagtaataggctggttaatattggggtttccccttggtcagtgtgaagattgtgcgttctttctggaggatgtccgcttagaacaggcagagtttttggcccgttcagtgtacaacttgtatgttatagacgttatagaccatgctttcaataaggaaataatggtagggtctgtgaagcc

SEQ ID NO: 24453 - protein, 146 aa, Panicum virgatum
  misc_feature: Ceres CLONE 1858772-R
  misc_feature (1)..(124): Pfam Name: LeuA_dimer Pfam Description: LeuA allosteric (dimerisation) domain
  misc_feature: SWISSPROT Homolog: EC 2.3.3.13 2-isopropylmalate synthase
SLADVQATCGTLGLSTATVKLIGPDGEEKIACSVGTGPVDAAYKAVDQIIQIPTVLREYGMTSVTEGIDAIATTRVVVTGDVTNNSKHALTGHSFNRSFSGSGASMDVVVSSVRAYLSALNKMCSFAGAVKASSEVSESTRVQSKE

SEQ ID NO: 24454 - DNA, 529 bp, Panicum virgatum
  misc_feature: Ceres CLONE 1858773
  misc_feature: Encodes the peptide sequence at SEQ ID NO. 24455
gctatgacctctcctccgtcctcgctcccactctcgacctctctacaatggcgagaaggtgcacgagcagcgccggcggcaacgtgccgggcttggcggccatggcggcggcgtcttggctcctggtggcggtggcgctcgccggcgtcgccgacacccagctgcaggtggggttctactccttgccccgcccgggcgccgagtccaccgtcgcgtacctcgtccggctcgcttgctccgcctacccctccatcctgccggcgctcctccgcctccagttcctcgactgcttcctccggggctgcctccggctccgtcctcatcatcggctgccgcggcgtcagcgccgaggtggactacagcccgcatctaggcctccgctggctatagatcgtccagggcgcccagacgcttgtcgaggcccagagccccggcgtcttctcctgcaccgacatcctcgtcctcgacccccgctacgccgtcccattcgtacgcctactacatccttttccacatatacttctatctc

SEQ ID NO: 24455 - protein, 160 aa, Panicum virgatum
  misc_feature: Ceres CLONE 1858773
  misc_feature: SWISSPROT Homolog: EC 1.11.1.7 Peroxidase
MARRCTSSAGGNVPGLAAMAAASWLLVAVALAGVADTQLQVGFYSLPRPGAESTVAYLVRLACSAYPSILPALLRLQFLDCFLRGCLRLRPHHRLPRRQRRGGLQPASRPPLAIDRPGRPDACRGPEPRRLLLHRHPRPRPPLRRPIRTPTTSFSTYTSI

SEQ ID NO: 24456 - DNA, 2449 bp, Panicum virgatum
  misc_feature: Ceres CLONE 1858789
  misc_feature: Encodes the peptide sequence at SEQ ID NO. 24457
gaccaattccactttccacagctagcagaactggactgacccagtccgtcccatatgaaagatcggtggtgaatgaactcaaaaaccaagaagcagggactggcccggtagcaaaagaattcgcaggatcgatggttggattccagtggttcctcacaatcttcctcaccacatgcccactgttcttcctctcccagatcaagccatgtgcatgttcgaagcaggaccggagggccaggtacacctggaacactactttcgagcagatggaccagggccttctgttccaccgcggcgacgaatcggcgacgaccttacagccaggcagtctgggcttctacatggggaattcctccgcgcttgggttcagctcggacgaccccgggtggttcgtcatccccaagtggttcgatccgtggaggacgacgagccgtggtggcgatcagagggtggacctgcgcgaggcatccttcagcatcgtcttcaccttgagcgtggcagcaagcacaggcagcagcaccctgcacttcgacatccttcccagacttgatccctcgacctccgacggcgggggatttaccccccgcagcttcgagactgtcaagatcgaagcactggacagcacagcgttccattctggaagaactatccgggtgacaaccgcgttccagccaccggacaacgatgatcctgatgcggcggcggcgaggcgatacagcgtgcggatcgagtacgatcgcgctgcgcacaacctgaccgcgcgcctagcccgtgaggcagcagcaggaacggagacgcctgacgaagccaccctgcacctgggcgccaacgacaccatgtccccggacggcctgctcttcgccctctcgtcgaccatggggcagctcctgcaactccacacctggagcttcacgatcgaggtcccggagagcggccgctcgcggggggtcaacgccatcaccgtgctgtcctccgttctcgggtcggcagccgccgcggccgccatcgccgccgcggtgtacctgtacctcaactccaagtacaggaggtggaagaaggacctggaccagctggccaagtccatgcggcgcctccccggcgtgccgatgcaggtcgacttcgccgacatcaagaaggccaccggcaacttccacgaggccaccaggctggggcaaggcggattcggcgccgtctacaggtgcaggcttcctgctcccaacagcaagggggagttcgtggaggttgccgtcaagaagttcacccgggctgacaaccggggctacgaggacttcctggcggaggtcagcattatcaaccgcctgcgccacaaaaacatcgttcctctcgtagggtggtcttacaacagaggggagcccatactcatctacgagtacatgcccaatggcagcctggaccagcagctcttccgcaagagcggtgatgatgagcagcatccggcggcttctatctgccagtggagcactcgctacagcatcgtcagtgacattgcaaccgggttgcagtacgttcaccatgagtacgagcccatggtgctccaccgcgacatcaaggcgagcaacatcttgatcgacctcacgttccaggcacgcctcggggacttcggcctcgcctgcgtgctcgccgacggcaagaactcctacaccgaccacggcgccccgggaaccatcggcttcaggtcgccggagtacatctacggcggcaaggccacgaggaagacggacgtcttcgccttcggagtgctcgtcctggagatcgtgacggggaagagggcagtcggcagggacgtgcagtttgggcacgtcacggattgggtctggagccttcacgccgaggggaacctgctcgccgccgtcgacgccgccgccgacggcgagttcgacgccgaggaggccgtacggctgctgcagcttggaatggcgtgcagcaacccgaacccgagcgagcggcctagcatggtggacgccgtgaagatcatcggcaagtcggtgccgccgccggatttgcctccttccaagccgccgatggtgtggcccccggaagggtggagctcagtgacggcctctgattgtagcacgtcgacgagcaacttcaacaggaccccgtcgacgttcatggtggagactgcgggcagggagcgaagcatctcttctgaacacgaacgagaacgacgcggcaggttggccggttattccagaggaaaatcctggcagctagaggccgtccccgattcttactctgcacacggatgatctagtggcagggaaacttaattagctaggttgtcgtcactgaaatagagtacatcagatcacgtggatgatctggtgtttgtgatgagtagttgctgacaaattggtctgaaatcgacaagacagatcacaactttttgtactgtagagaaatctgttgtttgtactgctattcccag

SEQ ID NO: 24457 - protein, 712 aa, Panicum virgatum
  misc_feature: Ceres CLONE 1858789
  misc_feature (340)..(622): Pfam Name: Pkinase Pfam Description: Protein kinase domain
  misc_feature: SWISSPROT Homolog: EC 2.7.11.1 Non-specific serine/threonine protein kinase
MVGFQWFLTIFLTTCPLFFLSQIKPCACSKQDRRARYTWNTTFEQMDQGLLFHRGDESATTLQPGSLGFYMGNSSALGFSSDDPGWFVIPKWFDPWRTTSRGGDQRVDLREASFSIVFTLSVAASTGSSTLHFDILPRLDPSTSDGGGFTPRSFETVKIEALDSTAFHSGRTIRVTTAFQPPDNDDPDAAAARRYSVRIEYDRAAHNLTARLAREAAAGTETPDEATLHLGANDTMSPDGLLFALSSTMGQLLQLHTWSFTIEVPESGRSRGVNAITVLSSVLGSAAAAAAIAAAVYLYLNSKYRRWKKDLDQLAKSMRRLPGVPMQVDFADIKKATGNFHEATRLGQGGFGAVYRCRLPAPNSKGEFVEVAVKKFTRADNRGYEDFLAEVSIINRLRHKNIVPLVGWSYNRGEPILIYEYMPNGSLDQQLFRKSGDDEQHPAASICQWSTRYSIVSDIATGLQYVHHEYEPMVLHRDIKASNILIDLTFQARLGDFGLACVLADGKNSYTDHGAPGTIGFRSPEYIYGGKATRKTDVFAFGVLVLEIVTGKRAVGRDVQFGHVTDWVWSLHAEGNLLAAVDAAADGEFDAEEAVRLLQLGMACSNPNPSERPSMVDAVKIIGKSVPPPDLPPSKPPMVWPPEGWSSVTASDCSTSTSNFNRTPSTFMVETAGRERSISSEHERERRGRLAGYSRGKSWQLEAVPDSYSAHG

SEQ ID NO: 24458 - DNA, 407 bp, Panicum virgatum
  misc_feature: Ceres CLONE 1858803
  misc_feature: Encodes the peptide sequence at SEQ ID NO. 24459
tcgtcgttgtacgggaatcgatagcttgcaagtttcctccttcccctgcctgtgttgcccggtccgctttcccacatcagctccaaatccctgacgccgatggaccccgccggccggcgcgcggccgccatcgcgcggcacctcgccgccggcgcgctccccgttccaccgcccctcgctgccgcggccgcgctgctgggcccctccccttgcctcagctacgaaccaccggaggcggacgaaaacgcgccagctttcccgcccacacagctccgtgcgctacttgacaggcacaatctcatgaagcgcaactggatgattaccgtcatgtaggagagccggctattttgcccgattcgacgtggcggcgggagtagggtctccatgtcgccagactactacgacgg

SEQ ID NO: 24459 - protein, 77 aa, Panicum virgatum
  misc_feature: Ceres CLONE 1858803
  misc_feature: SWISSPROT Homolog: EC 1.3.3.6 Acyl-CoA oxidase
MDPAGRRAAAIARHLAAGALPVPPPLAAAAALLGPSPCLSYEPPEADENAPAFPPTQLRALLDRHNLMKRNWMITVM

SEQ ID NO: 24460 - DNA, 654 bp, Panicum virgatum
  misc_feature: Ceres CLONE 1858814
  misc_feature: Encodes the peptide sequence at SEQ ID NO. 24461
ctcgtcctcgtccttccccacctcccgcttccccttcgccgccggcgccggggcccccggcggcggtggcggaggaggaggtggaagcagcgtgcggccgtgggggtcgagcggcgggacgtctgtttcgtcttcggggaagcggatacagaaggagctgctggacctcaacgcctccgactgctccgccgggcccaggggcgacaacctctaccactggctgtccaccatcatcgggccccaaggatcgccgtatgaaggagggatatttttccttgatatcgtgtttccccccgattatcctttcacacctccgatggtaactttcaaaacaaggatttaccactgcattgttgacgcctctggtaaagtgcatttgggcattctgaatgatggctggagtccagctttcactatttcaaaggtgttactggccatctgagacttcatcagcaatccagatccatacaccccgcttgtgatgatcatttcacgtcggtatctgactgacagaactaaacacgatgaaatagcagctgagtggacaatgagttgtgcacatgatctattcattttctccagtcaaagtagttaaagcatgcccttcaaatctttcacttgaaaccaaatcctgttggttatcattctggtgtt

SEQ ID NO: 24461 - protein, 146 aa, Panicum virgatum
  misc_feature: Ceres CLONE 1858814
  misc_feature (48)..(146): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for making plants with modulated low light sensitivity
  misc_feature: Useful for making plants with modulated light quality sensitivity
  misc_feature: Useful for biocontainment applications
SSSSFPTSRFPFAAGAGAPGGGGGGGGGSSVRPWGSSGGTSVSSSGKRIQKELLDLNASDCSAGPRGDNLYHWLSTIIGPQGSPYEGGIFFLDIVFPPDYPFTPPMVTFKTRIYHCIVDASGKVHLGILNDGWSPAFTISKVLLAI

SEQ ID NO: 24462 - DNA, 1458 bp, Panicum virgatum
  misc_feature: Ceres CLONE 1858823
  misc_feature: Encodes the peptide sequence at SEQ ID NO. 24463
acaatctcacatcgtctcatcgttcggagcgcacaacccccgtgttccaaatccaaattgctcttctcgcgaccctcggcgatccttcccccgcttcaaggtacggcgatcctctcccccgtcctcttgccccatctcctcgttcggcgtggtttggtggttctgcttggtctgtggctaggaactaggccgaggcgttgacgaaatcatgctagatccgcgtgtttcctgatcgtgggtggctgggaggtggggttttcgtgtagatctgatcggttccgctgtttatcctgtcatgctcatgtgatttgtggggattttaggtcgtttgtccgggaatcgtggggttgcttctaggctgttcgtagatgagatcgttctcacgatctgctgggtcgctgcctaggttcagctaggtctgccctgtttttgggttcgttttcgggatctgtacgtgcatctattatctggttcgatggtgctagctaggaacaaacaactgattcgtccgatcgattgttttgttgccatgtgcaaggttaggtcgttatctgattgctgtagatcagagtagaataagatcatcacaagctagctcttgggcttattatgaatctgcgtttgttgcatgattaagatgattatgctttttcttatgctgccgtttgtatatgatgcggtagcttttaactgaatagcacacctttcctgtttagttagattagattagattgcatgatagatgaggatatatgctgctacatcagtttgatgattctctggtacctcataatcaactagctcatgtgcttaaattgaaactgcatgtgccacatgattaagatgctaagattggtgaagatatatacgctgctgttcctataggatcctgtagcttttacctggtcaacatgcatcgtcctgttatggatagatatgcatgatagatgaagatatgtactgctacaatttgatgattcttttgtgcacctgatgatcatgcatgctctttgcccttactttgatatacttggatgatggcatgcttagtactaatgatgtgatgaacacacatgacctgttggtatgaatatgatgttgctgtttgcttgtgatgagttctgtttgtttactgctaggcacttaccctgttgtctggttctcttttgcagatgcagatctttgtgaagaccctcaccggcaagaccatcaccctcgaggtggagtcctccgacaccattgacaacgtcaaggccaagatccaggacaaggagggcatccccccagaccagcagaggctcatcttcgctggcaagcagctcgaggacgggcgcacgcttgctgactacaacatccagaaggaaagcaccctccacctggtgctgcgcctgagaggaggcatgcagatcttcgtgaagaccctcaccgggcagaccatcaccctcgaggtggagtcct

SEQ ID NO: 24463 - protein, 95 aa, Panicum virgatum
  misc_feature: Ceres CLONE 1858823
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGQTITLEVES

SEQ ID NO: 24464 - DNA, 715 bp, Panicum virgatum
  misc_feature: Ceres CLONE 1858827
  misc_feature: Encodes the peptide sequence at SEQ ID NO. 24465
gacggacgcctgccgcttggcttggctcctctccacctccacctccacctcctctcgcggtctcgcctcgcgtcgcttctcccccactccactccgcctcccccaccccccctcgcgccgcggcgccctctgatctgatgccggggaggccctgatggcggcggcgggagctggagcggccggcgggggagccgggggcggggagggctcctcctccccggcgggcgtcgcgatcgggccccaccaccacggggccgcggaagaggtcatgtggcaaatgactttaggaggaggagaatctatggaacatggtcccttccctgagagaattggagaaccagactgtagttattatatgaggactggactttgtagatttggggcaacgtgcaagttcaatcacccgccaaacaggaagctggctgttgctgctgcaaggatgaaaggggagtatccttatagagttggtcaaccagagtgtcaatattatctgaagaccgggacatgcaagtttggagcaacatgcaagtttcatcacccccgagaaaaggctgcgattgcaacgcgagtacagttgaatgttctaggttacccaataaggccgaatgagaaggaatgtgcttattatttgcgaacagggcagtgcaaatttgcaagcacatgtaagtttcatcatccaccgccctccaatacgatgggtgctgtacgcggctct

SEQ ID NO: 24465 - protein, 186 aa, Panicum virgatum
  misc_feature: Ceres CLONE 1858827
  misc_feature (59)..(85): Pfam Name: zf-CCCH Pfam Description: Zinc finger C-x8-C-x5-C-x3-H type (and similar)
  misc_feature (104)..(130): Pfam Name: zf-CCCH Pfam Description: Zinc finger C-x8-C-x5-C-x3-H type (and similar)
  misc_feature (150)..(176): Pfam Name: zf-CCCH Pfam Description: Zinc finger C-x8-C-x5-C-x3-H type (and similar)
  misc_feature: Useful for making plants with modulated nitrogen use efficiency
  misc_feature: Useful for making plants with modulated low light sensitivity
MAAAGAGAAGGGAGGGEGSSSPAGVAIGPHHHGAAEEVMWQMTLGGGESMEHGPFPERIGEPDCSYYMRTGLCRFGATCKFNHPPNRKLAVAAARMKGEYPYRVGQPECQYYLKTGTCKFGATCKFHHPREKAAIATRVQLNVLGYPIRPNEKECAYYLRTGQCKFASTCKFHHPPPSNTMGAVRG

SEQ ID NO: 24466 - DNA, 683 bp, Panicum virgatum
  misc_feature: Ceres CLONE 1858827-R
accttatgtacggaaccgcaacctcaccgacaggtgatgcgccaaccatgcactaccagttggcatcctcaccagggcattctgaaagattgctcgacggagggtccggaaggtctcataggatttcccaaactgattcccagcaaataccctctggcaatggaagcactgagagagaggcgtcataagccgccctcctcagcctttcctcatgcttattcccattcttgtctcttcagtaattatctcccaacacattcaaagagctgaagctgtacaggtcctcgtccatccttcctccgctgttctgagcttccgcattccggtgcttcgccatgtatcacattcaagcaggaaaaagttcttgctcaccccaccctggtgcccgtttgccctctgaaaaataatggggtaaccattcatatttatccgtccgtacacagacacaagatacactcactccctgatccctttgttgtagttatacaggtgacctgcggtgaacaaagcttaccaaactgactactggggttgcaacttcttcctatctttccttttgctcttattcctttttaggcaattggggtgagggcaggacgtgctgctcgtgcaagtctgcatgttcaaaacagcgggaataataccctgccttcaatgtaataattgtaatctatgtatgaccc

SEQ ID NO: 24467 - DNA, 629 bp, Panicum virgatum
  misc_feature: Ceres CLONE 1858845
  misc_feature: Encodes the peptide sequence at SEQ ID NO. 24468
catagcaaggaaatgaaggagatgagattgagtgcgcgtttgagcaactgctcatcaaatggggtttcacgagtcatgtccattggcagcaatgaagctgctccaagaagaggaatggttcttccatttaaccctcttgccatgtcctttgataatgtgaactactatgtcgacatgcctgcggaaatgaaacagcaaggagtgcaggataacaggcttcaattattgcgtgaggttacagggtcattcaggcctggagtactgacagcgcttatgggtgtcagtggagctggaaagactactcttatggatgtcttggctggaagaaagactgggggttatattgaaggtgatatcagaattgccggctatcccaagaaccaagccacatttgcaaggatttctggttactgcgagcaaaatgatatccattctcctcaggtcacagttagggaatctttgatatactctgccttcttgcgccttcctgaaatgattggagatcaagaaatcactgatgatatcaagattcaatttgttgatgaagttatggaactagtggagcttgacaatctgaaggatgctttagttggcctaccaggaatcacagggctttcaacagagcaaag

SEQ ID NO: 24468 - protein, 209 aa, Panicum virgatum
  misc_feature: Ceres CLONE 1858845
  misc_feature (86)..(209): Pfam Name: ABC_tran Pfam Description: ABC transporter
  misc_feature: SWISSPROT Homolog: EC 3.6.3.25 Sulfate-transporting ATPase
HSKEMKEMRLSARLSNCSSNGVSRVMSIGSNEAAPRRGMVLPFNPLAMSFDNVNYYVDMPAEMKQQGVQDNRLQLLREVTGSFRPGVLTALMGVSGAGKTTLMDVLAGRKTGGYIEGDIRIAGYPKNQATFARISGYCEQNDIHSPQVTVRESLIYSAFLRLPEMIGDQEITDDIKIQFVDEVMELVELDNLKDALVGLPGITGLSTEQ

SEQ ID NO: 24469 - DNA, 707 bp, Panicum virgatum
  misc_feature: Ceres CLONE 1858860
  misc_feature: Encodes the peptide sequence at SEQ ID NO. 24470
gacgacctgctcctcagtttgctccccttccgcctccgcgtccgcttcccatcttggcctggacacctgggctgcccccctccgtttccgcgctccccggatgcgcaccgatctcgcgccgcgcgcctaagtcgccgccggaatccgcccctccctcgcgccgctgccagcgtcgggcgacaaggtgatactggtgccaaggtaggacgagaggggtcaagttcttactggtttcattcttgaagccgccgacttcacatgccaacaaccccgaggagcagaagccaggctaggaccactaggccttggatcttgccagggatggactttgcggattcaagacggaagcctaatttcacggggaagattgctgtggctgctgccctcactgtcatgtgcataattgtattgaaacagtcgcctggtttcagcggtaccaatgtgttctctcgccatgaaattggggtgacccatgtcttagtgacaggaggggctgggtatattggctcgcatgctactcttcgtctccttaaggacaactaccgtgttaccattgtggataacctttccagaggtaacatgggagctgtaagagttcttcaacggctgtttccacagcctggaatgcttcaatttatttatgctgatttaggcgatgccaaagctgtatcctttgtctaagcctagtggggtttttttttttgtct

SEQ ID NO: 24470 - protein, 119 aa, Panicum virgatum
  misc_feature: Ceres CLONE 1858860
  misc_feature: SWISSPROT Homolog: EC 5.1.3.5 UDP-arabinose 4-epimerase
  misc_feature: Useful for making plants with altered carbohydrate content
  misc_feature: Useful for making plants with altered cell wall content and/or composition
MDFADSRRKPNFTGKIAVAAALTVMCIIVLKQSPGFSGTNVFSRHEIGVTHVLVTGGAGYIGSHATLRLLKDNYRVTIVDNLSRGNMGAVRVLQRLFPQPGMLQFIYADLGDAKAVSFV

SEQ ID NO: 24471 - DNA, 2359 bp, Panicum virgatum
  misc_feature: Ceres CLONE 1858874
  misc_feature: Encodes the peptide sequence at SEQ ID NO. 24472
aagaagctaggaaaagtaacctgttcggccatggatctcttgctacaccgccgcctgccgccgctcctcctcgccgtcttggtcgccgcctcccatggcgttccttccagcggggacgacggcggctacgacgcctccttgtgcgtgtgggagccctacacctgcggcaacgtcatcatcaggtacccgttctacagcaggccgggagctctgctggggaacaccagctcgtactgcggctaccccggcctggagatccagtgcgaggacgggaaggcgttcctggagctcgagagcggcaactacaccgtctcgagcatcgactacgacaacctcacagtccagctcgtcgatcccgaggtcgtcgacgggaggagctgcccctggaccgaccacaacgtgacgtttcggagcttcgaatggttctactatcccaacaccacggtcgacctcctcttcttcctcaattgcaacttcctctcctccgacttgactcggccgtcaaactccagctccaccgcctgcaaattcgatggcggcgggcagcagccgtggcttgggatgtccttcgtgttcttggagcaagacgtgccgtttcgggagacgaactggtggcggtactgcagcgtagttattgaagtgcccgtgctcagatttggtctccctcttgatccacaaaatgaccgtacatggaaggacggtgggtacagcagcagccttcgtgacggattccagttggcgttgaatcagagtcagaagctcccggcgtgtaaccagtgcgagcgatcgaaggggcagtgcgggtacaaccagacggggggattcatggcctgcttgtgctccggcggccgagtcagcgctgctaacaattgcacctccgaaccttccggaggatcaaaaaggcaaaaaggagttattattggcgtctcgactgctgctggtcttgccgtgcttgctgctgctgctgccgcaggtttgttcatcatgcgcaagaggaagaagaagaacgtgatcaactcgtcctcgaagctcctcaagtacagcggctctggcgggaccccgcgtgcccgggtcggcgacatggagtccggctgcatcgaggacccaccgacgcacctcttcacctacgaggagctcgaggaggccaccaattccttcgatgagcaccgagagctcggtgatggcggcttcggcaccgtctacaaagggtacctcaaggacgggcgcgtggtggcggtgaagcggctgtacaacaacagctaccggcgcgtggagcagttccagaacgaggcgggcatcctgtccgggctgcgccacccgaacctggtcatgttctacggctgcacgccctgctcgagccgcgagctcctcctggtgtacgagttcgtcgccaacggcacggtcgccgaccacctgcacgggcaccgcgccccggagcgcgcgctgtcgtggccgctccgcctcagcatcgccgtcgagtccgccgcggcgctcacctacctccacgccatcgagccccccgtcgtgcaccgcgacgtcaagaccaccaacatcctcctcgacgccgacttccacgtcaaggtcgccgacttcggcctctcccgcctcttccccctcgacgtcacgcacgtctccaccgcgccccagggcacgccagggtacgtggatccagagtaccaccagtgctaccagctgacggacaagagcgacgtgtacagcttcggggtggtcctggtggagctcatctcgtcgaagcccgccgtggacatcacccggcaccgcaacgagatcaacctagccggcatggccatcagcaagatccagaactgccacctcgagcagctggtggacctcgacctgggctacgaggccgacccggcgacgaagaagatgatgaccatggtcgccgagctggccttccgctgcctgcagcagaacggcgagatgcgcccaccgatgaaggaggtgctcgaggtgctcaggagcgtccagggcgagtgcccggcggagaaggatggggacaagcacaaggacggccccttctcccccaccacggttcacgccccgtgggacagcagggccacgacgcccaacaccagcagggattagattagtgctcgagaagctgatcgagatttatctgtatttgttgccgctgctgcatggagatgcgcttgttgtgtgaggcatgccagattacctgtccctttggctttcagggctcgtagtttctggtgatgtagatatttgtttgttttgttggcaccgtcaggacagagggaatgtacatatatgtaaaagtggtgaatggcacttatagttaattagttatatgagtactggacatatgtcatatctg

SEQ ID NO: 24472 - protein, 692 aa, Panicum virgatum
  misc_feature: Ceres CLONE 1858874
  misc_feature (376)..(650): Pfam Name: Pkinase Pfam Description: Protein kinase domain
  misc_feature: SWISSPROT Homolog: EC 2.7.11.1 Non-specific serine/threonine protein kinase
MDLLLHRRLPPLLLAVLVAASHGVPSSGDDGGYDASLCVWEPYTCGNVIIRYPFYSRPGALLGNTSSYCGYPGLEIQCEDGKAFLELESGNYTVSSIDYDNLTVQLVDPEVVDGRSCPWTDHNVTFRSFEWFYYPNTTVDLLFFLNCNFLSSDLTRPSNSSSTACKFDGGGQQPWLGMSFVFLEQDVPFRETNWWRYCSVVIEVPVLRFGLPLDPQNDRTWKDGGYSSSLRDGFQLALNQSQKLPACNQCERSKGQCGYNQTGGFMACLCSGGRVSAANNCTSEPSGGSKRQKGVIIGVSTAAGLAVLAAAAAAGLFIMRKRKKKNVINSSSKLLKYSGSGGTPRARVGDMESGCIEDPPTHLFTYEELEEATNSFDEHRELGDGGFGTVYKGYLKDGRVVAVKRLYNNSYRRVEQFQNEAGILSGLRHPNLVMFYGCTPCSSRELLLVYEFVANGTVADHLHGHRAPERALSWPLRLSIAVESAAALTYLHAIEPPVVHRDVKTTNILLDADFHVKVADFGLSRLFPLDVTHVSTAPQGTPGYVDPEYHQCYQLTDKSDVYSFGVVLVELISSKPAVDITRHRNEINLAGMAISKIQNCHLEQLVDLDLGYEADPATKKMMTMVAELAFRCLQQNGEMRPPMKEVLEVLRSVQGECPAEKDGDKHKDGPFSPTTVHAPWDSRATTPNTSRD

SEQ ID NO: 24473 - DNA, 3522 bp, Panicum virgatum
  misc_feature: Ceres CLONE 1858892
  misc_feature: Encodes the peptide sequence at SEQ ID NO. 24474
aaggaaggcggcggcgcatcccaaagggaagggaagaagggaacggccaaacctagcctccacgccaagcaccgaagcacctcgccgatcccttccttccccccctccacttcgccgagctcaaggggattcctctccatgctcccttccaagaggtccgcgggctctgacggcgcccagtccaagaggcccaagctgggggacaatggggccagtaacggcactcggaatggggtgccgccggcgatcgacgaggacctgcacagcaggcagctcgccgtctacggcagggagacaatgcgccgcctcttcgcctccgacgtcctcgtctctggactcaatggcctcggtgctgagattgcaaagaatctagctcttgctggcgtcagatctgtcactgtacatgatgtcaaagatgtggacatgtgggacctctctgccaatttctttttgtccgaccaagatattggaaacaacagggcccttgcttgtgtatccaagttgcaggagctcaacaatgctgtcctggtatctgctctaacacaggaattgacaaaagagcacttatctaagttccaggctgttgttttcaccgatataagcttagacaaggcttatgaatttgatgactattgccacagccaccaccctccaatcgccttcatcaaagctcaagtttctggacttttcggtagtgtcttttgtgattttggacctgagtttaccgtacttgatgttgatggtgaagatccacatactggtataattgcatctatcagcaatgacagccctgcaatggtatcctgtgttgatgatgagcgtcttgagtttcaggacggtgatcttgttgttttctctgaggtccagggcatggaagaactgaatgatggtaaaccaagaaaggtcaaaaatgctaggccattttcatttaccattgaggaggatacaggtagctatggtgtttattcaaaaggtggaattgttacacaagtgaaggaaccaaaggttctacgtttcaagtcactaagagatgctatgaaagatcctggcgatttccttctgagtgacttctcaaagtttgaacgttcacctgtaattcacctagcatttcaagctctggatagttttaggaaagaacatgggcgatatcctaccgctggttgtgagcaggatgctcaaagctttctcaagtttgttgctgatattaatgaagcatcaattgattctaagcaggaaaaaattgatgacaagttgctccggcatttcgcaagtggttctcgagctgttttgaacccaatggccgcaatgtttggtggtatcgttggtcaggaagttgtgaaagcatgttcagggaaattccatccgctttaccagttcttctactttgattctgttgaatctctcccgacataccagttggatccccaagacttgaagccatcaaacagccgctatgatgctcagatctctgtatttggttccaagcttcagaagaagctgcaagatgcaaatattttcattgtgggttctggtgcccttggatgtgaattcttgaagaaccttgccttaatgggtgtctcttgcagctccaagtcgaagctaactataacagatgatgatgtcatcgagaaaagcaatttgagccgccaatttctattccgtgactggaacattggacaggcaaagtcaactgtggctgccgctgctgccagagctatcaaccccagcctccaaattggcgcgcttcagaaccgtgcctgtccagatactgaaagtgtgttccattacacattctgggacggactggatgttgtcatcaatgcacttgataatgttaatgctaggatgtatatggacatgaggtgcctgtacttccagaagccactactggagtcagggacgttgggtgcaaagtgcaatactcaaatggtcattcctcaccttactgaaaattatggagcttcaagagacccaccagagaagcaggcacccatgtgcacagttcattcttttccacacaatattgatcattgcttgacatgggctcgttcagagtttgagggtttgctagagaaaacaccaaatgaagtaaattcttttctgtctaatcctactcaatattctgctgccatgaggaaggcaggtgatgcccaggcaagagaactacttgaacgtgtctctgaatgtcttggcaaggagcgatgcattacatttgaggactgcataacttgggcccgacttaggtttgaggattatttctcaaaccgtgtgaagcagctcacattcacttttcccgaagatgcttctactagcacaggcactcctttctggtctgccccaaagcgctttcctcggcctctgcaattttcagccactgactcatctcacattcacctcattatgtctgcttcaatactgagagcggagtcatttggaattgctatacctgattgggcaaagaacacaagtaagctggctgatgcagtcaataaggtcgcagttcctgaatttgagccaaagaaaggggtgaatattgtgacagatgagaaggctactaacctttctagtgcctcagttgatgatgttgctgttatcgatgaccttctgtccaagttagaagaatgtgcaaagaatctgcctccagggttccaaatgaaacctatccaatttgagaaggatgatgacactaattttcacatggatttaatatctgggtttgcgaacatgcgtgcaaggaactacagcattcctgaggttgacaagttgaaggccaagttcatcgctggaagaatcatccctgccattgcaacttcaacagccatggccacaggtcttgtgtgccttgagctatacaaggttattgctggggagcaccctattgaggactaccgcaacacatttgccaacctagcgctgcctctgttctcgatggccgagcctgttcctgccaaggtgatgaagcaccaagaccttagctggacggtatgggatcggtggtcgatcaagggcgacctgactgttgcggagctcctgcaatggttcagcgacaagggcctcagtgcttacagcatgtcctgtggcacgtctctgctgtacaatagcatgttcccgaggcacaaggaaagactgcagaagaaggttgttgatgtggcgagggaagtcgctaaggtggaggtccctgagtacaggaggcacatagatattgtggtggcctgcgaggacaatgatgggaacgacattgatatccctctcgtatccgtccatttccggtagtctgcttctggggccagattgtagaaagatggcttcgttgtttttgttgtgagacctggcactgaagacgctcctagcttgccatgttggcactgatagctctatctattatccggcctcttatcaatatactgtagtagtattcattagtattgtgtagtgtgctgctcttgtagctcctgcgcatgccacatctaattggatggttacagttaatcggcaggaaacttgaatctgtttgtttctttc

SEQ ID NO: 24474 - protein, 1044 aa, Panicum virgatum
  misc_feature: Ceres CLONE 1858892
  misc_feature (455)..(599): Pfam Name: ThiF Pfam Description: ThiF family
  misc_feature (58)..(191): Pfam Name: ThiF Pfam Description: ThiF family
  misc_feature (843)..(911): Pfam Name: UBACT Pfam Description: Repeat in ubiquitin-activating (UBA) protein
  misc_feature (742)..(803): Pfam Name: UBACT Pfam Description: Repeat in ubiquitin-activating (UBA) protein
MLPSKRSAGSDGAQSKRPKLGDNGASNGTRNGVPPAIDEDLHSRQLAVYGRETMRRLFASDVLVSGLNGLGAEIAKNLALAGVRSVTVHDVKDVDMWDLSANFFLSDQDIGNNRALACVSKLQELNNAVLVSALTQELTKEHLSKFQAVVFTDISLDKAYEFDDYCHSHHPPIAFIKAQVSGLFGSVFCDFGPEFTVLDVDGEDPHTGIIASISNDSPAMVSCVDDERLEFQDGDLVVFSEVQGMEELNDGKPRKVKNARPFSFTIEEDTGSYGVYSKGGIVTQVKEPKVLRFKSLRDAMKDPGDFLLSDFSKFERSPVIHLAFQALDSFRKEHGRYPTAGCEQDAQSFLKFVADINEASIDSKQEKIDDKLLRHFASGSRAVLNPMAAMFGGIVGQEVVKACSGKFHPLYQFFYFDSVESLPTYQLDPQDLKPSNSRYDAQISVFGSKLQKKLQDANIFIVGSGALGCEFLKNLALMGVSCSSKSKLTITDDDVIEKSNLSRQFLFRDWNIGQAKSTVAAAAARAINPSLQIGALQNRACPDTESVFHYTFWDGLDVVINALDNVNARMYMDMRCLYFQKPLLESGTLGAKCNTQMVIPHLTENYGASRDPPEKQAPMCTVHSFPHNIDHCLTWARSEFEGLLEKTPNEVNSFLSNPTQYSAAMRKAGDAQARELLERVSECLGKERCITFEDCITWARLRFEDYFSNRVKQLTFTFPEDASTSTGTPFWSAPKRFPRPLQFSATDSSHIHLIMSASILRAESFGIAIPDWAKNTSKLADAVNKVAVPEFEPKKGVNIVTDEKATNLSSASVDDVAVIDDLLSKLEECAKNLPPGFQMKPIQFEKDDDTNFHMDLISGFANMRARNYSIPEVDKLKAKFIAGRIIPAIATSTAMATGLVCLELYKVIAGEHPIEDYRNTFANLALPLFSMAEPVPAKVMKHQDLSWTVWDRWSIKGDLTVAELLQWFSDKGLSAYSMSCGTSLLYNSMFPRHKERLQKKVVDVAREVAKVEVPEYRRHIDIVVACEDNDGNDIDIPLVSVHFR

SEQ ID NO: 24475 - DNA, 663 bp, Panicum virgatum
  misc_feature: Ceres CLONE 1858894
  misc_feature: Encodes the peptide sequence at SEQ ID NO. 24476
aagaagagcgccctcctcctccggctcttcttctccaccaccaccacctcctcctagcgctgccgcgcgccgcccccctgagcaccaccacactgcggcaatggcgggcaacgggctgatcgtggagaacgacccgctcaactggggcgcggcggcggcggagctggccgggagccacctggacgaggtgaagcggatggtggcgcaggcgcggcagcccgtggtcaagatcgagggctccaccctccgcgtcggccaggtggccgccgtcgccgccgcccgggacgcgtccggcgtcgccgtcgagctcgacgaggccgcccgcccccgcgtcaaggccagcagcgagtggatcctcgactgcatcgcccacggcggcgacatctacggcgtcaccaccggcttcggcggcacctcgcaccgccgcaccaaggacgggcccgcgctccaggtcgagctgctcaggcatctcaacgccggcatcttcggcaccggccgcgacggccacacgctgccgtcggaggtggtccgcgcggcgatgctggtgcgcatcaacaccctcctccagggctactcgggcatccgcttcgagatcctcgaggccctcgccaagctgctcaacaccggcgtcagcccgtgcctgccgctccggggcaccatcac

SEQ ID NO: 24476 - protein, 187 aa, Panicum virgatum
  misc_feature: Ceres CLONE 1858894
  misc_feature (41)..(187): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MAGNGLIVENDPLNWGAAAAELAGSHLDEVKRMVAQARQPVVKIEGSTLRVGQVAAVAAARDASGVAVELDEAARPRVKASSEWILDCIAHGGDIYGVTTGFGGTSHRRTKDGPALQVELLRHLNAGIFGTGRDGHTLPSEVVRAAMLVRINTLLQGYSGIRFEILEALAKLLNTGVSPCLPLRGTI

SEQ ID NO: 24477 - DNA, 674 bp, Panicum virgatum
  misc_feature: Ceres CLONE 1858909
  misc_feature: Encodes the peptide sequence at SEQ ID NO. 24478
agatcaccagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaaggagaagaagcacggcgagggccaccacgacggccgcagcagcagcagcgacagcgactgatcgcctcgcggcgcgccgtgcttgccggtgaaaaaggtgcttggagaggactatctaccggaagctgtgtgatgtaatatgtttcacgagtgccatacgtgtgtgtgctaatcaagggagaaatgaaaaaaaaaacctttcatgttgatcaatgtactcctaatgatggctccacggtgctagcttgtaataataaaatgttaatgcagaaattggtctgctagattgtgtctttgacatgtattcacgggcatcatgcatactacatactagtatttctttgctgc

SEQ ID NO: 24478 - protein, 101 aa, Panicum virgatum
  misc_feature: Ceres CLONE 1858909
  misc_feature (2)..(101): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKDKKKKKEKKHGEGHHDGRSSSSDSD

SEQ ID NO: 24479 - DNA, 657 bp, Panicum virgatum
  misc_feature: Ceres CLONE 1858916
  misc_feature: Encodes the peptide sequence at SEQ ID NO. 24480
ttttttagtcatctctcccggcggcgcctccacatctcgtctctcggatcggaaggcgaaaccaagcactaccatatatattactactgcgatcttcaccacaagtcactatggcgaagttcacagcggaggagctccgtgccatcatggacaaaaagaacaacatccgtaatatgtctgttattgctcatgtggaccacggcaagtctacccttacagactcccttgtggcagctgctgggattattgcccaggaagttgctggtgatgtccgcatgactgatactcgcgctgatgaagcagagcgtggtattacaatcaaatccactggtatctctctctactatgagatgactcctgagtcactgaagaattacgagggtgagagagatggcaaccagtatttgatcaaccttatcgactcacctgggcacgtcgatttttcttcggaagtgacagctgcccttcgtatcaccgatggtgctctggtggtggttgactgtattgaaggtgtctgcgtgcaaactgagactgtgctccgtcaggctcttggtgagaggattaggccagtccttactgtgaacaagatggacaggtgcttccttgagcttcaggttgagggtgaggaagcctaccagactttctcccgtgtgattg

SEQ ID NO: 24480 - protein, 182 aa, Panicum virgatum
  misc_feature: Ceres CLONE 1858916
  misc_feature (17)..(181): Pfam Name: GTP_EFTU Pfam Description: Elongation factor Tu GTP binding domain
  misc_feature: SWISSPROT Homolog: EC 2.7.7.4 Sulfate adenylyltransferase
MAKFTAEELRAIMDKKNNIRNMSVIAHVDHGKSTLTDSLVAAAGIIAQEVAGDVRMTDTRADEAERGITIKSTGISLYYEMTPESLKNYEGERDGNQYLINLIDSPGHVDFSSEVTAALRITDGALVVVDCIEGVCVQTETVLRQALGERIRPVLTVNKMDRCFLELQVEGEEAYQTFSRVI

SEQ ID NO: 24481 - DNA, 2668 bp, Panicum virgatum
  misc_feature: Ceres CLONE 1858921
  misc_feature: Encodes the peptide sequence at SEQ ID NO. 24482
actaccaggcccaggcccccacctccatggcggtcctcgccatcctcctcctcctcctcctcgtcaccttcctcccgtacagcgccctcgccgccttctccccggccttccccttcttcctcgcctgcggcgcagactcgagtgtctccttcccgcgggacagccctgcccgcaccttcatcaaagacgacccgttcttgacctcctcgcgcgcccaggcgctgaagaacgccaacgccaacagcgccgcctctccgttctatgccgccgcgcgcgcctcaagctcggccttctcctacaacctccccatcaccgacgactccgccgggcaggccgcgttcgtcgtcctccgcctccacttcgtccctttcgccgcctcgcaatccggcgtgagcatcgagtccgcgagcttcgcggtctccgttcgggacgcgtacaccgtactgtcctccttctcgccgccgagcgccggcgtcgtcaaggagttcttcatcccggcagccggctccggcgacttccgcatcacgttcacgccggacgccggctcggccgcgttcgtcaacgccgtcgaggtgttcccggctccatcggagctgctgtggaacagctcggtgacgcaggtgggcaccgcggcgcacgccgacatggcccagtggcagcagcaggcgctggagacggtgtaccgcctcaacgtgggcggccccatggtgaccaaggagaacggcacgctctggcggacgtggctccccgacgaccccttcctcttcggccccgcggggatctcgatggtgaacacgaccaacaccccaatcgtgtacgacgacgccgcctacacccgcgaggtggcgccggacatcatctacaagacgcagcgcgcgacgaatgcgtcggcggggaggttatcgctgcagccgccgcttttcaacgtcacctgggccttcccggcggaaccggggtccagctacctcgtccgtctccacttctgcgactacgagctggtgagcagcgtcgtcggagaaggcatcatgttcaacgtcttcatcgggccagacatgggtaccccagacctgatgccgacgaaaaccattgcgacgcaagcgaaccgtgccttctacctagactacgcggccgcggcgccgattgccggcgggaacctcaccgtcagcatcggcaagtcggtcaagagcagcgccgatgaaggtggctttctgaatggggtagagatcatgcagctgcgaccttcggactcgagcttcaagacgacggggtcgcgtgccagcagcaacaagaggacggtcttgatcatcaccctctcgagcgtgctgggcgcctccgtcctcgcgtgcgccgcgctgtgctggatggcgctgctgcggagaagacgccatgcgccgcggccggcgccggaggtggagaaggaggccagcaccctgccttggtcgccgtacacgcaggacagctcctccgggtggcccgtcgagccttcgagccggtctggtacgaccggcgcgatgcagcagagggtgggcgcgcagcagctccacatcccgctggaggagctcaaggcggccacggacaacttccacgagcgcaacctgatcggcgtcggcgggttcggcaacgtgtaccgcggcgcgctccgcgacggcacccgcgtggcggtgaagcgcgcgacgcgcgcgtccaagcaggggctccccgagttccagacggagatcgtggtgctgtcccgcatccggcaccggcacctggtgtccctgatcggctactgcaacgagcaggcggagatgatcctggtgtacgagtacatggagatgggcacgctgcggagccacctgtacggggggcccgagcccgactcctccggcgaggatgcgccgccgccgctgtcgtggaagcagcggctggagatctgtatcggcgcggcgaggggcctgcactacctgcacacgggctactcggagaacatcatccaccgcgacgtcaagtccaccaacatcctcctcggcgacggcttcatcgctaaggtggccgacttcgggctgtcccgcgtggggccgtcgctcggggagacgcacgtgagcacggcggtgaagggcagcttcgggtacctggacccggagtacttcaagacgcagcagctgacggaccgctccgacgtctactccttcggggtggtgctgctcgaggtgctgtgcgcgcggccggtgatcgaccagcaggcgccggaccgcgaccagatcaacctggcggagtgggccgtggcgtgccagcggcgggggcagctgggcaaggtcgccgacccgcggatcctcggccagatgaacgacaactcgctgcgcaagttcgcggagacggcggtgaggtgcctggcggactacgggcaggagcggccgtccatgggcgacgtgctctggaacctcgagtactgcctgcagctgcaggagacgcacgtgcgccgggacgcgttcgaggacagcggcgccgtcggggcgcagttccccgacgacgtcgtggtgccgcggtgggtgccgtcgtcgaccagcttcctcacgaccggcgacaccgacgagacggccatctgcgtcaccgacgtgggcgtcgccaacagcaaggtgttctcccagctgagcagcggcgaggggcgataatgactgctgatgagcct

SEQ ID NO: 24482 - protein, 874 aa, Panicum virgatum
  misc_feature: Ceres CLONE 1858921
  misc_feature (519)..(799): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with altered carbohydrate content
  misc_feature: Useful for making plants with modulated biotic stress sensitivity
MAVLAILLLLLLVTFLPYSALAAFSPAFPFFLACGADSSVSFPRDSPARTFIKDDPFLTSSRAQALKNANANSAASPFYAAARASSSAFSYNLPITDDSAGQAAFVVLRLHFVPFAASQSGVSIESASFAVSVRDAYTVLSSFSPPSAGVVKEFFIPAAGSGDFRITFTPDAGSAAFVNAVEVFPAPSELLWNSSVTQVGTAAHADMAQWQQQALETVYRLNVGGPMVTKENGTLWRTWLPDDPFLFGPAGISMVNTTNTPIVYDDAAYTREVAPDIIYKTQRATNASAGRLSLQPPLFNVTWAFPAEPGSSYLVRLHFCDYELVSSVVGEGIMFNVFIGPDMGTPDLMPTKTIATQANRAFYLDYAAAAPIAGGNLTVSIGKSVKSSADEGGFLNGVEIMQLRPSDSSFKTTGSRASSNKRTVLIITLSSVLGASVLACAALCWMALLRRRRHAPRPAPEVEKEASTLPWSPYTQDSSSGWPVEPSSRSGTTGAMQQRVGAQQLHIPLEELKAATDNFHERNLIGVGGFGNVYRGALRDGTRVAVKRATRASKQGLPEFQTEIVVLSRIRHRHLVSLIGYCNEQAEMILVYEYMEMGTLRSHLYGGPEPDSSGEDAPPPLSWKQRLEICIGAARGLHYLHTGYSENIIHRDVKSTNILLGDGFIAKVADFGLSRVGPSLGETHVSTAVKGSFGYLDPEYFKTQQLTDRSDVYSFGVVLLEVLCARPVIDQQAPDRDQINLAEWAVACQRRGQLGKVADPRILGQMNDNSLRKFAETAVRCLADYGQERPSMGDVLWNLEYCLQLQETHVRRDAFEDSGAVGAQFPDDVVVPRWVPSSTSFLTTGDTDETAICVTDVGVANSKVFSQLSSGEGR

SEQ ID NO: 24483 - DNA, 1825 bp, Panicum virgatum
  misc_feature: Ceres CLONE 1858926
  misc_feature: Encodes the peptide sequence at SEQ ID NO. 24484
gaacgcacgaataatttgcgcggccgttcccacgcgcacgcaggccgccagccagcacaggcctcgcctagccgctcgcgcgcacgttgccgttggagattctggtgaggttggagattccaggttgcagctgctacatccatccccgcgtaaatctcaactgctatatatacatccgcgcgcgcgcaccgtcagattccgcgtccacttccatccgtccggttcctgctccctcctcaccctctcggtcgttgcactgccccccggcttccgcggcggccgccgccgggcgggctggggtttgactgctagctgcgccggccgacgcaggtgaatatatatatatatagagttaccatgagcacggacgtagcaggtgccgaggctcaagtcaaggggaggttccttggtatacttatctgctggcttttggggaatggaagccttttcgcgtggaacagtatgctcaccatcgaagattactatgcccatctcttcccggattaccacccgacaagaatcctcacactagcttaccagccttttgcctttggaataaccctcatcatgacatactatgaagcgaagatgaacacaagacggagaaatcttgcaggattttcccttttcttcctcggttcttttgcattgataattctggatattgctactaaaggacggggtgggcttggagtgttcgttggtgtatgcataatcagtgccatattkgggatagctgatgcgaattgtcaaggtgcattggttggtgacctatccttaatgtgcccagagttcgttcagtccttcatggcgggcttggctgcgtcaggggttctaacatcagccttgagattaatcactaaagcagcttttgagagctcaaaagatggtcttcgcattggagctatactgttcttttcaatcacttgcctgttcgagctggcgtgcctcctcttatacacgttcgtcttcgccaaactacccatcgtgaagtactaccgctcgaaggctgccgccgaaggcagcaagactgttgccagcgacctggctgctgcagggatcatctctgaccaacaggcacaagtcgaggaggatccacagaaacacaagcgcctgaccacaaaagagctactgatggagaacatagactacgcgatcgatatctacttgatatacgtcctgacactgtcgatcttcccaggatttttgtctgaagacaccggagaacacagcctgggatcatggtatgctcttgtgctgatcgcaatgtacaacgtgtgggacctgatcgggaggtacgtgccgctgatccagtgcctcaagctgaccaaccggaagggcatgatggtggcaatcctggcgcggttcttgttcatcccggccttctacttcacggccaattacggcgaccagggttacatgatcttcctgacctcctttctggggctaacaaacgggtacctcaccgtgtgcgtgctcatggaggcgcccaaggggtacaagggccccgagcagaacgcgctcgggaacgtgctagtcgtctgcctccttggcggcctcttctccggcgtcgtgctcgactggctgtggctcatcggcaagggctggtgattccgtctccagcgcatgggtcaattagattttattactgtagatctctgttcctccccgctctgggtcgctctacaacctgcacttctttcccttgaagttaagaagaaaagaacttctttctttaggtagctagtcaagaacatggatggtgtaatttcgcttcatttgaatttctctttcaaatgcaatcacttattttctttcttgttgg

SEQ ID NO: 24484 - protein, 417 aa, Panicum virgatum
  misc_feature: Ceres CLONE 1858926
  misc_feature (119)..(413): Pfam Name: Nucleoside_tran Pfam Description: Nucleoside transporter
  misc_feature (124)..(124): Xaa is any aa, unknown, or other
MSTDVAGAEAQVKGRFLGILICWLLGNGSLFAWNSMLTIEDYYAHLFPDYHPTRILTLAYQPFAFGITLIMTYYEAKMNTRRRNLAGFSLFFLGSFALIILDIATKGRGGLGVFVGVCIISAIXGIADANCQGALVGDLSLMCPEFVQSFMAGLAASGVLTSALRLITKAAFESSKDGLRIGAILFFSITCLFELACLLLYTFVFAKLPIVKYYRSKAAAEGSKTVASDLAAAGIISDQQAQVEEDPQKHKRLTTKELLMENIDYAIDIYLIYVLTLSIFPGFLSEDTGEHSLGSWYALVLIAMYNVWDLIGRYVPLIQCLKLTNRKGMMVAILARFLFIPAFYFTANYGDQGYMIFLTSFLGLTNGYLTVCVLMEAPKGYKGPEQNALGNVLVVCLLGGLFSGVVLDWLWLIGKGW

SEQ ID NO: 24485 - DNA, 2105 bp, Panicum virgatum
  misc_feature: Ceres CLONE 1858930
  misc_feature: Encodes the peptide sequence at SEQ ID NO. 24486
ccccagtcccccatctctcctctccctctgcggcgtataaagacgcggcccacgcacaccgcctcgccctcgccggaatatcctacgaaaaccctcgcggcggagagcgcgctcccacacacgcgcgtcgcaggtccccgcagccgccgcctccacgacttgtcgtgctcgtgcaccactccctcgagcgcggcgcggagcaagggggcactaaaatggcggcggcggagatcggggggttcgcggcggcgagaatggcggcgccggcgctcaggccggctgcgccccccgccccggcggcggcggcggcgccaccgcagctcaggagggccgtggcggcgcggtcgctgcggacggtcgccgccgagacggtgacggcggatctcgccggcgggaccaacggcgcgctgcatgctcagatgaatagcgaagctactactgaaatcacttcactggctgttactgcgaattctaggaggaagacaaagatagtctgcactataggcccctcaaccaacactcgtgagatgatctggaagcttgcagagactggaatgaatgttgcacgccttaatatgtcccatggtgatcatcagtcacacaagaaggttattgatttggtcaaggagtacaatgcacagaatactgatggtaatgttattgccatcatgctggataccaagggtcctgaagttagaagtggggatgttccagagccaatcatgctcaaggaaggtcaagagttcaacttcacgattaaaagaggggtgagcaccgaagacaccgtgagcgtgaattatgatgacttcataagtgatgttgaagttggcgacatactattggtggatggaggaatgatgtcgcttgcagtgaaggctaaatcagctgatacagtcaagtgtgaagtagttgatggtggagaattgaaatcaaggcgccacctaaatgtccgtggaaagagtgccactttgccatctatcacagaaaaggattgggaagacataaaatttggcgtcgaaaatggtgttgatttctatgcagtttcctttgtgaaagatgccaaagttattcatgaattaaaggactaccttaaaggtgctaatgcggatatacatgtcattccaaaaattgaaagtgcagattcaataccaaatctgcagtccattattgctgcttcagatggggcaatggtggctcgtggagaccttggtgctgaacttccaattgaggatgttcctttgctgcaggcagagattgtccagacatgtcgaagcatggaaaaaccagtcattgtcgctacaaatatgttggaaagcatgatcaaccatcctactccgactagggctgaagtttctgacatagctatcgcagtccgggaaggtgctgacgccatcatgttatctggcgaaactgcacatggaaagtacccactaaaggcagtcaaggtgatgcacactgtggcacttagaacagaatccagcctttataactcaactacctcccctggtcttattgcacctgcacaggctctatacagtgaggagttttccccaagccagcttagtaaaatgtttggatctcattcaaccatgatggcgaacacccttcgtacgccaataattgtatttacacagacaggctccatggctgtccttctgagccactatcggccctcatctacaatatttgcatttacgaatgaggaacgagtgaagcaacggctggcactatatcagggtgtcatccctattcacatgcagttctctgacgatgcagaagaaactttctccagagcaattagcagcttgctgaaagcgcaacatgtgaagaagggggactacgtcacccttgtccagagcggagtaacttcaatctggagagatgaatccactcaccacatccaagtgaggaaagttcagggctgaagtgccgtcgtggtacttggagaattttggatagcgctcccagaagtgttatyawyatactasgagtagtgtttaatgtgttgtgaggagattgytacatcgagttacacattttgtgttgaagtmatttgtagattttgaattttttaagtttgtattggttaattataaaatgtgttt

SEQ ID NO: 24486 - protein, 569 aa, Panicum virgatum
  misc_feature: Ceres CLONE 1858930
  misc_feature (87)..(429): Pfam Name: PK Pfam Description: Pyruvate kinase, barrel domain
  misc_feature (461)..(558): Pfam Name: PK_C Pfam Description: Pyruvate kinase, alpha/beta domain
  misc_feature: SWISSPROT Homolog: EC 2.7.1.40 Pyruvate kinase
MAAAEIGGFAAARMAAPALRPAAPPAPAAAAAPPQLRRAVAARSLRTVAAETVTADLAGGTNGALHAQMNSEATTEITSLAVTANSRRKTKIVCTIGPSTNTREMIWKLAETGMNVARLNMSHGDHQSHKKVIDLVKEYNAQNTDGNVIAIMLDTKGPEVRSGDVPEPIMLKEGQEFNFTIKRGVSTEDTVSVNYDDFISDVEVGDILLVDGGMMSLAVKAKSADTVKCEVVDGGELKSRRHLNVRGKSATLPSITEKDWEDIKFGVENGVDFYAVSFVKDAKVIHELKDYLKGANADIHVIPKIESADSIPNLQSIIAASDGAMVARGDLGAELPIEDVPLLQAEIVQTCRSMEKPVIVATNMLESMINHPTPTRAEVSDIAIAVREGADAIMLSGETAHGKYPLKAVKVMHTVALRTESSLYNSTTSPGLIAPAQALYSEEFSPSQLSKMFGSHSTMMANTLRTPIIVFTQTGSMAVLLSHYRPSSTIFAFTNEERVKQRLALYQGVIPIHMQFSDDAEETFSRAISSLLKAQHVKKGDYVTLVQSGVTSIWRDESTHHIQVRKVQG

SEQ ID NO: 24487 - DNA, 696 bp, Panicum virgatum
  misc_feature: Ceres CLONE 1858932
  misc_feature: Encodes the peptide sequence at SEQ ID NO. 24488
atccttgaaaaaactgaaaagagaaggggaaaatccccaactcctccccacataaaccctaatatccttggattcgcgccagaagcccccgaatcgaagccccctccggcgctccagctgcctgcaggatttgagccgtgctcgatctggtggaaaattccagttttttccgcgctcagagccgcgtcggagcgcttcgggttctccggtgctcgccggcgctggatccgtgcgtgttccggcgagaggtcgggtttcgcgtggggtcggttcagcttcgagctcgattcgcccgcttgagttgggtcgggctgccgtggcggtgattgaggtagtcgcgtcgatttgacgggtgcttcttgccattttggcgagccattcgggggaccgaagggttcgccgcaaggcagcagcgtttctcgataatcctgggccatttggtctttctgcgtggctgaaaggcgtgacctttgtgccgtgcgatgcaccccaaggctcgaatccacgcggaccctgtgctcgaggtcgaccagttcgactgcctgccggattcgctcgtcctgcacatcctgaacaaggtggaggacgtgcggtcgctgggccggtgctccgccgtctcgaagcggttctgcgggcttgtctccctcgtccacgatgtgtatgttaagattgaccgcgtcgtggcggtcgatggcg

SEQ ID NO: 24488 - protein, 71 aa, Panicum virgatum
  misc_feature: Ceres CLONE 1858932
  misc_feature (16)..(64): Pfam Name: F-box Pfam Description: F-box domain
  misc_feature: Useful for making plants with modulated low light sensitivity
  misc_feature: Useful for making plants with modulated nitrogen use efficiency
MHPKARIHADPVLEVDQFDCLPDSLVLHILNKVEDVRSLGRCSAVSKRFCGLVSLVHDVYVKIDRVVAVDG

SEQ ID NO: 24489 - DNA, 1241 bp, Panicum virgatum
  misc_feature: Ceres CLONE 1858938
  misc_feature: Encodes the peptide sequence at SEQ ID NO. 24490
gaggctgcagcatcagcaatggtgctgatccctttcgtccgcgactacatcgatcgcatgctccacgacatcccgggaatgaaggtcctcgccctcgacccccaaaccgttgggatggtgagtgtggtgtacagccagtcggatctgctgcggaaggaggtgtttctcgtggagacgatggacaacgcctccagctctagggagtccatggcgcacctcaaggctgtctacttcctccgaccctccaccgacaacgtccagaagctccgcaggcacctagccatgccgcgcttcgccgagtaccacctcttcttctccaatatattgaagattccgcagattcagatattagctgattctgatgagcaggaggttgttcagcaagttcaggagttctatgctgatttttgtgccattgacccataccatttcactctcaacattcaaaataaccatatgtacatgcttccaacggtggtcgatcctcctggcatgcagagcttttgtgatcgagctgttgatggcattgcttctgtcttcttggctctcaagcgtcgccctgttattagatttcagaggacatcagatgttgcaaaaaggatcgcacaagaaactgcgcgattgatgtatgagcaggagtgtggcctgtttgattttagacgaacagaaaactcttcgttgttgttggtgattgacaggagggatgatcctgttacgcctctacttaaccaatggacatatcaggcaatggtacatgagcttattggaattgagaacaacaaagtggatcttaggggatttgccaatgtacctaaagaccagcaggaggtggttctatcatcggttcaagatgatttttttagagctaacatgtttgagaattttggggacctcggtatgaacatcaaaagaatggtagatgactttcagcatctttcaaagagcagccttattctccagagtataggtgatatggcaaagttcgtgagcaactatcctgaatatcgaaagacacatggaaatgtaacaaaacatgtcgctttggtgagtgagatgagcagaattgtggaggaaaggaagcttatgctagtttcacagacagaacaagagcttgcatgtacgagtggacaagcagcagcctttgaggctgtcacttccttgctaaacaatgaaagtgtgtctgatattgaccgattacgactagtgatgctctatgctttgcggtatgaaaaagagagtcc

SEQ ID NO: 24490 - protein, 407 aa, Panicum virgatum
  misc_feature: Ceres CLONE 1858938
  misc_feature (21)..(407): Pfam Name: Sec1 Pfam Description: Sec1 family
MVLIPFVRDYIDRMLHDIPGMKVLALDPQTVGMVSVVYSQSDLLRKEVFLVETMDNASSSRESMAHLKAVYFLRPSTDNVQKLRRHLAMPRFAEYHLFFSNILKIPQIQILADSDEQEVVQQVQEFYADFCAIDPYHFTLNIQNNHMYMLPTVVDPPGMQSFCDRAVDGIASVFLALKRRPVIRFQRTSDVAKRIAQETARLMYEQECGLFDFRRTENSSLLLVIDRRDDPVTPLLNQWTYQAMVHELIGIENNKVDLRGFANVPKDQQEVVLSSVQDDFFRANMFENFGDLGMNIKRMVDDFQHLSKSSLILQSIGDMAKFVSNYPEYRKTHGNVTKHVALVSEMSRIVEERKLMLVSQTEQELACTSGQAAAFEAVTSLLNNESVSDIDRLRLVMLYALRYEKES

SEQ ID NO: 24491 - DNA, 689 bp, Panicum virgatum
  misc_feature: Ceres CLONE 1858938-R
tctctattccaaactatggaaggaattgttaaaggtcgattgcgagatgcggactatccacttgttggcaaccatttccagcagggcaggcctcaagatgtggtaatattcattgttggagggacaacttatgaggaagcaagatcagtagccctttataatgcagcaaatcctggagttcgtttcttccttggaggttcagtggttctgaattcaaaaagatttcttgaagatttgggggaggcacaaaggatatcgaaatcaagcactataatatgagctaaattgtgcatctcctgtttgaagagtaccagattatgataattgacagtattgactccacttttatatagaatcaaattcgtgagataaatttgtaacataagctctaggtgcatagtacaacgtcataccagataagcatatctgtagcccatccagcatctgttcatggccattcttgtttatttcgtctttacacagttgaagcaagtatttatttgtctctataccagtgttgattgagattgtaccatttaggtcgtatgtggagtcaaagatcatgtatgtaaaagaggccagttatatttttcagtttctctcagtttaatcttttgaaaatgtgtgagttgttgtctatgcagttaggttggacatctatgggatccaaaagttattgtctcgactgg

SEQ ID NO: 24492 - DNA, 722 bp, Panicum virgatum
  misc_feature: Ceres CLONE 1858948
  misc_feature: Encodes the peptide sequence at SEQ ID NO. 24493
gccccgcccgtctctcctctcttccccacgaacgagccgagccggcgggcgggctatgtagcttgcgcacctgcgcttgccctcgttgttgcccgcggcgagacgcgagaggaggaggaggcaaaggcaatggggggagcggaggggccgggccacccgaacggccacgcgagcggggccgtggtggcggagaagctggacgagctgcggcggcagctggggaaggcggacggggacccgctccggatcgtcggcgtcggggcgggggcctggggcagcgtcttctgcgcgctgctgcaggacgcgtacggccacctccgcgacagggcgcaggtccgcatctggcgccgccccggccgcgccgtcgaccgcgccaccgccgagcacctcttcgaggtcatcaacgcgcgcgaggacgtcctgcgccgcctcatccgccgctgcgcctacctcaagtacgtcgaggcgcgcctgggggaccgcacgctctacgccgacgagatactcagggacggcttctgcctcaacatgatcgacacgccgctctgcccgctcaaggtcgtcaccaacctgcaggaggccgtctgggacgccgacattgtcgtcaacggcctgccctccaccgacaccagggaggtcttcggggagattgggaggtactggaaggagaggattactgcccctatcatcatctcgctggccaaggggatagaggcctccct

SEQ ID NO: 24493 - protein, 197 aa, Panicum virgatum
  misc_feature: Ceres CLONE 1858948
  misc_feature: SWISSPROT Homolog: EC 1.1.1.94 Glycerol-3-phosphate dehydrogenase (NAD(P)(+))
MGGAEGPGHPNGHASGAVVAEKLDELRRQLGKADGDPLRIVGVGAGAWGSVFCALLQDAYGHLRDRAQVRIWRRPGRAVDRATAEHLFEVINAREDVLRRLIRRCAYLKYVEARLGDRTLYADEILRDGFCLNMIDTPLCPLKVVTNLQEAVWDADIVVNGLPSTDTREVFGEIGRYWKERITAPIIISLAKGIEAS

SEQ ID NO: 24494 - DNA, 2039 bp, Panicum virgatum
  misc_feature: Ceres CLONE 1858957
  misc_feature: Encodes the peptide sequence at SEQ ID NO. 24495
gatccccccgacgcggcgagtcctccggtcagcgccgccgcctcctcccctctccggccgccgccgccgccgccgcctcccctctccggccgccgtcgccgccatggtagctataatcccaccctctcccctcctcctcctccccatatggccaaccacctccgccccctcggagcggcggcgacctgcggagccgaccgaatctggctcccgggccggcgcggcctggccgcggtttggcgtggcgatcggagccgcacacgcccctcctcggatgggtacgggccctgggggtttagttaccgggccccaaacctttctagctggttgttggcgcggccgccgcgcgagattgcgggcggttctcgcggcgcaggctgctggaatagggtgcttggtgatccgatttcagccgccgccgccggcttagatgaatccggccgaagagcaagggaggtcgcctgtgctcggcagcaggctgaacctcctttttgtttgctaaatttaatcatagttgaaattgggtgctatgtgtgatcctggttttgcatgggcacaaggggtcctggtctattttcgtccgagctgactctgtagtagcggattgttgttagtctgtttgttttctcaggttgggctgtttaggcctggtgtctgaattgcagctgaaatgaactctgttccaacttggaaaagcttggttcgcattcacatgcctgatacttgtttgttttctgatgaacaacgccctgcatgtagagattttagctcttaaggttcttctgatgtggaagtattgcatatgttttttcgtgctctaccataatgataatgtaattctatgggtaggtgaattcagaactatatcattggagcattcaagccaccatgtgacatctcgattacattctctgatgcgaggaccaggaagcaggtttcagttaagaaggacaatgggaagacaacaatggtccctgttttccagagcctggaaacaatatctggagaagtatcgatagcaccagtcccaggtaaaaggattgaacacatgggtgttaagatcgagttgctgggccaaatagagctgtattttgaccgagggaacttctatgacttcacttccttagtgcgtgagttggatgttcctggtgaaatctatgaaagaaaaacatacccatttgagttttcgactgttgaaatgccatatgagtcttacaatgggacaaatgtcagactgaggtacattttgaaggtgactattggcagaaactatgttgggaatattgtggaataccgggatttctgtgtaagaaactactctcctgtccctacaatcaataatagtattaagatggaagttggaattgaggattgcttacatattgagtttgagtacagcaaaagcaagtaccatctcaatgatgtgattattgggaagatatacttccttcttgttagaataaagataaaaaatatggagctggagattcggcgtagggagtcaacagggtcgggctctaacacatatgttgaaactgagactcttgctaagtttgagctgatggatggtgctcctgtcagaggtgagtctattccagtgaggctgttcctgacgccttatgagctgaccccaacttaccgcaacataaacaacaaattcagcgtcaaatactacctgaatctggtccttgtggatgaggaagataggaggtacttcaagcagcaagagatcacaatgtaccgtctcctagaatctgccacggcttcctagaccctggcctggagcagcatgatgttcacctctcaggttttgtataattgagcgctgaggttagagcgatgttgtgtttacctgtatataactccagaagagcgccgcagtttgactgctgctgtggccatgcatgctgtcttgttgattgtgtccttttttttcccactccttaccttgcttatggtctatggcacaagcactgttaactgggggtgctagtgaatcacctgcctctattaatttaccattctcgtgaggcttctac

SEQ ID NO: 24495 - protein, 267 aa, Panicum virgatum
  misc_feature: Ceres CLONE 1858957
  misc_feature (1)..(246): Pfam Name: Vps26 Pfam Description: Vacuolar protein sorting-associated protein 26
MVPVFQSLETISGEVSIAPVPGKRIEHMGVKIELLGQIELYFDRGNFYDFTSLVRELDVPGEIYERKTYPFEFSTVEMPYESYNGTNVRLRYILKVTIGRNYVGNIVEYRDFCVRNYSPVPTINNSIKMEVGIEDCLHIEFEYSKSKYHLNDVIIGKIYFLLVRIKIKNMELEIRRRESTGSGSNTYVETETLAKFELMDGAPVRGESIPVRLFLTPYELTPTYRNINNKFSVKYYLNLVLVDEEDRRYFKQQEITMYRLLESATAS

SEQ ID NO: 24496 - DNA, 1831 bp, Panicum virgatum
  misc_feature: Ceres CLONE 1858968
  misc_feature: Encodes the peptide sequence at SEQ ID NO. 24497
gctggcctcggcggatgaggaggaggaggaggcgcgactcgccgaggtcgacggggaggcggcggcgcgggcgttcccgcggagctcctcgacgtgctccgggaggccaggcgcaacgccgtcaggctccgcgcgctgcagcagcggaaggaggccgcgcacgtcgtcgagcttgggaggaggttcaagattttcgacgagcttaggcagagggcgtcgcgcgtggtgtcccccggtgatggaggcgggggcgtgggtgatgctgcctacgacgagctcgagagcaggctaaagatgttgaatttacaaaatacgaatctaaggatccgattcggaatctaaaggacgcacactcaaatggactaactgatgcacttatggctgatgttcctgattccgggtgtacattaataataactgaaggaacttcggcaaaggaatttgctctaaagggtttatctgttcttgggaatgagaagtatggtgtatatgccattgaaggagtgctgcagaatattattcggaccccaaataagatcagtgctgaagttcaggacatattttcggcgctaggtttggagctaagaaatgtaccacgaaggcactttagaaaagactttggtcctggatatatatgtaaagatataaaaacccttaggtatcgacatgtcatgataatgactgatcaggatgtggatggtgcccacattaagggtttgctcatcaatatgttctattgtttatgtccaacactgcttaaggtccctttatttcttcaagatttcactaccgacatagtgcgggccacacatattcagactgggcagattaaaggatttaagttactaagtgattatacagcttggcagagcaaagttataccagctgaatggactattgaatatttcaagggtcttggaacaagcattcggcttgcaatagaatattttaaaaacaaagaagaacacactagatgtttcatctggaatgatattgatgcaaattatctggataaggtgttcaaccccaaacgtgccgatgaaaggaagatatggatttgtcaacatcaaataaccactgtgagtccttactctagtcgagtagtcacatatggtgaatttataaaaaaggagttaatgttatatgcttttgaagacatccgaagaaaactaccttctgtcgtggatggtcttaaagtatcacagcggaaagtggtccattatatgctcgatatgccgaaagatgggttaaaatctgcaagacataagatttcccagttggtaggtgcaatttcgcaacattctaactatcgccatgcagaagaaaactttgaaggtgtaatcaaggccatggctgctgctggaaaaaacaatattgatcttctggaaccacatgagggctctcgaaagatcagttctaaatacataaccatgagccctgtcatgactcatattgcacaatttattttccgaaaggaagatatacatcttcttgactacatcagtgatggtgggactcttgtggaaccagaatgttatgtaccggtagtccctttggctctcatcaattcatgtgaaggctttgctattggattcagtgcaatgttgccaaattatcatccaaaagatgttattgataatgtaaggcgtttattggatggtgaagaaactgttaaaatggtaccatggtacaagaatttgactgttaccgaagagaagggtagatattatgcggaagcatcgtggagtgtacaacatcaaaaggttgtgaccattaactacctcttacctggtgtacattaccaggattatgccaatttccttactacctt

SEQ ID NO: 24497 - protein, 484 aa, Panicum virgatum
  misc_feature: Ceres CLONE 1858968
  misc_feature: SWISSPROT Homolog: EC 5.99.1.3 DNA topoisomerase (ATP-hydrolyzing)
MADVPDSGCTLIITEGTSAKEFALKGLSVLGNEKYGVYAIEGVLQNIIRTPNKISAEVQDIFSALGLELRNVPRRHFRKDFGPGYICKDIKTLRYRHVMIMTDQDVDGAHIKGLLINMFYCLCPTLLKVPLFLQDFTTDIVRATHIQTGQIKGFKLLSDYTAWQSKVIPAEWTIEYFKGLGTSIRLAIEYFKNKEEHTRCFIWNDIDANYLDKVFNPKRADERKIWICQHQITTVSPYSSRVVTYGEFIKKELMLYAFEDIRRKLPSVVDGLKVSQRKVVHYMLDMPKDGLKSARHKISQLVGAISQHSNYRHAEENFEGVIKAMAAAGKNNIDLLEPHEGSRKISSKYITMSPVMTHIAQFIFRKEDIHLLDYISDGGTLVEPECYVPVVPLALINSCEGFAIGFSAMLPNYHPKDVIDNVRRLLDGEETVKMVPWYKNLTVTEEKGRYYAEASWSVQHQKVVTINYLLPGVHYQDYANFLTT

SEQ ID NO: 24498 - DNA, 728 bp, Panicum virgatum
  misc_feature: Ceres CLONE 1858971
  misc_feature: Encodes the peptide sequence at SEQ ID NO. 24499
tactcagtgatgccattttataaagctgggccagtgatggatcttgttgagaagatagtggggcgccttgattacaggacaactctgaacaagaggcaagtggaaaatttggagtatgagcttaaaggccggcgtgtgactgtgattcaccgcaggactaatcagaagtacactgtgcaaggtttgacacccttgcctaccagccagttgacctttgtggatgctgaaactggacaaacaaagagacttgtcgactattattctcagaaacatggcaaggtgattgagtatcagatgcttccatgcctggatttgagcaagagcaaggacaaaccaaatcatgtgccaattgagctttgcactcttcttgaagggcagaggtttccaaaggcaaacctggataagaattctgatagaacactaaaatcggaggccttaattcctgcatttaagcggaagaaggagattctggacttggtgaattctagagatggaccttgcagtggtgagatagcacatcaatttgggatttccttggatgtacaaatgactgaagtcacgggtaggatccttccgccacccaacctaaaacttggcgcatccaatggccagacctgcaaattcagtatcgatcaggataactgccagtggaaccttatgaagaagaaactagtagagggccgggatcttcagtgctggggcattgttgacttcagtgcccatccgtc

SEQ ID NO: 24499 - protein, 242 aa, Panicum virgatum
  misc_feature: Ceres CLONE 1858971
  misc_feature (13)..(147): Pfam Name: PAZ Pfam Description: PAZ domain
YSVMPFYKAGPVMDLVEKIVGRLDYRTTLNKRQVENLEYELKGRRVTVIHRRTNQKYTVQGLTPLPTSQLTFVDAETGQTKRLVDYYSQKHGKVIEYQMLPCLDLSKSKDKPNHVPIELCTLLEGQRFPKANLDKNSDRTLKSEALIPAFKRKKEILDLVNSRDGPCSGEIAHQFGISLDVQMTEVTGRILPPPNLKLGASNGQTCKFSIDQDNCQWNLMKKKLVEGRDLQCWGIVDFSAHP

SEQ ID NO: 24500 - DNA, 675 bp, Panicum virgatum
  misc_feature: Ceres CLONE 1858990
  misc_feature: Encodes the peptide sequence at SEQ ID NO. 24501
gtgtcgggcaccctcagcgccttcgtggcgggctcccagatgccgctcttcgcgctaggcgtcacgcaggcgctggtgtcctactacatggggtgggagaccaccaagcgggaggtccgcaagatctccgtgctcttctgctgcggcgccgtgctcacgctggtgttccacgtcgtcgagcacctcagcttcggcatcatgggcgagcggctcacgctgcgggttcgggagaggatgttctcggcgatcctgcggaacgagatcgcgtggttcgacgacaccagcagcaccagcgcgatgctgtcgtcgcggctcgaggcggacgccacgctcgtgcgcaccatcgtcgtcgaccgctccaccatcctgctgcagaacgtcggcatgatcgtgacctcgctcgtcatcgccttcatactcaactggaggatcacgctggtcgtgctcgcaacctaccccctcatggtcagcggccacatcagcgagaaaatgttcatgaaaggttacggcggcaacctcggcaagtcgtatctgaaggccaacatgctcgcggcggaggcggtgagcaacatccggacggtggcagccttctgctcggaggagaaagtgataaagctctacgcggacgagctgaaggagccatctaagaggtccttccggcgaggccagggcgcc

SEQ ID NO: 24501 - protein, 224 aa, Panicum virgatum
  misc_feature: Ceres CLONE 1858990
  misc_feature: SWISSPROT Homolog: EC 3.6.3.44 Xenobiotic-transporting ATPase
VSGTLSAFVAGSQMPLFALGVTQALVSYYMGWETTKREVRKISVLFCCGAVLTLVFHVVEHLSFGIMGERLTLRVRERMFSAILRNEIAWFDDTSSTSAMLSSRLEADATLVRTIVVDRSTILLQNVGMIVTSLVIAFILNWRITLVVLATYPLMVSGHISEKMFMKGYGGNLGKSYLKANMLAAEAVSNIRTVAAFCSEEKVIKLYADELKEPSKRSFRRGQG

SEQ ID NO: 24502 - DNA, 2683 bp, Panicum virgatum
  misc_feature: Ceres CLONE 1859003
  misc_feature: Encodes the peptide sequence at SEQ ID NO. 24503
actgatcttcttcagctgagaggaaaagcgctgcaattttcgctcgcgctcctcagcatcagcaggcagcagctagcgcccattcccataaatacgcgctccgggcaccgcgtctcccattccccggccaccgcaagcagcagcagcacactcgcaggcgatagccggcggcggggccgtaggttccgttccgttagatgccgcggaagcgggggcgggagagcggaggcggcggagactgggccggtggtgatggcggcgacggaggcggaggcggaggggatggccgcggcggccacgacggcagaggaccaggcgtcgtgcgcagcggcggctcaaccccggcgccggcactgaagaggccgtgcctgccgggcgacctcgagatcaggggatgccgtagttgcagttgcagccaccaccaggggctccccacaggctgtgcctgtgtgcaagcgatccatacacgactcgaggctgccgctagccggtttatggaagaggtaaaacaaatccttacaagcccctgcgaccttcttcctgctccaagagaaagaattgaacaatacctgcctccaacctgcaaactcgcttttgtgaataccatgagtgataaaatctttacaaagagggaggtccaggcagcgggcggtggtcccctcatgataaaaatggttgtgagcaatcagcgagacagcaattgctcccagcttctctctgctaatgtcaaggttgtagctcttgatggtgactttaatgctagtaatcgtgagagctggacactcgaggaattcaaaagccatatagtacgcccaagggacaaagttggggtggtgcttacaggaaacctggaattgaaactgagaaatggtgaggcatacctcgaaaacattacttttggtgatatctccaagttcacaaggagtggaaagtttaggcttggtgtaaagcttattgataatcttggcgagcgagttcaagaaggtataactgagcctttcactgtgagggaccggcgcggagaaggatacaaaaaatgtgacattccaacgttagaagacaaagtatggcgtgtggaaaagattgcaaaaaatggtcccttctgtaaggcattggcgcagaatggcattactttagtgaagcacttcttgaggcagtattacaaggataaaaaagctctgcgtaatattctcagcaatgcctcagatgcattctggaaaaagatggttaatcatgcgagaggtgtgatcctgggagtgccctttactcttactttattgatgacaagaatattagggtgttcttcagttctctgggtcagattgttggggtaacagtaactgacaagtataaagcttttggtgatcttgacaagcgccaaaaggcccaagtgaaagaatggagtaaggatgcatatgaatgtatgacataccatcagcctgattatgaaatgtaggcagccaaccaagactaatcgactgcagtaatttccagggatcgatcatgccagggcctaaaactactcaacctacagaagaaattattcatgaagttgatgagcaagccacttcagagggcaacagattttctggtgatcgctcccagcagtttacactccgaaggcttggatccaggagagtgacggccttaccttctgcagaggggaacaatgaaactgatgtgtcttttggcattgatgtggagccgggttctggtcctgaaatccagtaccaaactccaagcgtgaattacaatgcaagttcagtgatattcccttgccctcccgctgaccaaagtgttgcactgcatcaagcatccatgacggcgtcagcatgttcagtgacagtgcatcaggatgatcagatttctttcacaaatattggtccttcacttggtcaatggtgtaatgagcaacaagtggattctcagtatgcgtcctctttctctccaagtaaccaagctgattttcaatttctcgacggcttcagcattgatcagcttttggaagacatgcccaacgacgttttctctcagttgtgtgcacctggtgtgaacgatctgcaagctgatgtttgctgcggcatggcgaaaccgccttgccgtagatgggtgaaatttgctgtccttgccaagtggttggctatgctaagggtttccaagagcaaggttcttgcttgagcaaaattggttggatccaggaagcgcagacagataacccacaaactgcagttggcatctaattagtgtgatgatacgttctttgaatagtgtaataattataaggtgatcctcttgtgtccattgttaagtctgtattgatatttatgttactgtgaagaccctaattcatgttgatatttgtgttaagtctgtaatgttattcagtaagattgcattgatctgtaacttagcataagccaggtacttataattctgttagttccgagttgtctaagaaataagaatttctgttgtcgttttccttcatgaagttagtatttggtgagatatgacattagtttgtacgtgtagtataattacttggtgagatttcttgaacttattactataaagtataaacttgccatctgtaatgtgtgtgccccaggttgtctgtaaacatatataataaagttgaatactgttgtccttcttgcatttctgcatgaagatgaaattttcc

SEQ ID NO: 24503 - protein, 378 aa, Panicum virgatum
  misc_feature: Ceres CLONE 1859003
  misc_feature (125)..(375): Pfam Name: Calmodulin_bind Pfam Description: Calmodulin binding protein-like
MPRKRGRESGGGGDWAGGDGGDGGGGGGDGRGGHDGRGPGVVRSGGSTPAPALKRPCLPGDLEIRGCRSCSCSHHQGLPTGCACVQAIHTRLEAAASRFMEEVKQILTSPCDLLPAPRERIEQYLPPTCKLAFVNTMSDKIFTKREVQAAGGGPLMIKMVVSNQRDSNCSQLLSANVKVVALDGDFNASNRESWTLEEFKSHIVRPRDKVGVVLTGNLELKLRNGEAYLENITFGDISKFTRSGKFRLGVKLIDNLGERVQEGITEPFTVRDRRGEGYKKCDIPTLEDKVWRVEKIAKNGPFCKALAQNGITLVKHFLRQYYKDKKALRNILSNASDAFWKKMVNHARGVILGVPFTLTLLMTRILGCSSVLWVRLLG

SEQ ID NO: 24504 - DNA, 551 bp, Panicum virgatum
  misc_feature: Ceres CLONE 1859025
  misc_feature: Encodes the peptide sequence at SEQ ID NO. 24505
atcccattccccttccttccagaggagagagagagaagaaaagataagctcagctcaggctcaggctcagctcgcaagcaagtggagatgcggagcccacgaggaccagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcccctcggcgcgcgccgccgcgggcgccaccgaggacctcgtctacctcctgcagttcggcaacccctccgccgccgacgacgacggggcgcctaaggacggcgccgacgcgccgccgcccagcgcgccggcctacggcgtcgccgtctacaccgtgaccaccagcaagtggcgccgggagtgcggcgcgccgcccgtgctcggcatcttcgcgcagtgcgccgcggcgggcaccgccgtggcctcgctatgcggatggcacgcgcgcacatccgagcccgc

SEQ ID NO: 24505 - protein, 154 aa, Panicum virgatum
  misc_feature: Ceres CLONE 1859025
  misc_feature (20)..(67): Pfam Name: F-box Pfam Description: F-box domain
MRSPRGPAAAGRCGAQEHVDLIPGIPDDVAVDCLARVPHASHRALRRVCRGWRSAAAKPAFPSARAAAGATEDLVYLLQFGNPSAADDDGAPKDGADAPPPSAPAYGVAVYTVTTSKWRRECGAPPVLGIFAQCAAAGTAVASLCGWHARTSEP

SEQ ID NO: 24506 - DNA, 2815 bp, Panicum virgatum
  misc_feature: Ceres CLONE 1859041
  misc_feature: Encodes the peptide sequence at SEQ ID NO. 24507
accgcaccaccaccaccacctcccctcctcccccaaccgtccccttccagctcctccgcctccgccattttttccctgtcacggccaggcgatagggttcggcgtcccccgctccaccctccgatcaattggtttggagctgttgcttcgcgatcttccccccatcttcgtttcggttcttgcgttctcggagcaggaatcggcagcgtccacggcgttctcggtctcttgccgctcggcatgtctccgttccagggatacagaggtgatggggttctcgccggcgtccggtcgcggaagcgcgtgttcgcgtcggcggccgacgagcccgtgacggccaccgcgcccaggcggcagaagcggagggaggagccgtcgctggacgcgctcccggacgagtgcctcttcgaggtcctgcgccgcgtgcggggcgcccgcgcgcgctgcgcctccgcctgcgtctcccgccgatggctcgcgctcctcgccggcatccgcgcctccgaggccgtgctggccccacccgcccccgccgtgccggacctcaacatggagtacctcggcggcgaggaggaggaggccgacctcatggaccacgacggcgacgcccgcgagaggaccttcgagggcaaggaggccacggacgctcgcctcatggccgcggccgtcgccggccgcctggccgccgtctccgtccgcgggagccacccagcgcgcggagtcaccgactcgagcatctccgcgctcgcccgcggctgcccggcgctccggtccctcgccctgtgggatgttccgcaggtgaccgatgctgggctcgctgagatcgccgccgagtgccacgcgctggagcgtctggacatcactggctgcccgctggtcacggacaagggcctcatcaccgtcgctcagggttgcccggagctgaaatccttgaccatcgaggcatgctccggtgttgccaacgagggtctcaaggcgatcggccggtgctgtgctaagctgcaggcggtgaacatcaagaactgcactcatgttgatgaccagggtgtgtctggcctcatctgctccgcaaccgcctcattgaccaaggtccggctccagggtctgagcattactgatgcttctcttgcggtgattgggtactacgggaaggctatcacagacctcaccctcgctcgcctcccagcagttggtgagaggggattttgggtgatggccaatgccctgggcctgcagaagctcagatgtatgactgtcacctcctgccggggactcacggatcttgctcttgcatctgttgccaagttcagcccaagtttgaagcatgttaacctcaagaagtgcagcaaggtctccgatggttgcctcaaggaattcgcggaatcagcaagggctctggagaacttgcaggttgaggaatgcaacaaggttactctcatgggcattcttgctttcctcctcaactgcagcccgaagtttaaggctctctctttggtaaaatgcattgggattaaggacatctgctctgcacctgcacagcttccagtatgcaagtcgcttcgctccctgaccatcaaggattgcacaggtttcactgatgccagcttggccgtggtgggcatgatctgccctcagttggagaatgtcaatttgagcggtcttggtgcagttaccgacaatggcttccttccgttgatcaacagttctgagagcgggctggtcaacgttgatttgaatggctgtgagaatctcacagatgcagctgtttctgccttggtgaaggtgcacggttgttctcttgcacaccttagccttgagggctgcagtaagattactgatgcaagcctgtttgcaatctctgagagctgcagccagcttgccgagcttgatctttcaaactgcatggtcagcgactatggtgttgcggtcttggcagcggcaaagcagctcaagcttcgtatcctctcactgtctggttgtatgaaggtcacccagaagagtgttcctttcttaggcagcatgtcttcatccttggagggactcaatctccagttcaacttcatcggcaaccacaacatcgcttcgttggagaagcagctctggcattgcgacatccttgcttagaggagcaaggtgattagttgctggagatgctgggtcagccttctccagatgcagatatatgaccgtagtggtagtacttcagtccaagcttcatagttgagtctggtttccggctcgtgtttgtgtcatggtgggtctcctgtttgtcatagggccggttgttttcctggggggttgtttttgccaaggctcgttttttgcaggtatcctcatgtgaggatgcctgttcattgagccttcggcagccattaccatggcgccttgccccccttcatcccaacctaagcccttgtgatcagagtcatttcaccatgcagtttctcaagtcatgtttggagctcaagtattgtcaagtgtgtcttctttccagtacttctggttatagagtttgcagacatcaatgctctttgagtttgtagaaagttgtgttgtcggtgtctttggtgtctgggtgtctgcaacctcgtcgagttcagtttgttggtcgtggatagttgctggttcagtgtcggtagggtttgcctatatgctcggggatctggcctttgcaaggttcattctgtagagcctttgccatgacaaccctgtgtggttgtttttcttctccaggtacctgatttttcaggcaggtggtttgaaacactgtaacctttgctaccttctgaagataaataaagcttgagtttctgtt

SEQ ID NO: 24507 - protein, 627 aa, Panicum virgatum
  misc_feature: Ceres CLONE 1859041
  misc_feature: SWISSPROT Homolog: EC 1.14.11.27 [Histone H3]-lysine-36 demethylase
MSPFQGYRGDGVLAGVRSRKRVFASAADEPVTATAPRRQKRREEPSLDALPDECLFEVLRRVRGARARCASACVSRRWLALLAGIRASEAVLAPPAPAVPDLNMEYLGGEEEEADLMDHDGDARERTFEGKEATDARLMAAAVAGRLAAVSVRGSHPARGVTDSSISALARGCPALRSLALWDVPQVTDAGLAEIAAECHALERLDITGCPLVTDKGLITVAQGCPELKSLTIEACSGVANEGLKAIGRCCAKLQAVNIKNCTHVDDQGVSGLICSATASLTKVRLQGLSITDASLAVIGYYGKAITDLTLARLPAVGERGFWVMANALGLQKLRCMTVTSCRGLTDLALASVAKFSPSLKHVNLKKCSKVSDGCLKEFAESARALENLQVEECNKVTLMGILAFLLNCSPKFKALSLVKCIGIKDICSAPAQLPVCKSLRSLTIKDCTGFTDASLAVVGMICPQLENVNLSGLGAVTDNGFLPLINSSESGLVNVDLNGCENLTDAAVSALVKVHGCSLAHLSLEGCSKITDASLFAISESCSQLAELDLSNCMVSDYGVAVLAAAKQLKLRILSLSGCMKVTQKSVPFLGSMSSSLEGLNLQFNFIGNHNIASLEKQLWHCDILA

SEQ ID NO: 24508 - DNA, 704 bp, Panicum virgatum
  misc_feature: Ceres CLONE 1859044
  misc_feature: Encodes the peptide sequence at SEQ ID NO. 24509
ggtccatcacgggcgagctactcgatccccggccacacccccggccactccccggcccccaatcctccttccttcggctcctcctccgatccccactactgcggggcgggcgcacccacagtcgcaggtcgagggaacaacaacaacaacaatggcggcggtcggcctccgccgcatgtgcagcgccggccggcggccgaggctaccggcggccgtgctcctcgtcctcgtcctcctcgccgcgccgccgtgcctgcaggcgggtggcccgatcaagacggtggtggtggtggtgatggagaaccgttcgttcgaccacatgctggggtggatgaagcggctgaacccggagatcgacggcgtgacgggcggcgagtggaacccggtgaacacgacggacccggcggcggggcgcgtctacttcggggagggggcgcagtacgtggacccggacccggggcactcgttccaggagatccggcagcagatcttcggctccgacgacgcgtccggccccgcccggatggacggcttcgtgcagcaggcgcgctcgctgggcggcaacatgaccgacgccgtcatgcacggcttcgcccccgacagcgtcgccgtctaccgcgagctcgtcgcccagttcgccgtctgcgaccgctggttcgcctccgtgccctcctccacgcagcccaaccggctgttcgtccact

SEQ ID NO: 24509 - protein, 184 aa, Panicum virgatum
  misc_feature: Ceres CLONE 1859044
  misc_feature (41)..(184): Pfam Name: Phosphoesterase Pfam Description: Phosphoesterase family
  misc_feature: SWISSPROT Homolog: EC 3.1.4.3 Phospholipase C
MAAVGLRRMCSAGRRPRLPAAVLLVLVLLAAPPCLQAGGPIKTVVVVVMENRSFDHMLGWMKRLNPEIDGVTGGEWNPVNTTDPAAGRVYFGEGAQYVDPDPGHSFQEIRQQIFGSDDASGPARMDGFVQQARSLGGNMTDAVMHGFAPDSVAVYRELVAQFAVCDRWFASVPSSTQPNRLFVH

SEQ ID NO: 24510 - DNA, 675 bp, Panicum virgatum
  misc_feature: Ceres CLONE 1859090
  misc_feature: Encodes the peptide sequence at SEQ ID NO. 24511
atgcaacgacctctcctccgtcctcactcccactctcgacctgtcgacaatgccgagaaggtgtagcagcagcgtcggtggcagcgtgccgggcttggccatggcggcggcggcgtcatggctgctggtagtagcggcagtgctcgccggcgtcgcggacggccagctgcaggtggggttctactccagctcctgcccgggcgccgagtccaccgtcgcctccgtcgtccggcaggccggctccgccgaccccaccatcctgccggcgctcctccgcctccagttccacgactgcttcgtccgggggtgcgacgggtcggtcctcatcaagggcggcggcggcagcgccgaggtggacaacagcaagcaccagggcctccgcgggctcgagatcatcgagggcgccaagacccagctcgaggcccagtgccccggcgtcgtctcctgcgccgacatcgtcgccctcgccgcccgcgacgccgtcgcattcgtacgcacactttatttgttacatatacatatatacacatatatatttatatatatacatacatatacctatatatatatatatatatatatatatatatatatatatatatatatatatatatatatatatatatatctatacacatgtcgtggcagaccggcggggcgtctctctacgtgccc

SEQ ID NO: 24511 - protein, 208 aa, Panicum virgatum
  misc_feature: Ceres CLONE 1859090
  misc_feature (56)..(172): Pfam Name: peroxidase Pfam Description: Peroxidase
  misc_feature: SWISSPROT Homolog: EC 1.11.1.7 Peroxidase
  misc_feature: Useful for making plants with altered carbohydrate content
MPRRCSSSVGGSVPGLAMAAAASWLLVVAAVLAGVADGQLQVGFYSSSCPGAESTVASVVRQAGSADPTILPALLRLQFHDCFVRGCDGSVLIKGGGGSAEVDNSKHQGLRGLEIIEGAKTQLEAQCPGVVSCADIVALAARDAVAFVRTLYLLHIHIYTYIFIYIHTYTYIYIYIYIYIYIYIYIYIYIYIYLYTCRGRPAGRLSTC

SEQ ID NO: 24512 - DNA, 2106 bp, Panicum virgatum
  misc_feature: Ceres CLONE 1859091
  misc_feature: Encodes the peptide sequence at SEQ ID NO. 24513
atgccaccccagtaccccactagctgcctagtgcctagcacctagcaccccgtgaccatgccgacgcgtcccccggcccctccgctcctcttcctcctcctcctcgccgcggcctcggccgcgcatggccgcgccatctccggcggcggcgggagcctcagcctcctcccgggggccgcggccgccgtgctgcggctcccgtcggaggccgcgccgccggcgggggaggagaaggaggagggcggcggctgcgagatgacgtacgggttcctgccgtgcaccggcaccgcgctcgggaacctcttcctcgtcctggcctacggcttcctcatgttcaaggccgccacctacctctccgccggcagcgagctgctgctccagatcctcggccccggcgtcgtggggggcctcttcctgcccatcctcggcgcgctgcccgacgcgatgctcatcctcgtttccgggctctctggcaccaaagaggttgcacaaagtcaggttttgatcggaatgggcctgctcgcggggtcaactgtcatgcttttgaccctactctggggatcttgtgttgttgttggcaagtgtgatttgttggagaattcaaccgcagctgattgtcgggatacaaaaggcttcagtctttttggctctggtatttctactgatgtgcagaccagctatgcagcaagaatcatggcgatatctgtttttcctttcatcattgttcagatacccaaaatttttaagctccattctggtcatcgtttaacagtcctgcttggacttattgttgcagctctacttgtgcttgcttactgcctatatcaggtctttcagccatggatccagaggagaaggttagagtatgccagactaaagcacgtaatgtctggacttctaagacatgcccagatgcatgtgtttggccgccttcttgatgaagatggatcaccaaacgttcctgtgatcgagaagttgttccataagattgatctggataatgatggaaaactagaacgtggggaactacaagctttcattattggtattaagtttgaagatgttgacttggatagtagcctagctgtagatcaaatcatggcagactttgacagatcgcagaatcataccattgaaaagggggagtttgttgaaggaatcttgagatggctggaagaagctaagcattctattgctacctctggtgcatactcaaaaaagtttttgcaagattttcatacgagaaccagggatgaacacaatttgctgcttgacaaggatgatgaggatggtgaagctattgaaaatccaacctggacctgtttcaaggccatttcactgttgctcctgggaactgcaatggcggcagcatttgcagatccactagtcgatgccgtgcacaatttttcaaatgcgaccagtattccttcgttcttcatttcgttcattgcaatgccttttgcaaccaactccagcgaggctgtctccgcaattatatttgcaagccgaaagaagcagcggactctgtcacttacattctctgaggtctacggtgcggtgaccatgaacaacacactctgcttggtcgtgttcctggccctcgtttacgttcgggatttgacgtgggatttctcttcggaggtcctcgtcatcttccttgtctgcaccataatgggcctcttcaccagcttccggaccaatttcccgctctggacgtgcttcgtggcctatctgctgtatccgttgtcgctcatcatcgtctacgtccttgacttcaagttcggttggtcgtagacctggggtcttttaagtgtcaagtaatcaacacatatagatgtaacgtacactgtagaacgtatacgatgggcaaggcgactcgtacacatctggttttccttgcttattattgatgtactgcgtataggactgctgcaaatttggatctaaacagaattatggacgagcactagttagttgagagaagttccatgttattgctgttgaaagcaacgaataattttgagaagaacaggtgatgatgccttctgtcatttgtctttttacttggtccgaaggagaaatcagaaatgatcagtatctcctggc

SEQ ID NO: 24513 - protein, 578 aa, Panicum virgatum
  misc_feature: Ceres CLONE 1859091
  misc_feature (90)..(260): Pfam Name: Na_Ca_ex Pfam Description: Sodium/calcium exchanger protein
  misc_feature (434)..(568): Pfam Name: Na_Ca_ex Pfam Description: Sodium/calcium exchanger protein
  misc_feature (303)..(331): Pfam Name: efhand Pfam Description: EF hand
MPTRPPAPPLLFLLLLAAASAAHGRAISGGGGSLSLLPGAAAAVLRLPSEAAPPAGEEKEEGGGCEMTYGFLPCTGTALGNLFLVLAYGFLMFKAATYLSAGSELLLQILGPGVVGGLFLPILGALPDAMLILVSGLSGTKEVAQSQVLIGMGLLAGSTVMLLTLLWGSCVVVGKCDLLENSTAADCRDTKGFSLFGSGISTDVQTSYAARIMAISVFPFIIVQIPKIFKLHSGHRLTVLLGLIVAALLVLAYCLYQVFQPWIQRRRLEYARLKHVMSGLLRHAQMHVFGRLLDEDGSPNVPVIEKLFHKIDLDNDGKLERGELQAFIIGIKFEDVDLDSSLAVDQIMADFDRSQNHTIEKGEFVEGILRWLEEAKHSIATSGAYSKKFLQDFHTRTRDEHNLLLDKDDEDGEAIENPTWTCFKAISLLLLGTAMAAAFADPLVDAVHNFSNATSIPSFFISFIAMPFATNSSEAVSAIIFASRKKQRTLSLTFSEVYGAVTMNNTLCLVVFLALVYVRDLTWDFSSEVLVIFLVCTIMGLFTSFRTNFPLWTCFVAYLLYPLSLIIVYVLDFKFGWS

SEQ ID NO: 24514 - DNA, 718 bp, Panicum virgatum
  misc_feature: Ceres CLONE 1859115
  misc_feature: Encodes the peptide sequence at SEQ ID NO. 24515
gcacttggcacccaccacctcctctcgtctgctccgccgacagagcaagcagcagccaccaccaccgcctcccaggttcccacgtccctgccatcctttttgactccgggatcccctctcctgcccgcctgccgaggatccccccacgaccttcctactacttcccccatccttccgatctctccacgttcctctgaccagccgagcgtgaagtgagagagagggaaggaagggagggaggcggcggcgcgggtgaggaccgatggggaaggggagcgtgcgggcgctggccctggcgctcgccgtgctcctcgcctgctccggcgtcgctgttgtcacggcgcaggacaccgagcggatcgaaggaagtgctggcgatgtgctggaagataaccctattgggaggctcaaggtctttgtctatgatctccccagcaaatacaacaagaaactgctgaagaaggaccctaggtgcctgaaccacatgtttgctgctgagatattcatgcatcggttcctgttatcaagcgctgttcgaacttttaatcctgaggaagcagattggttctacacacctgtatacacaacatgcgatctgactccttcgggtcttcccttgcctttcaagtctcctcgaatgatgcgtagcgcaatccagctgattgccacaaactggccttactgraatagatcagaaggcgcagatcatttctttgtg

SEQ ID NO: 24515 - protein, 151 aa, Panicum virgatum
  misc_feature: Ceres CLONE 1859115
  misc_feature: Useful for making plants with altered carbohydrate content
  misc_feature: Useful for making plants with altered cell wall content and/or composition
  misc_feature (141)..(141): Xaa is any aa, unknown, or other
MGKGSVRALALALAVLLACSGVAVVTAQDTERIEGSAGDVLEDNPIGRLKVFVYDLPSKYNKKLLKKDPRCLNHMFAAEIFMHRFLLSSAVRTFNPEEADWFYTPVYTTCDLTPSGLPLPFKSPRMMRSAIQLIATNWPYXNRSEGADHFF

SEQ ID NO: 24516 - DNA, 1349 bp, Panicum virgatum
  misc_feature: Ceres CLONE 1859124
  misc_feature: Encodes the peptide sequence at SEQ ID NO. 24517
gcttgtccggttcagctccccttcccggccgtccgttccagagcttctggtggcttccgcctcatcggcggcatccgcacatgtaggcgccaccgacccgacccgccccgcgcgcgcgcgcgcccctgtccgcgaggccggcgagggagccaagctaccaaaccccatccgccttcccggcaccatggcgatgctgctccacagggtgtggggatccgtgctcgcgcgcgcggcgccggggccggtcccgggcccggcggctccaggctccccgcggggccgccgcgcgcagacgcccgccgagcagtactgcgcgtcgctgtcgctcggcgcgctcgacgccgtcccgaccgacgtggtcgcccagatcctgcgcctgctcggccccgtcgaagccgcgcgctccaccgccgtctgccgcgcctggcgcatcctcgcctccgacaacggcctgtgggccttcttcctgcgcctcggccccgagccatggggcctcgtcgtcttcgccgagacgcacctcgccgccggccccgattcgctcccgtggctgtacctgtacttcgatacctcgccgcagctctcgttcaaacagatttacggcctccgagcggtggtcccgggtactctcatagtggatggtggatctgggtattgcaagtacggctggagcaagtatgctgctccttccgggcgttgtgcgacattcttggaatttggtaacattgaatcacctatgtatgcgaggcttcgtcacttcttctctacgatctatacgaggatgcaagtaaagccttccactcaaccagttattgttgtccttccactgtgtcatactgatgatacggaatctgctagggcctcaagaaagcaatacaaggagacaatatactcagtcttgtttgatatgaatgttcctgctgtttgcgctgttgatcaagcagttttatctttgtatgcttctaaaaggacctccggaatcgttgtccacattggattcaataccacttctgttgttcccatttttgaaggcagggtaatgtatgagataggtgttgaaactgtggggcaaggagcccttaaactcactggatttcttaaggagttaatgcaccagagaaatatatcttgtgagtcactgtatactgtccggaccatcaaggagaaactttgctacgtagcggctgattatgaagctgaactacgtaaagatacacaagcttcttgtgaggttgatggtgaagggtggttcactctgtcaactgagagattcaagactgcggaaattctgtttcaggcccatatgggaggaatgcgtgctatgggcttgcataaagcagtagttctatgta

SEQ ID NO: 24517 - protein, 388 aa, Panicum virgatum
  misc_feature: Ceres CLONE 1859124
  misc_feature (146)..(388): Pfam Name: Actin Pfam Description: Actin
  misc_feature (49)..(96): Pfam Name: F-box Pfam Description: F-box domain
MAMLLHRVWGSVLARAAPGPVPGPAAPGSPRGRRAQTPAEQYCASLSLGALDAVPTDVVAQILRLLGPVEAARSTAVCRAWRILASDNGLWAFFLRLGPEPWGLVVFAETHLAAGPDSLPWLYLYFDTSPQLSFKQIYGLRAVVPGTLIVDGGSGYCKYGWSKYAAPSGRCATFLEFGNIESPMYARLRHFFSTIYTRMQVKPSTQPVIVVLPLCHTDDTESARASRKQYKETIYSVLFDMNVPAVCAVDQAVLSLYASKRTSGIVVHIGFNTTSVVPIFEGRVMYEIGVETVGQGALKLTGFLKELMHQRNISCESLYTVRTIKEKLCYVAADYEAELRKDTQASCEVDGEGWFTLSTERFKTAEILFQAHMGGMRAMGLHKAVVLC

SEQ ID NO: 24518 - DNA, 424 bp, Panicum virgatum
  misc_feature: Ceres CLONE 1859127
  misc_feature: Encodes the peptide sequence at SEQ ID NO. 24519
acggcactccaccagtccgcacagcccgcttcgcggtggaggtggtctggaagccagcaccgccaacccgcgagcagatagcgagagatggcccctgcgacctacctctccttctcggcgccgccgtcgtcgtgcgccggccgggagcggcggcggccggcgacgcgggcgtccgcgtccgggacggaccgggcgcgcgaggtggtgtcgcagatgcggcggctgccgctgcggaaggtgacgggcgactacgggccgtgggcggtgggcgcactccgagacgggctccagtggttcaacgggcgcggcgcacgccacggtttcttcacggcacgcgtccgctagcacagctccgccgtggtgcggctccgattcccgacgggaggcttcgcggcgcgcgacccgcgcaaggtgaccctgctag

SEQ ID NO: 24519 - protein, 85 aa, Panicum virgatum
  misc_feature: Ceres CLONE 1859127
  misc_feature: SWISSPROT Homolog: EC 4.2.1.92 Hydroperoxide dehydratase
MAPATYLSFSAPPSSCAGRERRRPATRASASGTDRAREVVSQMRRLPLRKVTGDYGPWAVGALRDGLQWFNGRGARHGFFTARVR

SEQ ID NO: 24520 - DNA, 389 bp, Panicum virgatum
  misc_feature: Ceres CLONE 1859156
  misc_feature: Encodes the peptide sequence at SEQ ID NO. 24521
aatcatccatctcacccccgttcaccccgtctatttgatttgcctttaatgcgttctgatttttgcgtttctccgaattaggaaggatgacctccttcctctggcactcctgtcctacgctcggagaaacgcttgacgacaccagaagaggatgaccttgggacagtgttgctgctaccccgtcctgagcagactccacagcgtcggggagctcatatgcgactccctatctgctccccccaatgagctctcccctgtcttctccagtctgaaaaaccttgcagagggcatgctgcagccccacgcgatcattgctgagtacctcatcgatgatcctgacgctgaccgcgataatctgacggatggcgccttttacgacgtcctgaagg

SEQ ID NO: 24521 - protein, 79 aa, Panicum virgatum
  misc_feature: Ceres CLONE 1859156
  misc_feature: SWISSPROT Homolog: EC 2.4.1.13 Sucrose synthase
  misc_feature: Useful for making plants with altered carbohydrate content
MTLGQCCCYPVLSRLHSVGELICDSLSAPPNELSPVFSSLKNLAEGMLQPHAIIAEYLIDDPDADRDNLTDGAFYDVLK

SEQ ID NO: 24522 - DNA, 686 bp, Panicum virgatum
  misc_feature: Ceres CLONE 1859162
  misc_feature: Encodes the peptide sequence at SEQ ID NO. 24523
gcaggccaaaaagtgatctgtattctgatcacactcagacatgatgcttgaagccaattgcgtgtgcgtgttgcctctcctcttcttctggggcctccacctcgcagccgtcgctgtctccggcgagttcgtctactccggcttcgcaggcgcgacggacctcgccctccacggtgccgccatggtaacgccaggcggcgtcctccagctgacagacggagcggcggtgagcaaaggccacgcgttccacccgacgccgctgcacctccgcggcggggggaaggaggacggggcggcggcggtccggtcattctcggcgtcgttcgtgttcggcatcgtgccggtcaccccgggcatgggcggccacggcctggcgctcgtcgtcgccccgtccagggacctctccaccgggacggccagcagctacctgggcttcctcaacagcactagcaacggcagcgcgcgcaaccacatggtcgccgtggagctggacaccatccagagccccgagttccaggacatcgacgacaaccacgtcggcgtcgacgtcaacagcctcgtctccgtgaactcatccagcgccggcttctacgacgaccggaccggcgagttcaggaacctcatcctcgtcagcggcgaggccatgcaggcgtgggtggactacgacggcggcgccacgcggatcg

SEQ ID NO: 24523 - protein, 215 aa, Panicum virgatum
  misc_feature: Ceres CLONE 1859162
  misc_feature (26)..(214): Pfam Name: Lectin_legB Pfam Description: Legume lectin domain
MMLEANCVCVLPLLFFWGLHLAAVAVSGEFVYSGFAGATDLALHGAAMVTPGGVLQLTDGAAVSKGHAFHPTPLHLRGGGKEDGAAAVRSFSASFVFGIVPVTPGMGGHGLALVVAPSRDLSTGTASSYLGFLNSTSNGSARNHMVAVELDTIQSPEFQDIDDNHVGVDVNSLVSVNSSSAGFYDDRTGEFRNLILVSGEAMQAWVDYDGGATRI

SEQ ID NO: 24524 - DNA, 623 bp, Panicum virgatum
  misc_feature: Ceres CLONE 1859164
  misc_feature: Encodes the peptide sequence at SEQ ID NO. 24525
tgatggaccgacaacctccgggaaccgtgtgcccactccaggaccagcactcacaagggagatctccttcggggatcaaaccgtctcccccgttgcagctgagaggcctgctgccatgaggatcgacagcgagacgcttgcgcagaacagggacagcgcgatgcagcggtacagggagaagaggaagaatcgcaggtatgagaagcacatccgctacgaatcgaggaagctgagggcggacacgaggaagcgggtgaaagggcggtttgtcaagtcgactgaagcactgaatgccgtcaatggcggatgagccaagagcctgtgaagatcgagctcggtgtgttgcgtctagtaggatggagctactaacatccgaaggtggtggtacggtgctacacctatgcatgatgctattgctggatcgccacgcagccgagccaaattttgcgttgaagcaagcgtcgtcattggtcagtcaatgcaagagactgcacggtatgcttgtaagttgcaagaaacgacaccccttttgctgctgccatcagaacagaaataggtagcttacagtacttgtttaccatgtggttttactagctacgagcgcctggtgatgcatatgttcg

SEQ ID NO: 24525 - protein, 102 aa, Panicum virgatum
  misc_feature: Ceres CLONE 1859164
  misc_feature (50)..(94): Pfam Name: CCT Pfam Description: CCT motif
  misc_feature: The sequence is a functional homolog of SEQ ID NO 226 in the 10/412,699 US patent application
  misc_feature: The sequence is a functional homolog of SEQ ID NO 458 in the 11/479,226 US patent application
  misc_feature: The sequence is a functional homolog of SEQ ID NO 486 in the 11/435,388 US patent application
  misc_feature: Useful for making plants with altered lignin content
  misc_feature: Useful for making plants with modulated cold sensitivity
  misc_feature: The sequence is a functional homolog of SEQ ID NO 410 in the 10/666,642 US patent application
  misc_feature: Useful for making plants with modulated flowering time
DGPTTSGNRVPTPGPALTREISFGDQTVSPVAAERPAAMRIDSETLAQNRDSAMQRYREKRKNRRYEKHIRYESRKLRADTRKRVKGRFVKSTEALNAVNGG

SEQ ID NO: 24526 - DNA, 688 bp, Panicum virgatum
  misc_feature: Ceres CLONE 1859194
  misc_feature: Encodes the peptide sequence at SEQ ID NO. 24527
agaggaagccggaagctccagtgcggcacacacccaccgagagcgaggacgcggcggcgccggcgaggggagagctcaggaagtgccgctgccttgagcgggcgatatggccgtggtgacggcgctggcggtggtggtggtggcggcgctcgcgccggccgcgcgcggggtggaccggagcgagttcccgccggggttcctcttcggcgccgcgacgtcggcgtaccagatcgagggcgcgtacctggaggacggcaagggcctcaacaactgggacgtcttcacccacacgcactctggagggatcatggacgggcggaacggggacgtggccgacgaccactaccatcgctacatgggagacgtggaggtgctgcagtcgctgggcgtcaacgcgtacaggttctccatctcatgggcaaggattctaccaagtacggcagggttaaaactgcacatgaaatttgtaagatttgccttggcgaccgttcgatcgaacagttcctgatttgggtggcaatgcgttctcgcaggaggcaggatcggcggcgtcaatccagacgggatagcgttctacaaccgcctgatcgatgccctcctgcagaaaggagtacagccgttcgtcacgctgcaccatttcgacatgccgcacgagctggaggtcccacacgttggctggctgggcgcc

SEQ ID NO: 24527 - protein, 133 aa, Panicum virgatum
  misc_feature: Ceres CLONE 1859194
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
MAVVTALAVVVVAALAPAARGVDRSEFPPGFLFGAATSAYQIEGAYLEDGKGLNNWDVFTHTHSGGIMDGRNGDVADDHYHRYMGDVEVLQSLGVNAYRFSISWARILPSTAGLKLHMKFVRFALATVRSNSS

SEQ ID NO: 24528 - DNA, 1421 bp, Panicum virgatum
  misc_feature: Ceres CLONE 1859196
  misc_feature: Encodes the peptide sequence at SEQ ID NO. 24529
agcagttcacttccggccggttgctgagagggtgagggtgtagcgcccgaacgggtgagagcgcttgcattgtccgcaagagcggcggcagctcgcaatggcgacgaaccccggccccttgaccgagtggccatggaagaagctcggcaacttcaagtacctgcttgtggcgccgtgggttctgcacgggtggtacctgtcggcgaccaaggggtggcgcgcggcggacccggggtatctggccatcttcccgtcgctgctcctccgggcggcccacaaccaggcgtggatcacggcgtcccgcgtgcagaacgcgcggagccggcggcagatcgtggcggacaggggcatcgagttcgagcaggtggaccgggagcgcaactgggacgaccagatcctcctcagcggcatcctcctctacctgggcgccctctacatgcccggcggccagcacccgccgctctggcgcgccgacggcttccacctcatcgcgctgctccacgccgggcccgtcgagttcctctactactggttccaccgcgcgctgcaccaccacttcctctacacgcgataccactcccaccaccattcctccatcgtcacagagccaatcacatccgtcatccatccatttgttgagctcgtggcttatgaagtgctgttcgcgatcccattgatcacatgcgccttgacaagaactgcttcaatccttgcattcgagatctatgttatctacgtcgacttcatgaacaacatgggtcactgcaacttcgaactggtgccaagttggctcttcaagtggttccctcctctcaagtatctaatgtacacaccctcgttccattctcttcaccacacacagttcaggacaaactactccctgttcatgtcattctatgattacatatataacaccatggacaagtcatcggatgcgctgtatgagaaatcacggaaggccaaagaggacacagtagatgtggttcatcttacccatcttaccagcctgcagtccatttatcatatgaggcccgggtttgctgaatacgcttccaagccttacacttccaagtggtacatgcggatgatgtggcctgtatcatggctttccatggttctgacatggacatacgggacttcattcgctgttgagaggaacatcatgaagaaactcaagatgcagtcatgggccattccgagatacagtttccattacggattgacttgggagaaggaagcgatcaacaacctaatcgaaaaggcaatatgtgaagctgacaagaaaggcgctaaagttgttagcctcggactccttaaccaggcacatagcctcaatggaaatggagaactttatctgcggaagtacccaaagttggaggttcgacttgtagatggcaccagcttagctgctgcggtggttg

SEQ ID NO: 24529 - protein, 441 aa, Panicum virgatum
  misc_feature: Ceres CLONE 1859196
  misc_feature (132)..(254): Pfam Name: FA_hydroxylase Pfam Description: Fatty acid hydroxylase
  misc_feature: SWISSPROT Homolog: EC 1.14.13.72 Methylsterol monooxygenase
MATNPGPLTEWPWKKLGNFKYLLVAPWVLHGWYLSATKGWRAADPGYLAIFPSLLLRAAHNQAWITASRVQNARSRRQIVADRGIEFEQVDRERNWDDQILLSGILLYLGALYMPGGQHPPLWRADGFHLIALLHAGPVEFLYYWFHRALHHHFLYTRYHSHHHSSIVTEPITSVIHPFVELVAYEVLFAIPLITCALTRTASILAFEIYVIYVDFMNNMGHCNFELVPSWLFKWFPPLKYLMYTPSFHSLHHTQFRTNYSLFMSFYDYIYNTMDKSSDALYEKSRKAKEDTVDVVHLTHLTSLQSIYHMRPGFAEYASKPYTSKWYMRMMWPVSWLSMVLTWTYGTSFAVERNIMKKLKMQSWAIPRYSFHYGLTWEKEAINNLIEKAICEADKKGAKVVSLGLLNQAHSLNGNGELYLRKYPKLEVRLVDGTSLAAAVV

SEQ ID NO: 24530 - DNA, 699 bp, Panicum virgatum
  misc_feature: Ceres CLONE 1859196-R
aggtctagatgcttctgagcaatcaaaggcacagaaaggaacccagtttatcccatattcccagtttccaccaaaaatggtacgcaaggacagctgcacttactcatcaactcctgcaatgtctgtgccaaaaacgctacagaatgtgcactcttgcgagaattggttaccgaggagggtcatgagtgcctggcgcattgctggaatggttcatgcattggagggatggaacgagcatgagtgtggggacagtgtgctagacatggagaaagtatggtctgctgctcttctgcatggtttccgccctattgctcaagtttgattccccaattgcagttgcaaggcaatgcaataagttctcatgggagctatgctacagacatagtagggtgttgatgttctatttctccccctctatttcttatcgattgcgaccttttggctatccatataagtatatagtcaagacgaactcttttatcagcacaaaacctttccgctgaagtggagaaaatgcatttcaatatggataagcagggatgggatgtagcatataagtattctgatctatcatagctagctgtttactacgtttctccatccatcaatgtgtaattctacaataagcaagtatggaaattgttgttgcttgttgtatgcagaggtgtcaatgtcagatttggtccaacacttgagttt

SEQ ID NO: 24531 - DNA, 657 bp, Panicum virgatum
  misc_feature: Ceres CLONE 1859197
  misc_feature: Encodes the peptide sequence at SEQ ID NO. 24532
gtgtgtaaccataaccaaacaataattgacctcatcgctcaggagcaaatcactcctctccctttggatcttcctccagggacaagagccaagataagccttgtgtgggggagcatggatattaaactccacgaccttgaaactatcacaaacaatttctcggaggagcataaagttggcagtggtgggtatggcgatgtttacaggggttggtataaggggcaagagattgctatgaagaagcttcatcagctgcaaggacttgacgataaggcgtttcactctgaattccgtaaccttatcaaggtccaccatcaaaatgtcgttcggttaattggctactgctacgaatcacgacataaatacctcgaccacaatggggacaagatttttgctaaagaaatggagcgaattctttgctttgagtatatggaaggtggaagccttgataaacatatttcagatgaatcttgtgatcttgactggccgacatgttatgaaattataaaagggacctgtgagggcttaaatcacctgcacaatgctcaggacagacctattttccatctggacttaaaacctgctaacatattgctggataagaacaaggtggccaaaatagcagatcttggtttgtctagacttgttgcttcaaca

SEQ ID NO: 24532 - protein, 180 aa, Panicum virgatum
  misc_feature: Ceres CLONE 1859197
  misc_feature (15)..(180): Pfam Name: Pkinase_Tyr Pfam Description: Protein tyrosine kinase
  misc_feature: SWISSPROT Homolog: EC 2.7.11.1 Non-specific serine/threonine protein kinase
MDIKLHDLETITNNFSEEHKVGSGGYGDVYRGWYKGQEIAMKKLHQLQGLDDKAFHSEFRNLIKVHHQNVVRLIGYCYESRHKYLDHNGDKIFAKEMERILCFEYMEGGSLDKHISDESCDLDWPTCYEIIKGTCEGLNHLHNAQDRPIFHLDLKPANILLDKNKVAKIADLGLSRLVAS

SEQ ID NO: 24533 - DNA, 686 bp, Panicum virgatum
  misc_feature: Ceres CLONE 1859216
  misc_feature: Encodes the peptide sequence at SEQ ID NO. 24534
gtggccaaagcattgggcatctaaagaatgtccactgctagcttgatgtgtgtggccggaatcagagagctttaaggatgatggcctgggaccagttccatcccattggaaaggagcatgcgacaaaggccaggatcataagttctcttgcaacaggaagctgatcggcgcgcgcttcttcaacaagggctacgccgcggcggccggcgcgctgaacgcgtcgatgaacaccccgcgcgacatggacgggcacggcacgcacacgctgtcgacggcggccgggtcgccggtgcccggcgcctccgtgttcgggttcggcaacggcacggcgtccggcggctcgccccgcgcgcgcgtggcagcctaccgcgtgtgctacccgcccgtgaatggcagcgagtgcttcgacgccgacatcctggccgcgttcgacgccgccatccacgacggcgtgcacgtgctctcgctctccctcggcggcgacccctccaactacttcgacgacggcatcgccatcgggtccttccacgccgtccgccgcggcatcgccgtcgtctgctccgccggcaactcgggccccgccctcggcaccgcctccaacctcgcgccgtggatcttcaccaccggcgccagcaccatggaccgcgacttctcgtcctacatcgtcttcgagcacaggaagggcc

SEQ ID NO: 24534 - protein, 148 aa, Panicum virgatum
  misc_feature: Ceres CLONE 1859216
  misc_feature: SWISSPROT Homolog: EC 3.4.21.25 Cucumisin
  misc_feature: Useful for making plants with modulated flowering time
MDGHGTHTLSTAAGSPVPGASVFGFGNGTASGGSPRARVAAYRVCYPPVNGSECFDADILAAFDAAIHDGVHVLSLSLGGDPSNYFDDGIAIGSFHAVRRGIAVVCSAGNSGPALGTASNLAPWIFTTGASTMDRDFSSYIVFEHRKG

SEQ ID NO: 24535 - DNA, 2979 bp, Panicum virgatum
  misc_feature: Ceres CLONE 1859240
  misc_feature: Encodes the peptide sequence at SEQ ID NO. 24536
ggcatccggaaacccccctccgaccgtccgacgcctctcgatttgaaatccccaccccgaaatcggaaaaaattagaagaggaaaaacaaaaagctctcgatctagggatccccttcccggcctctcgttcccctccctcccccaaaaccctaggccagcctagcggcggagctcgcccgccccggaccatggccgaagaccactactcctccgcgtcggccgccgccccgtcggcggcggcgaccgcggcggccgctgcggcggcggcggtcgggtcgtcggtgatcccgatcgtcaacaagctgcaggacatcttcgcgcagctggggagcagctccacgatcgacctgccgcaggtggccgtggtggggagccagagcagcggcaagtccagcgtcctcgaggcgctcgtcggccgcgacttcctcccgcggggctccgacatctgcacgcgccgccccctcgtgcttcagctcgtgcaccagccgcgacgacccacagacgccgaggccgatgagtggggcgagttcctgcacctctcgggccgccgcttctacgactttcgagatatccggcgggagatccaggcagaaacggatcgggaggcgggtggtaacaagggtgtatcagataggcagatccgtttgaagattttttcaccaaatgttcttaacattactttggtcgatttgcctggaatcactaaggtgccagttggtgaccaaccaactgatattgaggccagaataaggactatgataatgtcatacatcagacacaagacatgtatcatcttagctgtttcaccagcaaatgcagatttagcaaattctgatgctcttcaaatggctcgggttgctgatcctgatggttctcgaacaatcggtgttatcacaaagctggacataatggacaggggcactgatgcccgcaactttctgctgggaaatgtgatccccttgaaacttggctatgttggcgtggtaaaccgaagccagcaggatatcaactctgaccttagtatcaaagatgctctggctcgtgaagaaaaattcttccatactcaaccagcatatcatggtcttactcagtactgtggaataccacaattagcaaagaagctaaaccagatcctggtccaacatataaaaacagttctgccagggcttaagtcacgcataagcagtcaattgactgctgttgctaaggagcttgctgtgtatggtgatcctgttgactcaaaggccgggcaaggtgcaaagcttttgaacattctagctaaatattgtgaagcattctcctcgatggtggaaggaaaaaatgaagatatatcaaccattgaactttctggtggagcaagaatccattacatttttcagtctatctttgtaaaaagcttagaggaggttgacccctatgaggatgttacggatgaagacatccgcatggctatccaaaatgcaactggtcctagaagcgcgctgtttgtacctgaagtaccatttgaagtccttgtacgtaggcagatcagcagattgcttgatccaagtcttcagtgtgcacaattcatatatgatgagctagtaaagatgagccatcgctgccttgcaacagagctgcagcagtttcctatactccgccgaagcatggatgaagtaattgggaagtttttgcgggatgggcttaagccagcagaaagtatgatagcacacattattgagatggaggaggattacataaacacatcacacccgaattttatcggtggcagcaaggctgtcgagctagcacaacagcaagttaggtctgctaaaatgtcatcgtcggtggtaagaaaggatggagtagatgctgataaggtacaggcttctgaaaagactcaaaaaatgcgtgcagtattgggcagaacagtaaatggagtaattactgatcacatccagggggtaaggcctgcttccgaggctgagagaccaggatcttctggtagtggaagcacatccttttggaattcaatatttacttccaacgaggaccgtgcacatgcttctgcaaaagataattcagcaaacagatcgtatactgtgccgacacccaatctggaacattcattctccacgatacagttaagagagccaccggtcgtccttaaaccttcagaacaccagtctgagcaggaagcactcgaaatagcaatcacaaaattgctattgaagtcatattacaatatagtcaggaaaaatgtggaggacttcatcccaaaagcaattatgcatttcctggttaatcacacaaaaagggcgctgcataattacctcataacaaagctttacagagatgatctcttggaggacttgctcaaagaacctgatgagataaccataaagaggaagcagataagagaaaatctcaaggttcttcagcaagcttacaaaactttggacgagataccactcgacgcggaggcagttgagaggggtggctattcccttgactctgatgtgattggtctaccaagggcccacgggctttcgtcatccctacatggattcaatgatggaagttcaccatattcaaccccaaagcagtcaaggtcaaggagatccaaccattcaggggaacagccccctttcaataccaatatgagtggcaatggtttttgatgccacctttcaatgttgcctctcccagattgaaccgcatcaagtttgttgccatccatagatatatgttttttctagttatattctttgtagcgctgcgccgatgaagcctgacatggtgcgagttttgtcatttcgcctttttgtacagtatatctttgcccagtcattgtcttaaatgatatcggtgatgggtatagttttgttcggacccatggaagaagctatggaaatttctactaggtgtagtagtgccgagtgcctgtatgttaccacggatttgctgtgcaaaatatgacatggctggtatggtggtgc

SEQ ID NO: 24536 - protein, 823 aa, Panicum virgatum
  misc_feature: Ceres CLONE 1859240
  misc_feature (247)..(540): Pfam Name: Dynamin_M Pfam Description: Dynamin central region
  misc_feature (57)..(238): Pfam Name: Dynamin_N Pfam Description: Dynamin family
  misc_feature (662)..(753): Pfam Name: GED Pfam Description: Dynamin GTPase effector domain
  misc_feature: SWISSPROT Homolog: EC 3.6.5.5 Dynamin GTPase
MAEDHYSSASAAAPSAAATAAAAAAAAVGSSVIPIVNKLQDIFAQLGSSSTIDLPQVAVVGSQSSGKSSVLEALVGRDFLPRGSDICTRRPLVLQLVHQPRRPTDAEADEWGEFLHLSGRRFYDFRDIRREIQAETDREAGGNKGVSDRQIRLKIFSPNVLNITLVDLPGITKVPVGDQPTDIEARIRTMIMSYIRHKTCIILAVSPANADLANSDALQMARVADPDGSRTIGVITKLDIMDRGTDARNFLLGNVIPLKLGYVGVVNRSQQDINSDLSIKDALAREEKFFHTQPAYHGLTQYCGIPQLAKKLNQILVQHIKTVLPGLKSRISSQLTAVAKELAVYGDPVDSKAGQGAKLLNILAKYCEAFSSMVEGKNEDISTIELSGGARIHYIFQSIFVKSLEEVDPYEDVTDEDIRMAIQNATGPRSALFVPEVPFEVLVRRQISRLLDPSLQCAQFIYDELVKMSHRCLATELQQFPILRRSMDEVIGKFLRDGLKPAESMIAHIIEMEEDYINTSHPNFIGGSKAVELAQQQVRSAKMSSSVVRKDGVDADKVQASEKTQKMRAVLGRTVNGVITDHIQGVRPASEAERPGSSGSGSTSFWNSIFTSNEDRAHASAKDNSANRSYTVPTPNLEHSFSTIQLREPPVVLKPSEHQSEQEALEIAITKLLLKSYYNIVRKNVEDFIPKAIMHFLVNHTKRALHNYLITKLYRDDLLEDLLKEPDEITIKRKQIRENLKVLQQAYKTLDEIPLDAEAVERGGYSLDSDVIGLPRAHGLSSSLHGFNDGSSPYSTPKQSRSRRSNHSGEQPPFNTNMSGNGF

SEQ ID NO: 24537 - DNA, 697 bp, Panicum virgatum
  misc_feature: Ceres CLONE 1859253
  misc_feature: Encodes the peptide sequence at SEQ ID NO. 24538
ctcgcgaaccggaaccaccaccaggacggctgctagactcgagcctcgccctccccctcctcccaccaactgcagcagcgagacagagaatggctgcggcgccgtggtccctcgcgtgctcctcccgcgtctcccgccccgcggacctccgccgcacggcggcggcccctgctgatgccccgcagcagctccgcctcggccgctcccgccgccgcgcgcagcgcaccgtcgccatggctggatccggcaagttcttcgtggggggcaactggaagtgcaatggaacaaaggactccattagcaagcttgtctctgaattgaatgctgctacactcgaaactgatgtagatgttgtggtggcacctccattcatttatattgaccaggtcaagaattcactaactggtcgtattgaggtttctgctcagaatgtatggatcggaaaaggaggagcctacactggagagatcagtgcagaacaattggtggacataggctgtcaatgggttattcttgggcactctgagcgtagaaatattattggtgaaactgatgagtttatcgggaagaaggctgcatatgcattgagccaaaatattaaggttattgcctgcataggagagctggaggaagagaagatggggcagggtctatccatgtcgcagaagctcactctcgcctacgccgcgctcgtcgg

SEQ ID NO: 24538 - protein, 202 aa, Panicum virgatum
  misc_feature: Ceres CLONE 1859253
  misc_feature (55)..(202): Pfam Name: TIM Pfam Description: Triosephosphate isomerase
  misc_feature: SWISSPROT Homolog: EC 5.3.1.1 Triose-phosphate isomerase
  misc_feature: Useful for making plants with modulated biomass
MAAAPWSLACSSRVSRPADLRRTAAAPADAPQQLRLGRSRRRAQRTVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRNIIGETDEFIGKKAAYALSQNIKVIACIGELEEEKMGQGLSMSQKLTLAYAALV

SEQ ID NO: 24539 - DNA, 1655 bp, Panicum virgatum
  misc_feature: Ceres CLONE 1859261
  misc_feature: Encodes the peptide sequence at SEQ ID NO. 24540
cagcgcaagtcctcatccgactcccccctccatccgccacctcacctccgctagctccgagcgccccccatttcgccgtcgaggtgtcaggagtagcagattgcatgttcgtgatcgtggcgccttaattggactttgatatgggttctgctgcaactgaaagcaatgacaccttgctgggcaatggagttgttgggattcttgccgagacttgtaatatgtgggaaaggagggcaccgttaactccttcccactgtgctcgccttctgctcggaggagggaacagaactcgagtaaaccggataattgtgcagccaagcacaaagaggatccatcatgatgctcagtatgaggatgctggatgcaagatttcagaagacctgtcagagtgtggccttattataggcatcaaacaaccaaagttggagatgattcttccagatagagcgtatgcgttcttttcacacacccacaaggcccagaaagagaatatgccactgttagataagatcctggaagagagggtgtccttgttcgattatgagctaattgttggagatgatgggaaaagatcgcttgcatttgggaagtttgctggtagagctgggctgatagatttcttacatggtctcggacagcgatatttaagccttgggtactcgactccgttcctctctctggggcaatcccatatgtatccttcactcgctgcagccaaggctgcagtcattgccgttggtgaagagatagcaacatttggacttccatctggaatttgtccaatagtatttgtattcactggcgttgggaatgtctctcagggtgcacaggagatattcaagctattgccccataccttcgttgatgctgagaaacttcctgaaatttctgcggcctggaatctgtctaaacaatctcagtcaaccaagagagtatttcaactgtatggttgtgttgtgacttctagagacatggtctctcacaaggatcctaccagacattttgacaaagctgactattatgctcatccagaacactacactccagtttttcatgaaaggattgctccatatgcatctgtcattgtaaactgtatgtactgggagaggaggtttccacgattactcaatgtgatttgccaacgaatggaacagaggatggcctatggccacaatgagcaggacatggtactgctgcaccatgaagtggaagtggactacccggatgggcgacccactgaaaagcaccaagcgacgctactggagttcggaaaggttgagaatggcggatccaccaccactgcgatggcccttactgttggcgtaccagcagcaataggagctctgctcttgcttaagaacaaggtgcagacgaaaggagtaatcaggcctctcgaacccgaaatctacattccagcattggagatgctggagtcgtcaggcatcaagctggctgagagagtggagatttaaaaactccaaagttacagctttgtatatagaattatagatgtatagatatagtatacttgggtacataccttctgcacatactctgttctgttctaaatagggcaaatagcaactaaggatcgttggtgtatcatatggccctctgtgacctatatatcaaataaagtgcccataggttgattc

SEQ ID NO: 24540 - protein, 443 aa, Panicum virgatum
  misc_feature: Ceres CLONE 1859261
  misc_feature (19)..(155): Pfam Name: AlaDh_PNT_N Pfam Description: Alanine dehydrogenase/PNT, N-terminal domain
  misc_feature (195)..(366): Pfam Name: AlaDh_PNT_C Pfam Description: Alanine dehydrogenase/PNT, C-terminal domain
  misc_feature (329)..(440): SWISSPROT Homolog: EC 1.5.1.10 Saccharopine dehydrogenase (NADP(+), L-glutamate-forming)
  misc_feature (22)..(156): SWISSPROT Homolog: EC 1.5.1.7 Saccharopine dehydrogenase (NAD(+), L-lysine-forming)
MGSAATESNDTLLGNGVVGILAETCNMWERRAPLTPSHCARLLLGGGNRTRVNRIIVQPSTKRIHHDAQYEDAGCKISEDLSECGLIIGIKQPKLEMILPDRAYAFFSHTHKAQKENMPLLDKILEERVSLFDYELIVGDDGKRSLAFGKFAGRAGLIDFLHGLGQRYLSLGYSTPFLSLGQSHMYPSLAAAKAAVIAVGEEIATFGLPSGICPIVFVFTGVGNVSQGAQEIFKLLPHTFVDAEKLPEISAAWNLSKQSQSTKRVFQLYGCVVTSRDMVSHKDPTRHFDKADYYAHPEHYTPVFHERIAPYASVIVNCMYWERRFPRLLNVICQRMEQRMAYGHNEQDMVLLHHEVEVDYPDGRPTEKHQATLLEFGKVENGGSTTTAMALTVGVPAAIGALLLLKNKVQTKGVIRPLEPEIYIPALEMLESSGIKLAERVEI

SEQ ID NO: 24541 - DNA, 1741 bp, Panicum virgatum
  misc_feature: Ceres CLONE 1859269
  misc_feature: Encodes the peptide sequence at SEQ ID NO. 24542
accaaccaagcgaaggcgctctctctctctctctctctctctctctctcatcccgtcttctccctggcctctctcctctctctctattagttcccaaatcgcagcagcagcaacaacagatccaatacatactaggttccattgcatcacacatcagtcacccaaaccatcaaatcacacaggcgaggagagagagagagtgggggaacggggagggagtgggggagaggaggaagcagatgagagagagatgctgctactaaagcagcagcccatctatccatcaatcaggtagctcgccagcaatcgcgtgccgcctttccactcacgtacaccgcctctcagctcggctcggttggttcgttgccgcgtcaaatcggggcaaagcggagccagtcatcctgttgcttcgcgtgctccgctgttgcttgcaccgcgcgtaccttcaggaactcaggaaggagaggcagcgatcgatcggtcggccggtcggtggttgtcgtcggcgcccggcatgtcgtcctcctcgtcgtcgtcctccgcggcctccaccgccgccgtgttccctccctccccgccgccgctgctggtggagaacctcccgccgctgcaccagctcacgccggtggccgcggcgccgccggccgccgagcagctctgctacgtgcactgccacttctgcgacaccgtcctcgtcgtgagcgtgccgacgagcagcctgttcaagacggtgacggtgcggtgcggccactgcagcagcctgctcaccgtcaacatgaggggcctcctcttcccgggcacgccaacgacgaacaccgccgccgccgccgcaccaactgaaatcaccagcactaccaccaccatcaccacggcgccgccgccgcccgcctcgtcggccaacaacggccagttccacttcccccacccgctcaaccagctggcacccaaccctccccaccaatccctcctggacgagatatcgagcgcgaacccgagcctgcaactgctggagcagcacggcctcggcggcctgatccccggcggcaggaacgccgccgcgccgccgcccccgccgccgctggccgcggcggggaataataaaggggccaagcaggaggcgtcgccgcgcgctaaccccgtcgtcaacagacctccggagaagaggcagcgcgtgccgtcggcgtacaaccgcttcatcaaggacgaaatccaacgcatcaaggctggcaatcccgacatctcgcacagggaagccttcagcgcggcggccaagaactgggcgcactttccgcatatccactttggactcatgccggatcaccagcaggggctcaagaagacaagcctgctacctcaggatcatcaccagagaaaggacgggctcctaataaaggacgggctctacgcggcagcagccgctgccgcggcggctgcggccaacatgggggttgctccatactaattactcaagcttagctgctagcgagtttgctgctgtttacctagctgccgagactctcctttaacttctggctcctgtgaccagccaagctatatatctatctagggcttactcgatcgatccctctcttgttaatctgtgctatagctctcgctgttggaatcaagcactacctgcaatgcaggcaggggttgatcgatcgagctgttcatcgcctgcatggtcaattatcctgctctagtgtctctgttttgccgttgattaattatggcatggatg

SEQ ID NO: 24542 - protein, 315 aa, Panicum virgatum
  misc_feature: Ceres CLONE 1859269
  misc_feature (39)..(265): Pfam Name: YABBY Pfam Description: YABBY protein
MSSSSSSSSAASTAAVFPPSPPPLLVENLPPLHQLTPVAAAPPAAEQLCYVHCHFCDTVLVVSVPTSSLFKTVTVRCGHCSSLLTVNMRGLLFPGTPTTNTAAAAAPTEITSTTTTITTAPPPPASSANNGQFHFPHPLNQLAPNPPHQSLLDEISSANPSLQLLEQHGLGGLIPGGRNAAAPPPPPPLAAAGNNKGAKQEASPRANPVVNRPPEKRQRVPSAYNRFIKDEIQRIKAGNPDISHREAFSAAAKNWAHFPHIHFGLMPDHQQGLKKTSLLPQDHHQRKDGLLIKDGLYAAAAAAAAAAANMGVAPY

SEQ ID NO: 24543 - DNA, 695 bp, Panicum virgatum
  misc_feature: Ceres CLONE 1859279
  misc_feature: Encodes the peptide sequence at SEQ ID NO. 24544
cctccctcacaaccggttcccgaccgccgcgcacacctccacgccgcccaccaccgctctctcctcgaccgcatccctccgcccccggcaggcacaccgaccccgaggccctcgccgccgcgccgaccatggccaatacgctgcggttgtacctcacttgcatccggaacactctggaggcggcgatgtgcctccagaattttccttgccaagaagttgagaggcacaacaagccagaggtggagctcaagacaagccctgaacttctactgaacccggtactcatatgccgcaatgaagcagaaaaatgtttaatagagacttcaatcaactctgtccgtataagcatgaaggttaagcaagcagatgaactggaaaacattcttgcaaagaaatttcttaggtttttatcaatgagggcagaggcattccaagtgttgaggagaaaaccagttcagggttatgatatcagttttctgataacaaactaccattgcgaggacatgcataagcacaagctcatagatttcatcgtgcagtttatggaggacatcgacaaggagatcagtgagttgaagctgtcagtaaacacccgcggccggcttgtggcgactgaatttttgaagcagttcatatgatgactcagccatagtagtagtacagtgctgagaaacgtcatgatcgcggcctgtagc

SEQ ID NO: 24544 - protein, 169 aa, Panicum virgatum
  misc_feature: Ceres CLONE 1859279
  misc_feature (1)..(168): Pfam Name: ARPC4 Pfam Description: ARP2/3 complex 20 kDa subunit (ARPC4)
MANTLRLYLTCIRNTLEAAMCLQNFPCQEVERHNKPEVELKTSPELLLNPVLICRNEAEKCLIETSINSVRISMKVKQADELENILAKKFLRFLSMRAEAFQVLRRKPVQGYDISFLITNYHCEDMHKHKLIDFIVQFMEDIDKEISELKLSVNTRGRLVATEFLKQFI

SEQ ID NO: 24545 - DNA, 635 bp, Panicum virgatum
  misc_feature: Ceres CLONE 1859303
  misc_feature: Encodes the peptide sequence at SEQ ID NO. 24546
gtcgcggggcgctccgggcagacgttccgccggcccgctgtaccgtagctccgctccgccctctcgcgccggtcctcgccgtgctgcactcgcgtcgtcggccgcaatgcggcgggcgccgggcgctggtggcggggcctccctcgcccgcctcgccgtcgcgctgtgctgcgccgcgctcgcgccccgcgccgcggcggacctcgcggcggaccgggcggcgctgctcgcgttccgggccgcggtggggccgcggctcccgtgggacgcgtccgcggcgtccccctgcgggtggcgcggcgtcgggtgcgaccgcgcgggctcgcgcgtcgtcgcgctgaagctcccgggggccagcctcgccggcgcggtgccgcccgggactctcgggaacctgacggcgctgcggacgctgtcgctccgcctcaacgcgctgtccggcgggatccccgccgacatcgggggctgcgcggagctcaggtacctctacctccacggcaaccggttcgagggcgggataccggagggcttcttcgggctaagcttgctgcagcggctggtcctctccggcaaccagatttccggcggggtctcgccggagttcaacaagctcgcccggctcgctactctgtatt

SEQ ID NO: 24546 - protein, 176 aa, Panicum virgatum
  misc_feature: Ceres CLONE 1859303
  misc_feature (33)..(69): Pfam Name: LRRNT_2 Pfam Description: Leucine rich repeat N-terminal domain
  misc_feature: SWISSPROT Homolog: EC 2.7.11.1 Non-specific serine/threonine protein kinase
MRRAPGAGGGASLARLAVALCCAALAPRAAADLAADRAALLAFRAAVGPRLPWDASAASPCGWRGVGCDRAGSRVVALKLPGASLAGAVPPGTLGNLTALRTLSLRLNALSGGIPADIGGCAELRYLYLHGNRFEGGIPEGFFGLSLLQRLVLSGNQISGGVSPEFNKLARLATLY

SEQ ID NO: 24547 - DNA, 2244 bp, Panicum virgatum
  misc_feature: Ceres CLONE 1859311
  misc_feature: Encodes the peptide sequence at SEQ ID NO. 24548
aaactcttcccagtcgtctcgcagtctcaccacgcacccttcccccacctccgacgaaagattgaggcgcctcacctcatcttcaatggccggcgcctagatacagccccaccaagcaagcgtccctgcgcaccttgctcctgccgtcgtgctgtgccgtgcatccatcgacggtcagttgctatttctgcttgctctccatacgtacgaaattttagtcacattcaaaccagcagtggcttcggttcttgcattggatcaaggcagtgctaagatggctcgggcgaaccagagatcctgcacgcgttgccacagggacctcccgacctgctcctgcggcggcgtcgggcccgcccgtcgatccgcccggctctgccgcggccgcgacccgggcggcgccgaccgcatcagcgccctgcccgacgacctgctgctccagatcctcaaccgcctcggctgcgccgccgccgccgcccggacgggcctgctgtcgcgccggtggcggggcctctggacccgcctccccgacctcgtcctccgcgagatgaaccccggctcgctccacgccgcgctcgcgcggctcgtcgccgcgttcgagctcgagccccgcgcccggccgcggctcctcaacatccgggcccccagctaccgcatgttctcgcccgcccagatcgcctcgctgctcaacgccgccgcgatgctgcagccggagaatctcactgtcgccgtcgccgctgccgtcctggtgatgctaccctccctcgacggcaccaggtcgatgacgctggacgtgcagggcgtcagtctgatcaccccccaattcggggacatgcccgacctcgagagcctgtcgcttcatcgctacgacgctgtcccattcagcctgctccgccgctgctccgcgctgcgtagcctctcgatctcctactggcgccttgactccatcacgatcgacctgcccttgctcgaggagctagttctgtcgcccacggcgcagctccggcgagtcgtcatcaaagcccctaggcttaagaagctgacgtttggggccatagagggtgtcctggatgatttctccctgtgctacatggcatcagaggtggagcatctctcgtggcaatgcgctagcggcgcgtcacatgttcactttggtgatatttggtccctgatgaccgtgactatgaagacatcggagcctcaaggtcagctgcagcgctgccctacctccaacaccctgtcgctcaacatatttgaatggcagtttgatcaggaagaaggtgcagccctgagctttgactttgagcattacatatcatcctgctgtcctattgccaacatttctgctttagagctgtgcatcaactccagcggtcatgtctacggagcactggtcctgcacctgctggaggtttataccttgataaagaggctcaaggtggacctgtgtaagtttcaggagagaagagaatgtagtgcgaactgcccctgtattcagttgaataactggagcaatcagactgtctccttgactcatctgaatgaaatggaaattaaaggcgttagaggggaggatcatgaaattgatatattaaaagtcatattaagaagtgcagcgaggcttgaaaaagtgaccatcacattcaagacgaagtcgaaacagcacattcgccacttttccaataaactacaaagaatcttgaaggcacatccctatgtgaagtgtggaatttatcgctgttctggtgaggaggtggtgtttgcatgactagcttacttgtaggtgtgaaaagattccactgcagttaattttgatggagccaaaacagcctgaagctatttaagtggttggagtttagccagcatccagcatccatttcctaaattccaagtgtctcaaggggcgtcccagaggccacttctatatcaagggcggcagagatgctgctgttaccgtgcatttgggatgaacttatctactgaaaaagattaatttactctctttaacaatgtactatccctggaggggcgtcccagaggccacttctatatcaagggcggcagagatgctgctgttaccgtgcatttgggatgaacttatctactgaaaaagattaatttactctctttagcaatgtactatccctggagcattattttgggggaaacatgtaccgtaatatcttcggcaatatactagcctgctggatcatgctcttattagtagatactgtggacttatctgac

SEQ ID NO: 24548 - protein, 496 aa, Panicum virgatum
  misc_feature: Ceres CLONE 1859311
  misc_feature (43)..(91): Pfam Name: F-box Pfam Description: F-box domain
  misc_feature (410)..(456): Pfam Name: FBD Pfam Description: FBD
MARANQRSCTRCHRDLPTCSCGGVGPARRSARLCRGRDPGGADRISALPDDLLLQILNRLGCAAAAARTGLLSRRWRGLWTRLPDLVLREMNPGSLHAALARLVAAFELEPRARPRLLNIRAPSYRMFSPAQIASLLNAAAMLQPENLTVAVAAAVLVMLPSLDGTRSMTLDVQGVSLITPQFGDMPDLESLSLHRYDAVPFSLLRRCSALRSLSISYWRLDSITIDLPLLEELVLSPTAQLRRVVIKAPRLKKLTFGAIEGVLDDFSLCYMASEVEHLSWQCASGASHVHFGDIWSLMTVTMKTSEPQGQLQRCPTSNTLSLNIFEWQFDQEEGAALSFDFEHYISSCCPIANISALELCINSSGHVYGALVLHLLEVYTLIKRLKVDLCKFQERRECSANCPCIQLNNWSNQTVSLTHLNEMEIKGVRGEDHEIDILKVILRSAARLEKVTITFKTKSKQHIRHFSNKLQRILKAHPYVKCGIYRCSGEEVVFA

SEQ ID NO: 24549 - DNA, 693 bp, Panicum virgatum
  misc_feature: Ceres CLONE 1859330
  misc_feature: Encodes the peptide sequence at SEQ ID NO. 24550
agtctcctcccccgcgcctccccggctcctccccacgatgggaaaacgcgggcggctagcggcggccgtggcgccgcccgcgctcgtgccactccccgtcgtcctcgccgccttccttctctccgtcgcgaccccagcgctgggtcggagcccatcatgccctgcgggttggcaaatcagccctgttcagaacaaatgcttcatgtacatatcggcctccctttcttgggagagatctgaggctctctgccgtaaccgcactggacatctggctgctttatcatctgttcaggagctaaacttcacaaagtctctctgcggatcaacctcaggatgctgggttggagggtatcataacactagtactggtagtggttggaaatggtccggtgattcatctgttggggatgagtccctcttccctgttgagatgttgcatgcaaactgcagtggtactgcatgcggtgtagccaccactaatgatttgtgcgctttggtgaccaatagtcgtgcttcacttgctggaaaaaggtgcagtgagtcccatggtctgatttgtatgatggatcatgtaaacagatgctaccatgatcactgccacaaggaatatttcatagccctcattgctgtgagtggtttcattctggcaaccactttagccgttgtggtttggctgcttgtctacaggcgaag

SEQ ID NO: 24550 - protein, 218 aa, Panicum virgatum
  misc_feature: Ceres CLONE 1859330
  misc_feature (60)..(176): Pfam Name: Lectin_C Pfam Description: Lectin C-type domain
  misc_feature: SWISSPROT Homolog: EC 3.4.21.84 Limulus clotting factor C
MGKRGRLAAAVAPPALVPLPVVLAAFLLSVATPALGRSPSCPAGWQISPVQNKCFMYISASLSWERSEALCRNRTGHLAALSSVQELNFTKSLCGSTSGCWVGGYHNTSTGSGWKWSGDSSVGDESLFPVEMLHANCSGTACGVATTNDLCALVTNSRASLAGKRCSESHGLICMMDHVNRCYHDHCHKEYFIALIAVSGFILATTLAVVVWLLVYRR

SEQ ID NO: 24551 - DNA, 1175 bp, Panicum virgatum
  misc_feature: Ceres CLONE 1859362
  misc_feature: Encodes the peptide sequence at SEQ ID NO. 24552
gactcggggaatggataatggaagaaacagaaggcaaaccgagcaagtcagaggatccccgcgcctctgcggccccgagatctccgcctataaaagccgccccaccccgcactcgcccaccagctgctctccaccaagagctgctgctaccaccaaaccggtcgccggattcgtccggagctttgcccgtttcgcggacccagatctactccgcggcgccggcgcgtccccgctgagatggcgatcacggtgaggcggtcgacgatggtgcgcccggcgcgggagacgccgcggcagcggctgtggaactccaacctcgacctcgtggtgccgcgcttccacacgcccagcgtctacttctaccgccgcggcggccccgaggtggaggggttcttcgacggcgagcggatgtggcgcgcgctggcggaggcgctcgtgccgttctacccgatggcggggcgcctcgcgcgggacgaggacggcagggtcgagatcgactgcaacggcgaaggggtgctcttcgtcgaggccgacgcgcccaacgccgccgtcgacgactacggcgacttcgcgcccaccatggagctcaagcgcctaatcccggcggtcgattacaccgatgacatctcgtccttcccgctcctcgtgctccaggtgacttacttcaaatgtggaggcgtctcccttggtgttggcatgcaacaccatgtagcggatggcatgtccggcttgcacttcattaactcatggtctgacctctgccgtggagctcaaatttctgtcatgcccttcattgaccgcactctccttcgcgctcatgatccaccgactccatctttccaacatattgagtaccagcctgccccagctatgttgtcctccacacctcagtccctcacctccaagtcaaagccacctgccaccgctgtagacattttcaagctcactcgctcagaccttggccgtctgcgctcacagcttcccacaggtgaaggtgcaccacggttcaacacatatgcagtgttagctgcacatgtctggaaatgtgtctcccttgcacgcagcctgcctcctgaacagcccaccaagttatattgtgccactgatgggcgacaacggctccaacccccacttccagatggttacttcggcaatgtcatcttccctgcaacacc

SEQ ID NO: 24552 - protein, 312 aa, Panicum virgatum
  misc_feature: Ceres CLONE 1859362
  misc_feature (1)..(312): Pfam Name: Transferase Pfam Description: Transferase family
  misc_feature: SWISSPROT Homolog: EC 2.3.1.144 Anthranilate N-benzoyltransferase
  misc_feature: Useful for making plants with altered cell wall content and/or composition
  misc_feature: Useful for making plants with altered lignin content
MAITVRRSTMVRPARETPRQRLWNSNLDLVVPRFHTPSVYFYRRGGPEVEGFFDGERMWRALAEALVPFYPMAGRLARDEDGRVEIDCNGEGVLFVEADAPNAAVDDYGDFAPTMELKRLIPAVDYTDDISSFPLLVLQVTYFKCGGVSLGVGMQHHVADGMSGLHFINSWSDLCRGAQISVMPFIDRTLLRAHDPPTPSFQHIEYQPAPAMLSSTPQSLTSKSKPPATAVDIFKLTRSDLGRLRSQLPTGEGAPRFNTYAVLAAHVWKCVSLARSLPPEQPTKLYCATDGRQRLQPPLPDGYFGNVIFPAT

SEQ ID NO: 24553 - DNA, 670 bp, Panicum virgatum
  misc_feature: Ceres CLONE 1859373
  misc_feature: Encodes the peptide sequence at SEQ ID NO. 24554
aagaatagcaccctctcctccggctcttcttccccaccaccaccacctcctcctcccgaccaccgcgtcgcagcaatggcgggcaacggcctgatcgtggagaacagacccgcgacgcgtccggcgtcgccgtcgagctcgacgaggaggcccgcccccgcgtcaaggccagcagcgagtggatcctcgactgcatcgcccacggcggcgacatctacggcgtccccaccggcttcggcggcacctcgcaccgccgcaccaaggacgggcccgcgctccaggtcgagctgctcaggcatctcaacgccggcatcttcggcaacgaccgccacggccacacgctgccgtcggagacggtccgcgcggcgatgctcgtgcgcatcaccaccctcctccagggctactccggcatccgcttcgagatcctcgaggccctcgccaagctgctcaacaccggcgtcggcccgtgcctgccgctccggggcaccatcaccgcctcgggcgacctcgtgccgctctcctacatcgccggcctcatcacgggccgccccaacgcgcaggccgtcaccgccgacggcaggaaggtggacgccgccgaggccttcaagctcgcctgcatcgagggcgggttcttccgcctcaaccccaaggaagggctcgccatcgtcaa

SEQ ID NO: 24554 - protein, 100 aa, Panicum virgatum
  misc_feature: Ceres CLONE 1859373
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MLVRITTLLQGYSGIRFEILEALAKLLNTGVGPCLPLRGTITASGDLVPLSYIAGLITGRPNAQAVTADGRKVDAAEAFKLACIEGGFFRLNPKEGLAIV

SEQ ID NO: 24555 - DNA, 709 bp, Panicum virgatum
  misc_feature: Ceres CLONE 1859388
  misc_feature: Encodes the peptide sequence at SEQ ID NO. 24556
cacatccatatgcttagctcccagccccgcacccatgggcgcctgcttctcctccgcctccgctgcccccgccggcgccgccgagcgccgcccctccaaggagggcgagaagaggcgccgcggcggcgcgtctcccgaaggcgcggcaaaggcggcggcccccgtgcgggcagagttcggctacgagagggacttcgaggcgcgctacgaggtcggccgcctgctcggccacggccagttcggctacaccttcgccgccaccgaccgccagtccggggaccgcgtcgccgtcaagcgcatcgacaaggccaagatgacccgtcctgttgctgtggaggatgtgaaaagagaagtgaagattcttaaagcacttaaaggacatgagaatattgttcacttctataatgcatttgaagatgattcatacgtgtatattgtcatggaactatgtgagggtggtgagctattggaccggattttggcaaaaaaaaatagccgttacagtgagaaagatgctgcagtgatagtgcgccaaatgcttaaagtagctgctgagtgtcatctgcgtgggctagttcaccgagatatgaagcctgagaacttccttctcaaatcaaataaggaggactcaccactaaaggcaacagattttggtttgtcagacttcataaaaaccagggaggaagttccatgatattgttggcagtgc

SEQ ID NO: 24556 - protein, 219 aa, Panicum virgatum
  misc_feature: Ceres CLONE 1859388
  misc_feature (58)..(218): Pfam Name: Pkinase Pfam Description: Protein kinase domain
  misc_feature: SWISSPROT Homolog: EC 2.7.11.1 Non-specific serine/threonine protein kinase
MGACFSSASAAPAGAAERRPSKEGEKRRRGGASPEGAAKAAAPVRAEFGYERDFEARYEVGRLLGHGQFGYTFAATDRQSGDRVAVKRIDKAKMTRPVAVEDVKREVKILKALKGHENIVHFYNAFEDDSYVYIVMELCEGGELLDRILAKKNSRYSEKDAAVIVRQMLKVAAECHLRGLVHRDMKPENFLLKSNKEDSPLKATDFGLSDFIKTREEVP

SEQ ID NO: 24557 - DNA, 718 bp, Panicum virgatum
  misc_feature: Ceres CLONE 1859389
  misc_feature: Encodes the peptide sequence at SEQ ID NO. 24558
gcacccgctacccatctctcctccagtcccctcccctcgcctcgcattgcgggcttgcggccgccacccggtcgagtgtgaggctacatagctagctgcgcgtacgctcgccggcgccgcccgttcctgccgtgcgcctgctccggtaaatgactggaggccttcccggcgtcgtcgaggtcgtggtgctggctccgctcttgttcgtggcgtgcctgtcgtccccgtcgccggagccgtcgtcgtcgttgcgcgctagcaccggagggttcatcaacgaaggctaaatcttgctggcaatacgatctttcaacttctccttacagcaagactgaagaaattcctgaacaagctgcggagaacagattaagcaagcaaggctgatagtgaagtttcagaaagctcattgaacgacgtgatggatcccaccactgttgagtcgaaatgggtgtctcccaccactgaagatgggtcaatggacaggagaggaaacccagctgccaaagcagcatctggaagatggagatctgccatcctgctgctcgccaactacgggctcgtgacgtgcgccttcttcggcgtcggtgtgaacctggtggtgttcctgcggcgggtgctccaccaggacaacgccgaggcggccaacaacatcagcaagtggaccggcaccgtctacatcttctcgctcatcggcgcctttctcagcgactcctactgg

SEQ ID NO: 24558 - protein, 99 aa, Panicum virgatum
  misc_feature: Ceres CLONE 1859389
  misc_feature: Useful for making plants with altered carbon content
  misc_feature: Useful for making plants with altered nitrogen content
MDPTTVESKWVSPTTEDGSMDRRGNPAAKAASGRWRSAILLLANYGLVTCAFFGVGVNLVVFLRRVLHQDNAEAANNISKWTGTVYIFSLIGAFLSDSY

SEQ ID NO: 24559 - DNA, 696 bp, Panicum virgatum
  misc_feature: Ceres CLONE 1859408
  misc_feature: Encodes the peptide sequence at SEQ ID NO. 24560
gagccgcagccgacgccttttcagtttctcctctcctcttccctggcggcttcttcttcttcggcctcctcggctcctcgtcgcaacgcctcttctccgtctcgtcgtcgtctcgagcggccgccgtcgcgtcaagggttcgaggttcgagagctgagttgggaggaggactgccgccgcagccatgaaggcgctcattctcgtcggaggcttcggcacccgcctgcggccgctcacgctcagcgtgcccaagccgctcgtcgacttcggcaacaagcccatgatcctgcatcaggtcagcacgaatgcgccgtctctgcgatcattttcggttgtttaagtcattaggaaatggtgccaagagaagtcgatttcggcaacaaccccatgattgaccagcctgagctgttataagcctccgtgtcatgctttgattgggtggatccatgtgagtgaattcctcacagaaatactgaaatagtcgtccacctataccactgttcttggtggcaaataattgctgaagaacaataatgatggcttttggtatatgatttgatcatttgaagtaaccaaaaagcaagcaaaatcactttcaggcctactgttgctggattgatacggtatttggttgaatttactgaatgctatgatacacagatcgaagctctgaaggaagttggggtcacagaggtc

SEQ ID NO: 24560 - protein, 51 aa, Panicum virgatum
  misc_feature: Ceres CLONE 1859408
  misc_feature: SWISSPROT Homolog: EC 2.7.7.13 Mannose-1-phosphate guanylyltransferase
MKALILVGGFGTRLRPLTLSVPKPLVDFGNKPMILHQVSTNAPSLRSFSVV

SEQ ID NO: 24561 - DNA, 765 bp, Panicum virgatum
  misc_feature: Ceres CLONE 1859410-R
  misc_feature: Encodes the peptide sequence at SEQ ID NO. 24562
ttgcttaagcctcttaaatacttggacgggcagagggaacgaagtttgggatccatcatcatcaagtattctccaagtactagtttcacttcagggattggttctcaatgaaaagccctattttaatgaggctgggtatgagaagcaagttggtactgttgaaggggagaagaatgcagtgccctataatgagaacacgtacttgctgagcttgaaatccatgctatatatcatgagacgacctcctatgcattttgaggattttgtgaagagccatttccggaagcgtggccactacatccttaaagcttgcgaggcctatttgcaagggaatgtggttggcacgctcactgacgatgcctgcaccaccgacagaagcaaggagcactctagctctgttggcttcaagctcgcattggcaaagattttaccacggttcattgcagccctgaaggaaactggagccgactgtgaccaatacgagcaccttgggaaaacagaaactgttagagatagctgatctcacgcatagcgccatagaggcttctacttgtttttttttcttttctttttttcttttttggtttcagaaagatggcgtccccactctccaccacccactgggtctgtttccgtataaatgtacattcaacatttgtttaaatttgtacatttggaaaatgtagctccaaatgagttattcagtacgtgggactgagctaccctgtacagttgatgtttttgttaagcttacagggttctttc

SEQ ID NO: 24562 - protein, 172 aa, Panicum virgatum
  misc_feature: Ceres CLONE 1859410-R
  misc_feature: SWISSPROT Homolog: EC 6.3.2.19 Ubiquitin--protein ligase
CLSLLNTWTGRGNEVWDPSSSSILQVLVSLQGLVLNEKPYFNEAGYEKQVGTVEGEKNAVPYNENTYLLSLKSMLYIMRRPPMHFEDFVKSHFRKRGHYILKACEAYLQGNVVGTLTDDACTTDRSKEHSSSVGFKLALAKILPRFIAALKETGADCDQYEHLGKTETVRDS

SEQ ID NO: 24563 - DNA, 626 bp, Panicum virgatum
  misc_feature: Ceres CLONE 1859410
atctctcgttccgttgcccaagcctggtagggttcgatctccctctcgcccactctgcgccgtcgttgttcccgccgccccttcacgccgtctgcctcccccctcctctccgcggcctgcagcggccagatcgagtcggggccggactattcctcgccggaaggggacgattcgcatcgggcatcacggattcaccgccaccgccgccgctcatctccaagatccgagggcggtcggagtggaggtgcccgtggttgacccgttggtgaggcgattattgggtcaggaacttctttctccacttccgaggacaggaggactacaacaggctgaggcctcttagctacagaggagtcctgatcttctaggtttgcttcaccccatacgctggcaccgtcgtctacagcatcgtgctccccgcctcgagctaggcactacaacctgcgtgcaagaaaaggaaaacacagagtcaaggtttgggaaggacaactaggagatagcaaaacagcatcgggggcataaccaatggcagatgaaggggcaagtgatgcttcaagtgattcaagcaacactttctgggatttggccacttgtgctgctgctgtggcagcatatgcggccgacaa

SEQ ID NO: 24564 - DNA, 692 bp, Panicum virgatum
  misc_feature: Ceres CLONE 1859412
  misc_feature: Encodes the peptide sequence at SEQ ID NO. 24565
attcgacccataagcttttgcgatccctcccactcccatcgccgcatcgcattctccgatccggagctctctgctcgcagccatggcgaagtgctacccgaccgtgagcgccgagtaccaggaggccgttgagaaggccaggcgcaagctccgcgccctcatcgccgataagagctgcgcccctctcatgctccgtctcgcgtggcactcggcggggacgttcgacgtgtcctctaagaccggcggccccttcggtacgatgaagaacccggcggagcaggcgcacggcgccaacgcgggtctggacatcgccgtgcggatgttcgagcccgtcaaggaggagttccccatcctctcctacgccgatctgtaccagcttgcgggagttgtggccgtggaggtgaccggtggacctgaggtccccttccaccccggtaggggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgc

SEQ ID NO: 24565 - protein, 131 aa, Panicum virgatum
  misc_feature: Ceres CLONE 1859412
  misc_feature: SWISSPROT Homolog: EC 1.11.1.11 L-ascorbate peroxidase
  misc_feature: Useful for making plants with modulated heat sensitivity
  misc_feature: Useful for making plants with modulated water use efficiency
  misc_feature: Useful for making plants with altered carbohydrate content
  misc_feature: Useful for making plants with altered cell wall content and/or composition
MAKCYPTVSAEYQEAVEKARRKLRALIADKSCAPLMLRLAWHSAGTFDVSSKTGGPFGTMKNPAEQAHGANAGLDIAVRMFEPVKEEFPILSYADLYQLAGVVAVEVTGGPEVPFHPGRGEFGWGGTSVKR

SEQ ID NO: 24566 - DNA, 680 bp, Panicum virgatum
  misc_feature: Ceres CLONE 1859414
  misc_feature: Encodes the peptide sequence at SEQ ID NO. 24567
aaccccgcctcctccttgacttcgccaccgtccttcctcgtcgtctcggtcttggaagcaagcaaggtagctgcacggaggcaaccgcgcagtaaggtgctcttggttctctgggatgatgaggcgcaggcagctcttgctggcgactgcctgcttgtgggctctgtcgtgcgccccgctgctccgtgcttccacccctgacggacttctcagggtcggcctgaacaagaacaagctcgacagccgccgcctgagggccaaggttgaaaggcagcacgacagccgccgcctgagggccgccggcgccgacgaggtccctctcatcgactacctcaacacccagtacttcggggtcgttggcatcggcacgccgccgcagaacttcaccgtcatcttcgacactgggagctccaacctctggatcccctcctccaaatgctatttctcgatagcatgttacttccaccacagatacaagtccggcaagtctagcacttacaaagctgatggtgaggcttgcgaaattacttatggctctggatcaatttccggattcttcagcaaggataacgtgctggttggagaccttgttgttaaaagccagaagttcattgagactactcgcgaacccagtttctcattcatccttgggaagtttgatggcattcttggtcttggat

SEQ ID NO: 24567 - protein, 188 aa, Panicum virgatum
  misc_feature: Ceres CLONE 1859414
  misc_feature (76)..(188): Pfam Name: Asp Pfam Description: Eukaryotic aspartyl protease
  misc_feature: SWISSPROT Homolog: EC 3.4.23.40 Phytepsin
MMRRRQLLLATACLWALSCAPLLRASTPDGLLRVGLNKNKLDSRRLRAKVERQHDSRRLRAAGADEVPLIDYLNTQYFGVVGIGTPPQNFTVIFDTGSSNLWIPSSKCYFSIACYFHHRYKSGKSSTYKADGEACEITYGSGSISGFFSKDNVLVGDLVVKSQKFIETTREPSFSFILGKFDGILGLG

SEQ ID NO: 24568 - DNA, 1974 bp, Panicum virgatum
  misc_feature: Ceres CLONE 1859418
  misc_feature: Encodes the peptide sequence at SEQ ID NO. 24569
acgcccaaaacctcgccgccgtcgggtcgaacaggagcaccgctcgctgtttcgcccacatccgtgcagatcggccacactattttcttccttgacgggcggcgatggcgcggcgctccaagaaaaggaacaggaggagagggagtccagaggccaagctcaccgacgacctcctcgtcgagatcctacgccgcctccccgccaagtccctctgcgcctgcaagtgcgtgtccacgcgctggcgcggcctcatctccgatccggaacaccgcaagaagctgccccagatgctcaccggcttcttctacatgagcttcaacaccgaccgctgcccggtggtagcccgccatttcaccaacgtcttgaggggagaaggcccttccatcagcccttccctgcgcttcctgcccttgcgctacctcaacatcttggattgctgcaatggcctcctcctctgccgcatcccgaagtccactggtccagcgacatttcagtacctcgtctgcaaccctgctactgagaaatggtttgtcctgcctgagtccacttggtcggccgatgtgccgattgcgcgcctggggttcgaaccggcggtctcctcccacttccatgtgtttgaatttgaggaagatgaggatggatatgtgaaagaagtgcagatttactcatcaaaggctggagcgtggagtcagaaagacagtggttggaacattggactcacaatttgtagcggttctagaagcatctttttcaacggtatgctgcatctcgttacctatgaggaggttgttgcggcagtggatgtggaggcgaagacttggaggattatccctatgccatacgatgacgaatattatcctttcactattgatgaagcgttcattgacctggctcaagggaatctttatttggcaactaatatttccgataatttgacaatctgggttcttgaggactatggcagtgaagagtctgaagactggaccttgaagcaccgtgtcagatacaggcggaagtttcaattggatgtcattaactccgataatggatgcggtctagtttcaatctacccagaaggcaatgcgattttctgtgttgacggggatgataaaatgctaatgtcatatcaaatggacagcaaacaaagcactttgcctgtagcacatgttcttggacatgattgccagggaccttatcttccatatgttcctaacttcttagaatcattggcagatgggcaatgaaaatctttgaacctctaatcgatgttcttgttgggtaacaataggagcagcagcaacatggctagatctttctgatggcgtgtgccataaaaaccttaatggtagagtactctgttttagcttgatttcatatgagtgcactttgttaagatcatgtaacctaacttcacatgtgcttgttatttctatgaatttagttactctacttctctttttccagcaataataggaattgctttaatattgtaatctgcatacgtagggtaacactaggtactttgccagctaaccatgttgctgttatcacaacctcacttcgattggcatcctgatacctgctgttcccatttgattgaacattcactatcatttatttctggctcatccaccaggttgctactaggcatatcaacagcccttctcttttctaccacaccaactggcgcaccttgcactctctttgccccttggtatatgagatagataggttcttatttacaaatatatatatggcagctggatgaaactatttctcaactctcaagtgaagaggggctactgcagataactggagtgaagttcaggacctaccactgcacttaagtttcatctgtgtggatctactagtttcaacagagataacatcagttttgtaaataattgcatttgtttcaatctataggttggcatgcccaatagggagatattgatgaatttgagtgttgatccg

SEQ ID NO: 24569 - protein, 379 aa, Panicum virgatum
  misc_feature: Ceres CLONE 1859418
  misc_feature (14)..(61): Pfam Name: F-box Pfam Description: F-box domain
MARRSKKRNRRRGSPEAKLTDDLLVEILRRLPAKSLCACKCVSTRWRGLISDPEHRKKLPQMLTGFFYMSFNTDRCPVVARHFTNVLRGEGPSISPSLRFLPLRYLNILDCCNGLLLCRIPKSTGPATFQYLVCNPATEKWFVLPESTWSADVPIARLGFEPAVSSHFHVFEFEEDEDGYVKEVQIYSSKAGAWSQKDSGWNIGLTICSGSRSIFFNGMLHLVTYEEVVAAVDVEAKTWRIIPMPYDDEYYPFTIDEAFIDLAQGNLYLATNISDNLTIWVLEDYGSEESEDWTLKHRVRYRRKFQLDVINSDNGCGLVSIYPEGNAIFCVDGDDKMLMSYQMDSKQSTLPVAHVLGHDCQGPYLPYVPNFLESLADGQ

SEQ ID NO: 24570 - DNA, 695 bp, Panicum virgatum
  misc_feature: Ceres CLONE 1859433
  misc_feature: Encodes the peptide sequence at SEQ ID NO. 24571
actaccaccaccaccgcgacgccaccaatccgcgcgcatccgcccgccatgcctcctccccgcctcctcctcctgctcctgccgccgctcctcctcgccctgcccgccgcgccgcagcccgcgccggcgccgcaggaggacgacctgcgctgcctccggggcgtcaagtccggcctccgcgaccccgacgggcgcctcgcctcctggaacttcgccaacacctccggcggcgccgtctgcagctacgacggcatcctgtgctggaacatgcaggagtcccgcgtcaactcgctcacgctctccgggttcggcctccagggcgccctcccctcctccctccagtactgccgcgccgccaccacgctcgacctctccgccaacgagctcgacggccagataccccccgcgctctgcgactggctccccttcgtcgtcaccctcgacctctcctccaacaagctcaccggccccatccccgcggagctcgccaactgccgcttcctcaactcgctcaagctcgccgggaaccagctctccggccagatcccggcctccctcgcgcgcctcgaccgactcaagtcgctcgacctctcggagaacaggctcgacggccagatcccgacccagctgggcgccaacttccccaaggactccttctctggcaactcgggcctctgcggccgccccgtctcctc

SEQ ID NO: 24571 - protein, 215 aa, Panicum virgatum
  misc_feature: Ceres CLONE 1859433
  misc_feature (29)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MPPPRLLLLLLPPLLLALPAAPQPAPAPQEDDLRCLRGVKSGLRDPDGRLASWNFANTSGGAVCSYDGILCWNMQESRVNSLTLSGFGLQGALPSSLQYCRAATTLDLSANELDGQIPPALCDWLPFVVTLDLSSNKLTGPIPAELANCRFLNSLKLAGNQLSGQIPASLARLDRLKSLDLSENRLDGQIPTQLGANFPKDSFSGNSGLCGRPVS

SEQ ID NO: 24572 - DNA, 573 bp, Panicum virgatum
  misc_feature: Ceres CLONE 1859445
  misc_feature: Encodes the peptide sequence at SEQ ID NO. 24573
agctagcctgaaccaaacgggcctcagctagcgcactcttctcccacacaccactccactccactcgcttcaaaacctcccaaacaagccacagccttccgagaaaagccaagaacacgcctccctcccctccaggcctccaccatggacaagattggcagcagcagcaggaggaacaagcggagaagccgccccatggccgccatcaccatgctcgtgctggccgccctcctcctctgctccgcgcccaccgtagcactcacccccgacggcgaggttctgctcgagctcaagctggccttcaacgccaccgcccagcgcctcaccagctggaggccctccgaccccaacccctgcgggtgggagggcatctcctgctccctccccgacctcagggtccaatccataaatctcccatacatgcagctcgggggcatcatttcacccagcatcgggaggctcgataagctgcagagactagctctgcaccagaacagcttgcacggcccaatccctgcagagatcaagaactgcacggagctcacggcaatttacctgagagctaactatctg

SEQ ID NO: 24573 - protein, 142 aa, Panicum virgatum
  misc_feature: Ceres CLONE 1859445
  misc_feature (39)..(79): Pfam Name: LRRNT_2 Pfam Description: Leucine rich repeat N-terminal domain
  misc_feature: SWISSPROT Homolog: EC 2.7.11.1 Non-specific serine/threonine protein kinase
MDKIGSSSRRNKRRSRPMAAITMLVLAALLLCSAPTVALTPDGEVLLELKLAFNATAQRLTSWRPSDPNPCGWEGISCSLPDLRVQSINLPYMQLGGIISPSIGRLDKLQRLALHQNSLHGPIPAEIKNCTELTAIYLRANY

SEQ ID NO: 24574 - DNA, 774 bp, Panicum virgatum
  misc_feature: Ceres CLONE 1859445-R
atcaaagctgaaactgaatatacagtcactcaagccatagctgctcaggaagcaaataagagaaacaacaactggctgccacctccatgggcacttgctgcgatggctatccttggattcaacgagtttatgacattactgaggaatccgctttacctgcttgtcatatttgtggtttatcttgttggaaaagccttttgggtgcagtcagaaattggcagagaattccaacacggatttcttcctgccatcctttcgctgtcaacaaaatttgttcccactataatgaacatcctgaagagattagcagatgagggtcaaagaccagcaggcccagagaggcaaagggagatggaactccaaccaaaatccacaaggaatggttcatacagcaacgtgacctcggcagggtcatccagcgtaaccacttctgagatcggacctgaatattcaagcccggtggcgcagtgatctagtggatctttagcttttggccgaagaccagccctagtagttgaggctgcaaaatggctcggagcctagagatgtggctgagcctaggagattcaggtgccttgcggtttttgtaagcttgcccctcccaaacagatgtacggtgatgaggtggccttggccaccgctgttatttaaagacttcgtttgggggtggggttgtttgtaagaacattgtggaataactttcatttcattttttggattctgtaacatgatatatgatggttgtatagatgattttccagtcgggccaggcgg

SEQ ID NO: 24575 - DNA, 1411 bp, Panicum virgatum
  misc_feature: Ceres CLONE 1859446
  misc_feature: Encodes the peptide sequence at SEQ ID NO. 24576
gcggacgctggcgcggcgcggggtgaggcggacgcgcgccgggctcatggcagctaccgccccgccgcttccctgcacgcaactgcctcgcgccccgcctcttctttaagtcaagccccccgtgtgcctccctccgcggcgccgcgacgatcccctcccactcgcagtcgcagaccaacggcgacggtactaggtactagcaagtgccggtcccacatgcctctcgctgcggccgccgtcgccgccgtcgcctgcccctccccggtcggcctcggccgccccttgtgccgtgtctacgcccatccgcgccgccggcgggggttccggttggaggccagctcatcggcacccgcgcccgcgccggctgcggcggatgagggggctggagcggggccgtgccccgtggtcaggttcgacatggacgacttcgccgtcgctgaccgcgtcagcgtcgggctccatggacggtcggatgagatgatcttcgaggccacggtgcgcgatccgagcagcgagctgtatgggtcaacggtggtgctgcggcagctgaagagctcgcaggcgaagcgcaggggccggcgcgcgcttgaggtactgacgaagctggctcgccgccagatgatgtaccattcgtacgcactgcaggtccatggttacatcgctccgggcaatgccgtggagcaggaagatgtccctttcgtactggtgcatgggtatcatgggagttattccctgcgtcactggttgcaactctcggattggctcccaaccttagaagcaacattagcattggatgaagaacaagttaggagggttggagatgactctgttggaggaccagctgtatctcgacaactacgtttaattaggattttgatgagagaccttttgattggtgtaaattatctacatagccatgggttggcacatactgagctgagattagagaatgttcacgtgagcccaatagacaagcatgttaaggttggtattcttggaaatgctgctgattttcatgacaatgatcctagcagtagcacagtagcaagtaacaatgaaaggcggaaaatgatgatagcatttgacatgagatgtgttggcttcatcatggcaaagatggttttaagagagctaatggattcttcaactttctttaaattcaaatcgttcctgacaaagggaaatgatccatcctgtttgcgtgagttccttctaccaattctgtgccaaaattctccatctgggaatattggtttgcagatgctagataggcaatggggtgctggttggaatcttttggccttattgctggcaacaaaacctgagaaaaggataagttgccttgatgcattgcggcaccccttcctctgtggaccaaaatggcgtataaatccatcaactagtatcattc

SEQ ID NO: 24576 - protein, 398 aa, Panicum virgatum
  misc_feature: Ceres CLONE 1859446
  misc_feature (91)..(384): Pfam Name: Pkinase Pfam Description: Protein kinase domain
MPLAAAAVAAVACPSPVGLGRPLCRVYAHPRRRRGFRLEASSSAPAPAPAAADEGAGAGPCPVVRFDMDDFAVADRVSVGLHGRSDEMIFEATVRDPSSELYGSTVVLRQLKSSQAKRRGRRALEVLTKLARRQMMYHSYALQVHGYIAPGNAVEQEDVPFVLVHGYHGSYSLRHWLQLSDWLPTLEATLALDEEQVRRVGDDSVGGPAVSRQLRLIRILMRDLLIGVNYLHSHGLAHTELRLENVHVSPIDKHVKVGILGNAADFHDNDPSSSTVASNNERRKMMIAFDMRCVGFIMAKMVLRELMDSSTFFKFKSFLTKGNDPSCLREFLLPILCQNSPSGNIGLQMLDRQWGAGWNLLALLLATKPEKRISCLDALRHPFLCGPKWRINPSTSII

SEQ ID NO: 24577 - DNA, 697 bp, Panicum virgatum
  misc_feature: Ceres CLONE 1859446-R
ccctcacagttagttcagagtccgctgatccagtcttctctcttatgtcggatatggtttcagaattatgccagaatctaattggcctcatgacaaatctggcaccgaaggagttttgtctgtcacaacatcagcaaggatagctgctgggaggatttatattaatgaacaggacagtaaagagagtagggccgcatcttctagatcttctaggagatatcttcgcggtaaatggagaaaagcttcaaagatgaaggagctgccagctagtctccccagtgtaaacattgccatggatgaagtcaacgtatcgatgagctgcaacttgactttgaatgtcaactctgcacaaaaagtgctgcaagagatccgcacgcagaccccaccggaaatgttcgatttgtcaaagattgtctgcgggacatacatcgatgcgaggttgatggttcttcgtggtgtcaacgggtcggctctgcttttcattagatcgaatccaatgaccaattcctgaggagaatcggttcgccatgtaatgtgtattctctctgtacattctgtattcctagctgcgcattcatttgtagcaggtgtggataagatgctgtaggccattgttagattgttatatatcttcagcttgattaaaagctactaccctttggcttttttaatttaagggcaggagcactgccatatc

SEQ ID NO: 24578 - DNA, 1373 bp, Panicum virgatum
  misc_feature: Ceres CLONE 1859448
  misc_feature: Encodes the peptide sequence at SEQ ID NO. 24579
catggtgtaactgttgaaccatcgcacggtcgcagccaacaacaccaccactggcaaacgctcgagcaaaccgctctcggcacacaccaccacggtgccgccaacacaacgcagtgcaggttgaccaaatgtcgccggagcctccgcacggatggtgcagccgccgccaccgcgtcacggcacacacgccgcggccggcgtcgccgccgcgcactgaacgccagtgccgccggcgccgccgcgcaccggacgccggtgccgccagcgccgccgaccccaaacagccgcgggagccgccgccgccgctccacgatgcgggcaggccccgaaaggagccaccaccgctgcttcacaggccgcggccggcgtcgccaccgcgccccgccacgcgggcaccgccgcccccgccccccttcgcgccgaggcccgaggaggaagatccggcggtgaagggcacggatccggcggcgtagggcgcggatccggccgcccgggaggcggaaccggccgcggagcgccggagccggccaccaccgccatggacgccgagctaccaagagaggacgagggggagggaaggaggagccccgccgccttccttgcagccgcacgggcttccggcgaccgctcaggcggcggcgagacgggcaggggcgcggcctgggggggcggcggcgctcgggctggttccgcccgagccgccccaggggagcgatgcggacgggaggaagcgttttgttttcccgaattggatattgcaattgtgaaggcaaccaaccatgtagaatgccctcccaaggaacggcatgtcagaaaaatattcatcgcaacctcagcaaatcgccctcgcgcagacttcacatactgcatatatgcattgtcaagaagaatgtccaagacaaagaactggatagttaaattgaagacattaatagtggtacataggcttctgagagaaggtgatcccacattcaaagaagagttcctggcctacacatgcaggggaaacattttgcatatggcaaatttcaaggatgactctagccaattagcctgggattgctccgcatgggttcgcacctatgcgctattcctggaggaacggcttgagtgctttagggttctcaaatacgacatcgaaactgagcgcctcatgaaatcgccccagtgttctaccaagggacatagtaaaaccaggaccctaccttgcccagatcttttggagcagttgcctgcactgcagcagctgcttttcagggttgttggagtccagccggaaggttctgcctggtcaaactacctcattcagtacgcactagccctggttgtgaaggagagctttcaagatctactgtgcaattaatgatggcatc

SEQ ID NO: 24579 - protein, 274 aa, Panicum virgatum
  misc_feature: Ceres CLONE 1859448
  misc_feature (68)..(272): Pfam Name: ANTH Pfam Description: ANTH domain
MDAELPREDEGEGRRSPAAFLAAARASGDRSGGGETGRGAAWGGGGARAGSARAAPGERCGREEAFCFPELDIAIVKATNHVECPPKERHVRKIFIATSANRPRADFTYCIYALSRRMSKTKNWIVKLKTLIVVHRLLREGDPTFKEEFLAYTCRGNILHMANFKDDSSQLAWDCSAWVRTYALFLEERLECFRVLKYDIETERLMKSPQCSTKGHSKTRTLPCPDLLEQLPALQQLLFRVVGVQPEGSAWSNYLIQYALALVVKESFQDLLCN

SEQ ID NO: 24580 - DNA, 650 bp, Panicum virgatum
  misc_feature: Ceres CLONE 1859448-R
gatggaagctcatcggggtgggagttggcacttgtcaccgctccaagcaccaatataagccagccagttaagaccaacttggctggaggctttgacaagctgttactcgacagcctctacgaagacgaggcaaggaggcagcagatcgccagtgtgacctacgctggcagccttggaacagccaaccctttcgacgccaatgccaatggcccgttcgccatgtccagcagcttcgcaccaccatctaatgtgcagttggcactgatgaaccagcagcaacagcagtactaccaggtgcagcagcagtatttccagccacagcagcatcagtattttcagcagcaacaacagataatggcgatgccgacaccaaacatgtaccaccaccaatatcagtatgctgcgcctccctccagagctccaaatccatttggtgatcctttcagcgaccttgtagcggtgggtgctcctggaaaacagggcaactcaagctttgtctgaactggttgctacttctgaccattctaacttgagtagagcagcaaacctgtacagcatgagttcctctgctgagtgaagatgttgtatattaatgctttcttttgcaatatccacattttcgaagataacatgattggtaccagttctat

SEQ ID NO: 24581 - DNA, 478 bp, Panicum virgatum
  misc_feature: Ceres CLONE 1859465
  misc_feature: Encodes the peptide sequence at SEQ ID NO. 24582
actctttattataccacaccgactggggtcatcgccacggcactccacgagtcatcccagcccgcgtcgtggtggaggtggtctggcagctagcaccgcctaccctctagcagatcacgagagatggccacggtgacctacctctccttctcggcgccgccgacgcctcgcgcccgccggcctgagggggggacggcgacgctcgcgccggcgaccccgacggccctggcgcccgagagggggggccagagccgggcccggccggtctcggcggagcggtccgaccacgccgatggcgtcgtgagcttcctcctgatgtacctcgcccactccggcggcgtggaggggatccgcgagttcctcgacggccgcgcccacccccacttctccgactccgacggccgcacggtgctgcacatcgcctcctgcgagggatacgccgaggtcgtcgagctcctcctccagcgcggcgcggagg

SEQ ID NO: 24582 - protein, 118 aa, Panicum virgatum
  misc_feature: Ceres CLONE 1859465
  misc_feature: SWISSPROT Homolog: EC 3.5.1.2 Glutaminase
MATVTYLSFSAPPTPRARRPEGGTATLAPATPTALAPERGGQSRARPVSAERSDHADGVVSFLLMYLAHSGGVEGIREFLDGRAHPHFSDSDGRTVLHIASCEGYAEVVELLLQRGAE

SEQ ID NO: 24583 - DNA, 710 bp, Panicum virgatum
  misc_feature: Ceres CLONE 1859469
  misc_feature: Encodes the peptide sequence at SEQ ID NO. 24584
ctacctactgagtttcttcgggatcgcgttcgtccagtccgtcgtctccaacagcgacgacgaggaggactacctcatcgacgcccgccacgagccgtcgccggccccggccccggccccgtgcgcgctgctggggaaccccgccgccgcgccggagaaaatgccggaggaggacgaggagatcgtggccgcggtcgtggccgggaagatcccgtcctacgtgctggagaccagcctgggggactgccgccgcgccgccgggatccggcgggaggcgctgcggcggatcacggggagggacatggacggcctcccgctcgacgggttcgactacgcgtccatcctcggccagtgctgcgagctgccggtgggctacgtgcagctgcccgtgggcgtcgctggcccgctcctgctcgacggccgccgcctctacgtccccatggcgaccaccgagggctgcctcgtcgccagcaccaaccgagggttcaaggccattgccgaatccggcggcgcctccagcgtcgtgctcaaggacgggatgacgcgagcaccggccgtccggttcccgtctgcccgccgcgccgctgagctcaagggattcttggagaatcccgccaacttcgacaccctggctacagtgtttaacaggtcgagcagatttggcagactgcaggggagtgaagtgcgcgatggcagggaagaacctttac

SEQ ID NO: 24584 - protein, 236 aa, Panicum virgatum
  misc_feature: Ceres CLONE 1859469
  misc_feature (69)..(235): Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
YLLSFFGIAFVQSVVSNSDDEEDYLIDARHEPSPAPAPAPCALLGNPAAAPEKMPEEDEEIVAAVVAGKIPSYVLETSLGDCRRAAGIRREALRRITGRDMDGLPLDGFDYASILGQCCELPVGYVQLPVGVAGPLLLDGRRLYVPMATTEGCLVASTNRGFKAIAESGGASSVVLKDGMTRAPAVRFPSARRAAELKGFLENPANFDTLATVFNRSSRFGRLQGSEVRDGREEPL

SEQ ID NO: 24585 - DNA, 1407 bp, Panicum virgatum
  misc_feature: Ceres CLONE 1859476
  misc_feature: Encodes the peptide sequence at SEQ ID NO. 24586
actctctcctttgcacccctagtactgatcctcctccccgcgctcttcggtttgcttctcttttcttctatctcctttcactcgtttcgaccttgtgttcttgccgaattgtgcctgatggccatatgcttgtttgatttacttggcagcgcagcaagacatagaagaatcccctactactagtactactactactcatgcatgagcaccgcctcctcgcgccgcatatgaatcagacatgaataggggccacagcagcagctcctcgaagctcatcaacgagaagcttgaggaacaccggatctccaccgccaagcactgcccccactgcggcgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgaccagggatggcctgagcaagcacttcttccaccggccatcaaaggcctatacgacgggcacgaggaagaggaggaagatacagacggagtgcgacgtccacaagggcgagacgaggtggcacaagaccggaaagacgcggccggtaatggtgaacggccggcagaaggggtgcaagaagattctggtgctgtacaccaacttcggcaagcaccgcaagccggagaagacgaactgggtgatgcaccagtaccacctcggcgacctcgaagaggagaaggagggggagctggtggtttgcaagatcttctaccagacccaacccaggcagtgcagctggtcttccgaacggggcgccgccgccgccgccatggcagcaacgacagtacaggagcagcgtaggagggatagcggcagcggaagctgctcttcaagggaccacgaggtatcgttcccggccggatacacggtcaccgcggccgtcgagatgcagcagcatatgaagcagcactccgcggaccatttcagcttcgcgcctttcaggaagactttcgatcaggaggttggtataggtggtgatcaggtgccatctaatcagcttggacgatcagaacagcatcatgccgtccaggagcagcagccacaccgtccggtgatcgcgaccatggccgtcccagccacggctttcctgatcagtaggccatcgaaccctgtttcgactattgtgccacctgcaatgcagcacacgtcagttgttctcgatcatgatcagttccatgtgccagcaatccttctacatcaccacgacaaatttcagcatcagcaccaacagcaacaaccacagcaaaagcttgaccgcaggtctgccgg

SEQ ID NO: 24586 - protein, 389 aa, Panicum virgatum
  misc_feature: Ceres CLONE 1859476
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
  misc_feature: Useful for making plants with altered carbohydrate content
MNRGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLEEEKEGELVVCKIFYQTQPRQCSWSSERGAAAAAMAATTVQEQRRRDSGSGSCSSRDHEVSFPAGYTVTAAVEMQQHMKQHSADHFSFAPFRKTFDQEVGIGGDQVPSNQLGRSEQHHAVQEQQPHRPVIATMAVPATAFLISRPSNPVSTIVPPAMQHTSVVLDHDQFHVPAILLHHHDKFQHQHQQQQPQQKLDRRSA

SEQ ID NO: 24587 - DNA, 543 bp, Panicum virgatum
  misc_feature: Ceres CLONE 1859476-R
cagtcccaagagacagaatggccttacccttactggccgcctgacaaccaagatcatcatggatagtatcaacaaggctgttaaatagtggcaatcaataccaaaactaaccacaccactttcaatgggttggtatttgtccccttgaatatactgggcgttgctttaatttcttggagaatgtactgccgaagataaagaaaacagatctatgcagatctctccctcaatgaaaagaagatgataaaattaattgttgtgaactcttcaaggcagaagatcagaaagcgtgaacaaaaagaaaagaggaaagatcgatgggaggataggaattgttgtgctgacatcaaaacggagcatagctggcctagacaatgcaacccgtattagtgcaatttaatcaagtataactacaatcaatccttcgtttatcactgttttttcatttgtattagctattttccaattgtaaaaagtagtattgtttgcatgtacattaacccagccccttctttggttactgaatctatacttatttccccc

SEQ ID NO: 24588 - DNA, 1919 bp, Panicum virgatum
  misc_feature: Ceres CLONE 1859498
  misc_feature: Encodes the peptide sequence at SEQ ID NO. 24589
gtcccgtaccttccgttcgctttctccccttcgcacgccgcctcgggccctccctcgtccccttccccctcccctccacctcctcccagatctcgtcgcgctcgccattcccccatccgctacgcgccgggcggaccccgtccagatcaggcgccgccgccgcaccccgcctcgtcgtgggcgccccctccctgtggtggactgccgcggggtggagaggagatccgccggggctggctggctggctggctctggattggtcggttggctggctggctggtcgagtgattcgttcgtttgctgattggtcgaggcgctaggaccgcccctggcgcggaggccgcacaggctcggcggcgccatcggcgagatgaagggcgcggccatccccgcggtcgcgatcatgccctcgccgctcttcctctggcggttcaaggccatattgtttctcctatggggcttatgttgttgcaagataggttgggactcagttatgagaatgagtgctgatctacgtgacttgttcctttatgaggctttcttgtactataatcctcttcttcttgtggctttgatgatttggttatggggagtaaatttatgggtctttgcgcaatcatctgtcaactatgctaaagtttttgatcttgcacagacacatttatctcaccgagagatatggaggtgtgctacttggctgactttaattgtccccacaagcatgacagcgtacctatatctgtactcacatggagaagtgtctcttgcagcatctcaaccagttctcttgtatgctatccttctgatgatccttttttccccttttgatatgttttacatatcatcaagattttactttctgaggacagtgtggcgtataatactgcctttacaagcaattacattccctgacttctttttggctgatatttttacatccatgtcaaaggtgttctcagatctggagcgttcagtttgtcgcatggtgaatcgccaggttgcgactattgcttggtttgaagcagattctatttgtggcagtcattccattgctattcctcttgctctcgtattcccctacttgtgccgtttcttccaatgtctccgacagtacaaggatactaaggagaagacatgtctcttgaatgccctcaagtactcaacagcagttccagtgatttttctttcggctctcaagtatcatgtatttcctgagcagtgggttagcttttaccgacccctctggcttatatctagtgttataaactcgctgtattccttctactgggatataaagcgagattgggatttgagcatcctaaccaggattttcatgttcaaaaacccaagcatatggactaaccttctttatgggcagaactgggtgttctactgggtactaggcagcaatttggttctgcgatgtacatggacatacaagctctcggcacatcttcgacacaactacctgacggtgttcgccatagccgcactggaaatactgagacggtggcagtgggtgtttttccgagttgagaacgagtggaacaagatgacagccaagcaaaacctggagatgtcatctgacattccctcggaaggagacaggctactggattctagtaataaccatacagtatgaattggtttctagctatattctacgatacagattcatcatcattcttttagtgtgaccattatagccaaattttacgtctaagattcagattttgtctgtagagcacaaaaggtcagggatacatgataggtttctttaaaaagattgaaattgttggcgaaacgtatgactgtaatcctcgtggggatatatatactgttgtaaccctcttgcatccaacaggaggtatttgttgacacatgaaagaataatagtaatgctgaatttttacgaactt

SEQ ID NO: 24589 - protein, 423 aa, Panicum virgatum
  misc_feature: Ceres CLONE 1859498
  misc_feature (221)..(393): Pfam Name: EXS Pfam Description: EXS family
MKGAAIPAVAIMPSPLFLWRFKAILFLLWGLCCCKIGWDSVMRMSADLRDLFLYEAFLYYNPLLLVALMIWLWGVNLWVFAQSSVNYAKVFDLAQTHLSHREIWRCATWLTLIVPTSMTAYLYLYSHGEVSLAASQPVLLYAILLMILFSPFDMFYISSRFYFLRTVWRIILPLQAITFPDFFLADIFTSMSKVFSDLERSVCRMVNRQVATIAWFEADSICGSHSIAIPLALVFPYLCRFFQCLRQYKDTKEKTCLLNALKYSTAVPVIFLSALKYHVFPEQWVSFYRPLWLISSVINSLYSFYWDIKRDWDLSILTRIFMFKNPSIWTNLLYGQNWVFYWVLGSNLVLRCTWTYKLSAHLRHNYLTVFAIAALEILRRWQWVFFRVENEWNKMTAKQNLEMSSDIPSEGDRLLDSSNNHTV

SEQ ID NO: 24590 - DNA, 2140 bp, Panicum virgatum
  misc_feature: Ceres CLONE 1859523
  misc_feature: Encodes the peptide sequence at SEQ ID NO. 24591
acagttcaccagggcgaaaggaaggcgacgcacgtttccggcggcgagttcgccgggcccttccgcctccggtggcctctttggctctggagatggaagggtcccgggaactcaacgcgcggatctgtatagagtaggtaggttagtatctagctctactgtgtgctcgtcgtcggtgacggcagcggagcttggggttccgggagcggcggcgtctgcgcggctccggcggaaaataaagctcttctcggggattcaaggtggtgtttcttccttcctcggtgaagtttccctgaggtctgtggacccattcttttggcttgccggcgagttgttgattctttcggttggcttgggtcaattgaaagaaacaaccacaaatcttgtgcggcttcttttcctgccgctgcttgttgctgtgggcgattccgcggcggtgaggatccggtggggcttccgtttgttcggttgtcctctccttccttcatcttctctgatttggatgttggggcgattctcctcgacggagtcgctggggctgcatttggatgcgattgggggcgtgccggcgagaggaaggaccagattgatgaatccgacagctgagttctcttcccaagcatctcttgcagctttccaatgtctggagtccgattatcgatctggatgggcaaggttggtggttcgtcgcgtcgtttgtgcagatcggcgaccggaggagcttcgtatccatgtccagagaaggaagatgaccagtagggtcctggttgtaattttttacttcctcagggtccttgatgtaaaagaaggatggctgaagccattcgtcaccatcttccacttggacacacccctggccctcgagagcaagtacgggggcttcctcagcgagaacatcatccaggactacgtggacttcgcggaggtgtgcttccgcgagttcggcgaccgcgtcaagttctggaccacgttcaacgagcccttttcatactcgacgcaggggtactccaatggcgccttcgcccccggccggtgctcgccattcatctcccggtcctgcaccccccgcgactccggccgcgagccctacatagtgacgcaccatatcctcctcgcccacgcccgggccgtggcgctgtaccgcgccaggtaccaggcggcgcagcgcgggcagatcggcatcacgcagccgtcgcactggttcgtgcccaacaccgacaccctcgccgaccggagggccgtgcagcgcagcctggacttcatgttcggctggtacctggaccccatcgtgcacggcgagtacccgggcaccatgaccagcttcctcggcgaccggctgccgaggttcacgccggagcagatgaggctggtcaagggctcctacgacttcatcggcgtcaactactacaccagctacttcacctcggcgaggcccgcgcccaacgggccgccgtcctacgatggcgacatccgggccaacatctccgggttccgcaacggcgtgcccgtcggccagccggagttcgtgcccgccttcttcaactccccggccggcctccgtgagctcctgctctacaccaaacgccggtacaacaaccccgtcatctacgtcaccgagaacggcatcgcagaggagaacagcgcgcgcatcccgctcaagaaggcgctcaaggacgggcaccggatcaagttccactcccagcacctgcagttcgtgaaccacgccatcagggacggcgtcaaggtcaagggctacttcacctggaccttcatggactgcttcgagtggggcgacggatacttcgaccgcttcggcctcatcttcatcgaccgcctcaacggcctcaagcgctaccgcaagcagtccagctactggatcgagggcttcctcaagagggagaagacgcatgatgatcatgagccgagcttcatcgccggctttgatcagctggtgctgcgttgtcgttgccgcgcccgagaataatggctgtgattgaggggccgggaattttaattttcggagagtgattgctgtgatgctgtctactgttgcctgtgttttgtttgctttctagttggtgtcgtcgctgagggcccagtgaggggaaataaagctcatggccgatctactttattacct

SEQ ID NO: 24591 - protein, 660 aa, Panicum virgatum
  misc_feature: Ceres CLONE 1859523
  misc_feature (199)..(635): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
QFTRAKGRRRTFPAASSPGPSASGGLFGSGDGRVPGTQRADLYRVGRLVSSSTVCSSSVTAAELGVPGAAASARLRRKIKLFSGIQGGVSSFLGEVSLRSVDPFFWLAGELLILSVGLGQLKETTTNLVRLLFLPLLVAVGDSAAVRIRWGFRLFGCPLLPSSSLIWMLGRFSSTESLGLHLDAIGGVPARGRTRLMNPTAEFSSQASLAAFQCLESDYRSGWARLVVRRVVCADRRPEELRIHVQRRKMTSRVLVVIFYFLRVLDVKEGWLKPFVTIFHLDTPLALESKYGGFLSENIIQDYVDFAEVCFREFGDRVKFWTTFNEPFSYSTQGYSNGAFAPGRCSPFISRSCTPRDSGREPYIVTHHILLAHARAVALYRARYQAAQRGQIGITQPSHWFVPNTDTLADRRAVQRSLDFMFGWYLDPIVHGEYPGTMTSFLGDRLPRFTPEQMRLVKGSYDFIGVNYYTSYFTSARPAPNGPPSYDGDIRANISGFRNGVPVGQPEFVPAFFNSPAGLRELLLYTKRRYNNPVIYVTENGIAEENSARIPLKKALKDGHRIKFHSQHLQFVNHAIRDGVKVKGYFTWTFMDCFEWGDGYFDRFGLIFIDRLNGLKRYRKQSSYWIEGFLKREKTHDDHEPSFIAGFDQLVLRCRCRARE

SEQ ID NO: 24592 - DNA, 1836 bp, Panicum virgatum
  misc_feature: Ceres CLONE 1859533
  misc_feature: Encodes the peptide sequence at SEQ ID NO. 24593
attgctgccgcgcccgctgatccgccgcctgcctgccgcccccgctgcttcgttcccctccctcctcggcctccgccaaagccagcatcctgaatcggagaagcgagagcagggatttctgggattttacctcccctgaatcggctcgatgggctcgctggtctcctgcatgtccgatccttgcccgtcggcgtccccgccgccgcaggcgaagcggcgctcctccacctcctcccgcggccgtggcggcggcggcggaggcggcggcggcggcggcggcgggagggactccgccaaggccaccatggccatcgacgaggaggcgttggccgccgccgcggcgctcgtgctggggcagcggggcgccgtgggggcgttcgagcggtccgcgtcggtgcgctgcgcggccaagcgccagggccagggcccgccgctgccccggagcagcagcacgcgcccgaggtcgctcgccgaccccgagctccagccgcagcacctgctcgccaaggatttgaatactaaggatttggaaacaaacatcattgttctcgttcatggtggtggctttggtgcttggtgttggtacaagactatatcacttcttgaagatagtgggttcaaagttaatgccattgacttaacgggctcagggattcactcttatgacacaaacaagattagcagtctttcagagtattctgaaccacttacatcttaccttaaaggcttaggtgatgctcaaaagtctgatcaggttcagaagctttgcccgccgcacgatcccaattgccagatgaagacccgcctgcggattcattcttcttggaagaagcattatatgatccagatccctgccaatctgtaacaccccgggtgttaatcacctataattaaggtgattttggttggacatgattttggtggtgcatgtatatcctacgcaatggagatgttcccgtccaaagttgccaaggctgttttcctctgcgcagcaatgctgacaaatagacacagtgcccttggcatgttccaacagcagatggacacaaatggcactctccaaaaggcacaggaattcatatactccaacggcaaggaccggcctccaaccgccatcaacatcgacaaggcactgctgagagacttgttattcaaccagagcccttccaaggatgtgtcgctggcctcagtgtcgatgaggcccatccccttcgcccctctgctggaaaagctcgtgctaaccgctgagaactacggctcggtgcggcggttctacgtggagaccacggaggacaacgccattcccctccctctacagcagagcatgtgtggcaccaacccgccggagaaggtgctgcgtctgaagggggcagaccacgcgcctttcttctccgaaccacaggcgctgcacaagacactggtcgagatagccaccatgcctccggtccaggcgtcttgagatcacgttttcatagcttcaggttttgccggcaggtgagcgtgcatggctggtgtacatgctgaggatgtaaggatgttgtcagaggtgcggcggcatagcagggctatagaatctctcaccgtcatttctgaagatgcatgtggcatccttcggttgtggactgacatggtgacatcttgatcttcggggcaactatcactactgaatcccgtctagaaaaagtttggaaaggtgaaatttcacgagatttctgtgatgcttcagcttatgtgaaatttcacatttcagatatagggccttgaccacttcagtatgtgtaactctacaacagccaaaaaggaaaatgatagtaaagaaacatctttttttttctc

SEQ ID NO: 24593 - protein, 238 aa, Panicum virgatum
  misc_feature: Ceres CLONE 1859533
  misc_feature: SWISSPROT Homolog: EC 3.1.1.78 Polyneuridine-aldehyde esterase
MGSLVSCMSDPCPSASPPPQAKRRSSTSSRGRGGGGGGGGGGGGGRDSAKATMAIDEEALAAAAALVLGQRGAVGAFERSASVRCAAKRQGQGPPLPRSSSTRPRSLADPELQPQHLLAKDLNTKDLETNIIVLVHGGGFGAWCWYKTISLLEDSGFKVNAIDLTGSGIHSYDTNKISSLSEYSEPLTSYLKGLGDAQKSDQVQKLCPPHDPNCQMKTRLRIHSSWKKHYMIQIPANL

SEQ ID NO: 24594 - DNA, 684 bp, Panicum virgatum
  misc_feature: Ceres CLONE 1859549
  misc_feature: Encodes the peptide sequence at SEQ ID NO. 24595
accatcagctcgatccatcgatctctccctgccgccgtcggccgctaatcgatcgaggtgatccagcagcagcagcagcagcagcaatggccggcggccgccgtccccggtgcctctcccctgcgtgcctctttctcgccgccgccgtggccctgctcgccatgccgggcctcgccgccgcccgcacccgccgctacacgttcaatgtgacgatggcgacggtgacgcggctgtgcgtgacgaagagcatccccacggtgaacgggcggttcccggggcccaaggtggtcgtgcgcgagggcgaccgcctcgtcgtccaggtccacaacaacatcaacagcaacctcaccttccactggcacggcgtccggcagctgcgcagcgggtgggcggacgggccgtcgtacatcacgcagtgcccgatccggccggggcggagctacgcctacgacttccgcgtcgtggggcagcgcggcacgctgtggtggcacgcccacttctcctggctccgcgccacgctctacggcccgctcgtcatcctcccgccgcgcggcgtcccctacccgttccccaagcccgacggcggggaggtccccctcatgctcggcgagtggttcaacgccgacccggacgcggtcatcaggcaggcgctgcgcaccggcgggggccccaacgtctccgacg

SEQ ID NO: 24595 - protein, 199 aa, Panicum virgatum
  misc_feature: Ceres CLONE 1859549
  misc_feature (40)..(156): Pfam Name: Cu-oxidase_3 Pfam Description: Multicopper oxidase
  misc_feature: SWISSPROT Homolog: EC 1.10.3.2 Laccase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MAGGRRPRCLSPACLFLAAAVALLAMPGLAAARTRRYTFNVTMATVTRLCVTKSIPTVNGRFPGPKVVVREGDRLVVQVHNNINSNLTFHWHGVRQLRSGWADGPSYITQCPIRPGRSYAYDFRVVGQRGTLWWHAHFSWLRATLYGPLVILPPRGVPYPFPKPDGGEVPLMLGEWFNADPDAVIRQALRTGGGPNVSD

SEQ ID NO: 24596 - DNA, 1621 bp, Panicum virgatum
  misc_feature: Ceres CLONE 1859561
  misc_feature: Encodes the peptide sequence at SEQ ID NO. 24597
ctgcttgggctcttggcttcctcccctcccctaccggatcccccatggcgcaggacgagaccccggagccccccgccaccgcatccggctcctcctccacctcctctgccgccgccgccgccccggccgcccgcctcaacgccgccgcgcccgagttcaccccgcgatccaccgcccagcaccacggcagcaacccccaccgccgcgggtctcaccactaccagcagcaccaccaccagccgcatcaccaccaccaccaccaccagcagccgcaccagcactaccagccgcggcaccaacagcaccaccagggcggcgaggatgaggggagcgccgccgcggcgggggaggataaggaggggcctgcgggggcggggcaggcgcagcagccccgcctgaacgacgccgatgcccggaaggtcgtcaagcaggtggaattttacttcagtgatatcaatttggccacaactgaacatctgataaagttcatcactaatgatccagatggatttgtgccaatatctgtagttgcgtcttttaggaaaatccgggagatagtttctgacagatccttgttggttgctgcattgcgcacatcgtcagagctggttgtttcagaggatgggaaaaaggttaaacgcctacggcccttcaacactgaagaagttcagtcacgtatcgttgttgctgaaaatttacctgatcaaaagtatcagactcttatgaagattttctcggatgttgggagtgtgaaatctatacgtacctgctatccacaggatggcggtgcggctgctgctagcaaaacatcaaggattgagatgctttttgctaataagctgcatgcttttgtggagtatgggactgttgaagatgctgaaaaagcggttgcattcagtggcgagggaaagtggagggatggtgcaattagagttcgctcgctgcttgcttgtctgaagcatggattgggtcaagggaggagaggtggagatgaatatgctgttgatgaagatggccctgacacaactggccactcacatgactacggagcagatgatacgacccagatttctgaagcacatcttgatcatcaggctgaagatggctactatgacaagggaatgaggcaaggaagagggcgaggacgtggaggcagaggccgcggtcgtggccagtactacggccacagccgagatgcccaccatccgattggcactcctccatcagagcacccagctatcccaaagccacccccaggcccccgcatgccagatggcacaagagggtttaccatgggccgagggaagccgctcaacccttccccagatgctgcacctatcacagatgctgcgcctatcacagatgctgcctagtggtgttaccatgtgatgacttatcctgctcgtcatcagtcgtacaaaccatgacagtgatccttttctcaggttctaaaactgattgctgtggtgtgctggttcattttgatgtgagatctaaaagagagaaaaaatatatggctggtaccgtggtacatgcgtgtataccaacaccgggggtataaacatgtgaacaagtactgtgatatgtagttcttaaagtagaaaaaaaaatcatacttgac

SEQ ID NO: 24597 - protein, 442 aa, Panicum virgatum
  misc_feature: Ceres CLONE 1859561
  misc_feature (126)..(185): Pfam Name: La Pfam Description: La domain
MAQDETPEPPATASGSSSTSSAAAAAPAARLNAAAPEFTPRSTAQHHGSNPHRRGSHHYQQHHHQPHHHHHHHQQPHQHYQPRHQQHHQGGEDEGSAAAAGEDKEGPAGAGQAQQPRLNDADARKVVKQVEFYFSDINLATTEHLIKFITNDPDGFVPISVVASFRKIREIVSDRSLLVAALRTSSELVVSEDGKKVKRLRPFNTEEVQSRIVVAENLPDQKYQTLMKIFSDVGSVKSIRTCYPQDGGAAAASKTSRIEMLFANKLHAFVEYGTVEDAEKAVAFSGEGKWRDGAIRVRSLLACLKHGLGQGRRGGDEYAVDEDGPDTTGHSHDYGADDTTQISEAHLDHQAEDGYYDKGMRQGRGRGRGGRGRGRGQYYGHSRDAHHPIGTPPSEHPAIPKPPPGPRMPDGTRGFTMGRGKPLNPSPDAAPITDAAPITDAA

SEQ ID NO: 24598 - DNA, 1020 bp, Panicum virgatum
  misc_feature: Ceres CLONE 1859570
  misc_feature: Encodes the peptide sequence at SEQ ID NO. 24599
aacaaactcgcccgccgcaccacgccacacctctgctctgctgcgcttctgctctcgtgcctctcccctataggctgctcctcttgtcttctccaatccaatggcggcggacgctcccgcctccggtaccctcacggcgctgctcaagaaggcggccgccgccttcccggcccgccgcgccgtctccgtcccgggcaagatccaactcacccacgccgccctcgacgcgctcgtcgacgccgcggccgcgcgcctcgccgccgacgccggggtccgccagggacacgtcgtcgcgctctccttccccaacaccatcgagctggtgatcatgttcctggcggtgatccgcgcccgcgccgtggcggcgccgctcaacccggcctacacccaggacgagttcgagttctacctctccgactcccagtcccgcctcctcatcaccaacgccgagggcaaccccgccgcggaggccgccgccgccaagctcggcctcgcccacgccgccgcaaccctcaaggacgccgccggacccgtccacctcgccggcctcggctgtgcggctgccgccaacgggaacgccaacggctcccacaaacaagacaagaacgagccgtccgacgttgccctgttcctgcacacctccggcacgacgagccggcccaagggggtgccgctcacgcaggccaacctggcggcctccgtccgcaacatccgctccgtgtaccgcctcaccgaggcggacgccaccgtggtggtgctgccgctcttccacgtgcacggcctcctctgcggcctcctcagctcgctggcctccggcgcctccgtggcgctcccggccgccggccgcttctccgcgtccaccttctgggccgacatgcgcgcggcgggcgccacctggtacaccgccgtgcccaccatccaccagatcatcctggaccgccacgcctccaagcccgaggcgtcctacccggcgctccgcttcgtccgcagctgcagcgcgtcgctggcgccggcgatcct

SEQ ID NO: 24599 - protein, 306 aa, Panicum virgatum
  misc_feature: Ceres CLONE 1859570
  misc_feature (37)..(306): Pfam Name: AMP-binding Pfam Description: AMP-binding enzyme
  misc_feature (57)..(114): SWISSPROT Homolog: EC 6.2.1.3 Long-chain-fatty-acid--CoA ligase
  misc_feature (173)..(225): SWISSPROT Homolog: EC 6.2.1.26 o-succinylbenzoate--CoA ligase
MAADAPASGTLTALLKKAAAAFPARRAVSVPGKIQLTHAALDALVDAAAARLAADAGVRQGHVVALSFPNTIELVIMFLAVIRARAVAAPLNPAYTQDEFEFYLSDSQSRLLITNAEGNPAAEAAAAKLGLAHAAATLKDAAGPVHLAGLGCAAAANGNANGSHKQDKNEPSDVALFLHTSGTTSRPKGVPLTQANLAASVRNIRSVYRLTEADATVVVLPLFHVHGLLCGLLSSLASGASVALPAAGRFSASTFWADMRAAGATWYTAVPTIHQIILDRHASKPEASYPALRFVRSCSASLAPAI

SEQ ID NO: 24600 - DNA, 543 bp, Panicum virgatum
  misc_feature: Ceres CLONE 1859570-R
  misc_feature: Encodes the peptide sequence at SEQ ID NO. 24601
gcgacccgggggcgaacgaggcggcgttccggttcgggtggttccacacgggcgacatcggcgtggtggacgaggaggggtacctgcacctggtggggcgcatcaaggagctcatcaaccgcggcggcgagaagatctcgcccatcgaggtggacgccgtgctgctgggccaccccgccgtcgcgcaggcggtgtccttcggcgtgcccgacgacaagtacggcgaggagatcaactgcgcggtcatcccccgcgaggggtcgccgctgggggaggacgacgtgctggcgcactgccgcaggaacctggcgtccttcaaggtgcccaagaaggtgttcatcgccggcgacctccccaagacggccaccggcaagatccagcgccgcatcgtcgcgcagcacttcgtcgtgcagccgcccaaggccgccgccgcctgaatgtgctggtgcccgtgtcctcgagtagtgcggccatatattttagtagctgctgccattgccgctttgcattgacaaggaataaacaagaagaagattttgtcgc

SEQ ID NO: 24601 - protein, 144 aa, Panicum virgatum
  misc_feature: Ceres CLONE 1859570-R
  misc_feature: SWISSPROT Homolog: EC 6.2.1.26 o-succinylbenzoate--CoA ligase
DPGANEAAFRFGWFHTGDIGVVDEEGYLHLVGRIKELINRGGEKISPIEVDAVLLGHPAVAQAVSFGVPDDKYGEEINCAVIPREGSPLGEDDVLAHCRRNLASFKVPKKVFIAGDLPKTATGKIQRRIVAQHFVVQPPKAAAA

SEQ ID NO: 24602 - DNA, 1178 bp, Panicum virgatum
  misc_feature: Ceres CLONE 1859576
  misc_feature: Encodes the peptide sequence at SEQ ID NO. 24603
aaaaaaaaggagataagaatgcatggcagctcgtgtgaagaattgctgtactgaacattgccaatgctgctgctgatgcagggcctgggtgctcgtcgatcgggtacggcgaggcggaggagctggggcctttcttggtgcagaagggcacgccggagctcaaatggaacaactactcctggaacacagaggccaacctgatgttcctggagtccccggtgggcgtcggcttctcctacaccaacacgagctccgacctgcagaagcttggcgacaagatcaccgctgatgacgcttacgtgttcctgctcaactggttcaagaggttcccgcagtacaagtcccacgacttctacatcgccggcgagagctacgccgggcactacgtgccgcagctgtcggagaagatcttcgacggcaacagggcgggccccaaggagagctacatcaacttcaagggcctcatggtcgggaacgcgctcatggacgacgagacggaccagacgggcatgatcgactacgcctgggaccacgccgtcatctccgaccgggtgtacgccgacgtcaaggcccgctgcaacttcagcatggccaacgtcackgacgcctgcaacgccgcgctccaggagtacttcgccgtgtaccgccttatcgacatgtacagcctctacacccccctctgcaccgacggctctggctccggctcgtccgccgccgccgccgcgcgcaaggtcgccgtccacggcgccgcccccgggatcttctccagataccgcgggtggatcatgaagccggcgggctacgacccctgcacggcggagtacgcggaggtctacttcaaccggcccgacgtccaggcggcgctgcacgcgaacgtgaccaagatcggctacaactggacgcactgcaggtgctgcgtggctcactgcccgcaacttggcagcaagaaatgctgcctcatttcttcaggtttcagagcactgaccgaaaagggcaccgatgtgatgcgcagcgacgtgatccccacttggaacgacgccgccttctccaccctccccatcatccgcaagctcatcgccggcggcctcagggtctgggtcttcagcggcgacaccgacgggaggatccccgtgacggcgacgaggctcacgctcaacaagctcggactcaagaccgtc

SEQ ID NO: 24603 - protein, 325 aa, Panicum virgatum
  misc_feature: Ceres CLONE 1859576
  misc_feature (1)..(325): Pfam Name: Peptidase_S10 Pfam Description: Serine carboxypeptidase
  misc_feature: SWISSPROT Homolog: EC 3.4.16.6 Carboxypeptidase D
MFLESPVGVGFSYTNTSSDLQKLGDKITADDAYVFLLNWFKRFPQYKSHDFYIAGESYAGHYVPQLSEKIFDGNRAGPKESYINFKGLMVGNALMDDETDQTGMIDYAWDHAVISDRVYADVKARCNFSMANVTDACNAALQEYFAVYRLIDMYSLYTPLCTDGSGSGSSAAAAARKVAVHGAAPGIFSRYRGWIMKPAGYDPCTAEYAEVYFNRPDVQAALHANVTKIGYNWTHCRCCVAHCPQLGSKKCCLISSGFRALTEKGTDVMRSDVIPTWNDAAFSTLPIIRKLIAGGLRVWVFSGDTDGRIPVTATRLTLNKLGLKT

SEQ ID NO: 24604 - DNA, 1422 bp, Panicum virgatum
  misc_feature: Ceres CLONE 1859612
  misc_feature: Encodes the peptide sequence at SEQ ID NO. 24605
acgttacttacagaaagcatagcgagctccctgcagagtgcagcagtgcagccaccttgcacgggaccggcagccatgtccagccttcttctccccatcctcctcctctgcgcctccctcctcgccgcaacaaccaacgccgacgacccagtgttcaccggctgcccgaccaacacgaactacacgcgcggcagcgcgttcgaggccagcctcggcgctctcctctagtccctccccgccgccgcggccgcgtcctccgggttcgccgacaacatcacgggctccgcgcccgggagccaggcgtacggcctcgcgcagtgccgcgccgacctcaacgcgtcggcctgccgcgcgtgcctcgacggcgcggcgcgggacatggccgccaggtgccccggccagaagagcgccatgctcatctacgacggctgcctgctgcggcactccaacgcgagcttcttcggcgccgccgacacgtccgtctcggtctggatgtggaacacgcagaacgcgacgcagccggcggaggagttcaggtcgcggctcggcgcgctgatgcgcaacctcacggcgagggcggcgtacgcgtccccgcggatgttcgcggcgggggaggccggcctcacgcccttcgtgaacatcttcggcatggcgcagtgcacgcgggacctcgccgccgacgactgcaacagctgcctcgccagcgccgtcgcgtccatcccgagatgctgcgacggcaagcagggcggccgggtcatctaccggacctgctccatccggttcgaggtgtacccgttctacaacgccctcgccgccgaggcagcgatgccgccggcgccggcgccggccccgggaggcgggtccgtcaacggcagcgatcagtcgggcccaggaagcaacgggagtgatcgtacggtcaggacagctcttctcgtgtcagttcctgttgctgtcgtgctgctggtgctggtgctagtgctagttgcttcctatcgctgcaagaggaacagaaaaccacgccggcattcgcaggttgcaagcaccagtcatggagatgacgaagaaatgggaagctcagattctctgctgtatgatttgggcacgctacgagctgccaccaacaacttctcagaagaaaacaagctcggcgaaggcggatttgggccagtctacaaaggcacgctgcaaaacgggcagtacattgcagtgaagaggttgtcagcaacttcgcagcaagggcaggtggagatgaagaacgaggtggtcctggttgcaaagctgcagcacaggaatctggtgcgcctgctcggctgctgcatcgaggagcacgagaggctcctcgtctacgagttcctcagcaacaacagcctcgacaagatccttttcgatcctgcacggcagcatgagctgagctgggggcag

SEQ ID NO: 24605 - protein, 347 aa, Panicum virgatum
  misc_feature: Ceres CLONE 1859612
  misc_feature: SWISSPROT Homolog: EC 2.7.11.1 Non-specific serine/threonine protein kinase
MAARCPGQKSAMLIYDGCLLRHSNASFFGAADTSVSVWMWNTQNATQPAEEFRSRLGALMRNLTARAAYASPRMFAAGEAGLTPFVNIFGMAQCTRDLAADDCNSCLASAVASIPRCCDGKQGGRVIYRTCSIRFEVYPFYNALAAEAAMPPAPAPAPGGGSVNGSDQSGPGSNGSDRTVRTALLVSVPVAVVLLVLVLVLVASYRCKRNRKPRRHSQVASTSHGDDEEMGSSDSLLYDLGTLRAATNNFSEENKLGEGGFGPVYKGTLQNGQYIAVKRLSATSQQGQVEMKNEVVLVAKLQHRNLVRLLGCCIEEHERLLVYEFLSNNSLDKILFDPARQHELSWG

SEQ ID NO: 24606 - DNA, 786 bp, Panicum virgatum
  misc_feature: Ceres CLONE 1859612-R
  misc_feature: Encodes the peptide sequence at SEQ ID NO. 24607
tggccaagctgttcaacatcgactccagcgtggggaacaccagccgcatcgccggaacttacgggtacatggcccccgagtacgccctgcacggcatcttctcggcgaaatccgacgttttcagctacggcgtcctcgtcctggagatcgtcaccggccggcgcaacaccttcacccaacattctgggccttctgaagatctgcttacctatgtctggaggcactggagccgcgggagcgtgcgggagctgctcgacggctgcccggcggaggggcggcgcccgcaggaggtcctgaggtgcgtccacgtcgggctgctgtgcgtgcagggggacccgcagctccggcccgggatggcgtccgtcgtcgtcatgctcaacagccgctccatcacgctgccggcgcccgacgcgccggcgtacgcgctccccggccgtgcggtcgcagccgcagcagccgtccggcgggggaggagcatggacatggatcgcgagggccagagcgccatggtggcagtggcagctcgggagccgtccatcaacgaagttacggtgtctgacttgcagccccgttgatgctgtacacttgtcggtaataatcagcatatggacgtcatcgacgatcaagtaatggacgacaacgatgtttttgttttttaaagggtcacaacgatgctttgtgattcaatttgcgtctcctccttttgaataccagagtagtttgtgctctcatatctgtactgtcgaaggtgctttatttggtccagtcgtcggaagtttaagatgt

SEQ ID NO: 24607 - protein, 190 aa, Panicum virgatum
  misc_feature: Ceres CLONE 1859612-R
  misc_feature: SWISSPROT Homolog: EC 2.7.11.1 Non-specific serine/threonine protein kinase
  misc_feature: Useful for making plants with altered cell wall content and/or composition
AKLFNIDSSVGNTSRIAGTYGYMAPEYALHGIFSAKSDVFSYGVLVLEIVTGRRNTFTQHSGPSEDLLTYVWRHWSRGSVRELLDGCPAEGRRPQEVLRCVHVGLLCVQGDPQLRPGMASVVVMLNSRSITLPAPDAPAYALPGRAVAAAAAVRRGRSMDMDREGQSAMVAVAAREPSINEVTVSDLQPR

SEQ ID NO: 24608 - DNA, 1233 bp, Panicum virgatum
  misc_feature: Ceres CLONE 1859620
  misc_feature: Encodes the peptide sequence at SEQ ID NO. 24609
gctcgcacaaatcctaaacgaaaccctgtcgctaatcgctcgtctccgcagcaccagcagtacagctccagcatcccctcccttcctttcctttcccttggcttccttgctttgcttgttcctctgccgccccgtcgtcgccgtctcctccgtggcgcatcaggcattcgaacccgctcgtcaaaaggaatccgtccgcgagatcgaaagcaacagctcccgattattaaagccacgctttttcaaaagccgcggggggttaaaattcctgggaaattttggaggaagcgaaattcgtttcctcgcatctgaaactgcagttgcgtgctcgaggcgggggtgcacagcctagaagctcccagcgcccggacgccgccggcgccccgttctctccgtggcggatcctccgccggccgctactccactgagctctggtggtggacttgagcggagattcaaccgagcgcggattggattggtcggttcttctgctgaataccacacatgacaagggtcatccatgactctggagaaggcgtgcagaaggaggcacttgatcttgtctcctctgatgttaacttcctcaagggccatttcccggactacaggattggaccaaacaaccaaatcattgatccagaggaggcacatgaggctgtacctctcaaggagattgttgcaaaggaaacagcgcagctgctagagcagcacaagcgcctttcagtgcgtgatctgaaagagaagtttgagaagggtttgtctggtgctaccaagctgtctgaggaggctaagcggagagaagcagcttcattagacaggcaggttcttctgaagaagctcagagatgttttagacatgctgaaaggccgtgtggctggtcgaaatagggacgatgctgaggaagctatatcgctggtggaggcactagctgtccagctgacacaacgagaaggggagttaatttatgagaaggctgaagtaaaaaagttggctaacttccttaagcaggctactgaagatgcacgtaaagtggctgaagaggaaagggctcttgcgcttgctgaaattgaaaaggctagagctgcaatagaaaaggttgagaaagcattgcaggtgcatgattctgcttcaagtagcagggagaaggaggagatagaggaacttaggaaagaggtccgagaggctaggagaataaaaatgctacaccagccaagcaaggtcatggacatggag

SEQ ID NO: 24609 - protein, 242 aa, Panicum virgatum
  misc_feature: Ceres CLONE 1859620
  misc_feature: Useful for making plants with altered alkaloid content
  misc_feature: Useful for making plants with altered terpenoid content
MTRVIHDSGEGVQKEALDLVSSDVNFLKGHFPDYRIGPNNQIIDPEEAHEAVPLKEIVAKETAQLLEQHKRLSVRDLKEKFEKGLSGATKLSEEAKRREAASLDRQVLLKKLRDVLDMLKGRVAGRNRDDAEEAISLVEALAVQLTQREGELIYEKAEVKKLANFLKQATEDARKVAEEERALALAEIEKARAAIEKVEKALQVHDSASSSREKEEIEELRKEVREARRIKMLHQPSKVMDM

SEQ ID NO: 24610 - DNA, 576 bp, Panicum virgatum
  misc_feature: Ceres CLONE 1859645
  misc_feature: Encodes the peptide sequence at SEQ ID NO. 24611
aacggatccaattcccttcggtttcaattgggcttttgtgtcctgatttgatcggggccccgctggaacctgctgggtttggaattccgctcgggaatttcggggaaacaaaacaagggcaaccgccgggaaggggatcaagtgcaaacccccgggggcatggaaggccggaaagcccctgccaatcaagaagggggagggggcccccccccaggccatggaggggcccgtcaaaatcctctacccctccccctgccacacaaacttctacttctggaaggccaaggggcaaactcccgggttcccccgaatcttcggccatgaggctggaggaatcttaaaaagggttgaaaagggggtgactgaccggccccctgggaaccatgtccttcctgggttcacggggaagggcaaggatggccccccctgcaagccggcaaaaaccaccttgtttgacctgctcaggatcaacactaacaggggtgtaatgatggggaatggcaagtcccgtttttcatccaagggaaagccaatctatcactttgttgggactccaacctccagcaagaaccctgc

SEQ ID NO: 24611 - protein, 119 aa, Panicum virgatum
  misc_feature: Ceres CLONE 1859645
  misc_feature: SWISSPROT Homolog: EC 1.1.1.1 Alcohol dehydrogenase
MEGPVKILYPSPCHTNFYFWKAKGQTPGFPRIFGHEAGGILKRVEKGVTDRPPGNHVLPGFTGKGKDGPPCKPAKTTLFDLLRINTNRGVMMGNGKSRFSSKGKPIYHFVGTPTSSKNP

SEQ ID NO: 24612 - DNA, 518 bp, Panicum virgatum
  misc_feature: Ceres CLONE 1859665
  misc_feature: Encodes the peptide sequence at SEQ ID NO. 24613
atactgcaagacaaccaaccgaggccatgcgccatggggatcccgagcgccagcaccacctcgccttcctcctcgtcctcctcctccgctgccgcctccaacgaggagacccacacccgccgcggcgcgcacgtgctgctcctgccggtaccgggcgcacagggtcacaccaacccgatgctccagctcggccgccgcctcgcgtaccacggcctccgccccacgctggtcaccacccgctacgtcctctccaccacggctcggcccccgcccagccccttccgcgtcgccgccatttccgacggcttcaatgacggcggcatggccgcgtgccccgacctcgccgagtactgccgacgcctcgaggccgtaggtacggagacgctggcggagctgctccgctccgaggccgccgagggccggcccgtccgcgtgctggtctacgacccgcacctcccgtgggcgcggcgggtggcgcaggcggcgggcgtcgcggctgcggcgttcctgccgcagcc

SEQ ID NO: 24613 - protein, 161 aa, Panicum virgatum
  misc_feature: Ceres CLONE 1859665
  misc_feature: SWISSPROT Homolog: EC 2.4.1.121 Indole-3-acetate beta-glucosyltransferase
MGIPSASTTSPSSSSSSSAAASNEETHTRRGAHVLLLPVPGAQGHTNPMLQLGRRLAYHGLRPTLVTTRYVLSTTARPPPSPFRVAAISDGFNDGGMAACPDLAEYCRRLEAVGTETLAELLRSEAAEGRPVRVLVYDPHLPWARRVAQAAGVAAAAFLPQ

SEQ ID NO: 24614 - DNA, 2486 bp, Panicum virgatum
  misc_feature: Ceres CLONE 1859666
  misc_feature: Encodes the peptide sequence at SEQ ID NO. 24615
atctcatttgctccgtcatcattagttccgttcttgaatcccgtccggggctccgggcactcactttccccaaaattggaatcaaaccctagctcagtagctcgtcctcctcctcgattccccccgatccccaccagccgactcgccggaaccctagctagcgttagatctaccgcgccgcgcgcgcgtgcccgccgccatggcgaccctaaaggatctcctcccggcgcccaagacgtcggcgtccaccttctacgaccacagcagcgacccctggttcaaggagcggtacggcggggagtcggcgcaggcgtcggccgcggcgaggcccgcgggcgccgccaggaccatccctccgtacgggaagcgggcggggttcgtgccgcgccggccggaggactttggggatggcggcgccttcccggaggtccatgtcgcgcagtatccgctcggcatgggccgccgcgacgacaagggcgggtccaagatcctcgcgctaaccgtcgacgcgcatgggagcgtcgccttcgacgccgtcgtcaagcagggcgagaacgccggcaagatcgtctactccaagcacagcgacctcgtgccgaagatcgccacgtccgattcgcaggcgccggacgacgacgaggagcagaagcagatcgaggagaccacagagcggaccaaggctgccttggagaaggttgtcaacgtccgcctctcagctgctcagcccaagaatgtgccgacacatgattctgagtccaagtttattaagtataagccgtcacagcaatcagcggccttcaattcaggtgccaaggagaggatcattcggatgtcggagatggcggtggatcctcttgagccgccaaagttcaagcacaagcgtgtgccccgggcgtctgggtcgccacctgtgccggtgatgcactcgccaccgcggccagttacagtgaaggatcagcaggattggaagatcccaccgtgcatttctaactggaaaaatccaaagggttacacaattccacttgataagaggctggcggctgatggaagagggctacaggaggtgcaaattaatgacaactttgcaaagctttctgaagcattgtatgtggcagaacagaaggcgagggaggcagtacagatgcgctccaaggtccagagggaactgatgctgaaggagaaggagagaaaggagcaagaactgagggctcttgcccagaaggctcgcatggagaggactggtggcccatctgcgccatcagctgtgcctgctggtggtggcaggggagcagttgatgctatcgatgaagatatggatatggagcaaccacatgaaccgcgtgagcagcgcagggagagtagagaagagagggaagcgaggattgagcgtgatagaatccgtgaggagcgcagacgtgagagggagagagagaggaggctggaagccaaggatgctgcaatgggcaagaagagtaagatcacgagagacagggatcgtgacatcagtgagaagattgctctgggtatggcaagcactggtggtgccaaaggtggtgaggtcatgtatgaccagaggctgttcaaccaggacaagggtatggactccgggtttgccacggatgatcagtacaacatctactctaaggggctcttcacagcgcagtctacgatgtctacattgtacagacctaagaaggatggtgattctgatgtgtatggtgatgcggatgaacagttggagaaggttatgaagactgagaggttcaagcctgacaaggcttttactggtgcttccgagaggactggcaagcgagacaggcctgtggagtttgataagcaggaggagaacgatcccttcggtctggatcagttcttgactgaggtgaagaagggaaagaaagctgtggagaagatcggaggcggaggcaccatgaaggcgagtggtgggtcctcaatgagggacgattatgatggaggatctgggaggtcccgcattaattttgaaagggggcgttgaggtccatggggattacacaaaggaggatgttggtggtgaagcgcttgagagacctgctgagggtgatgaggccgtggctggaggaggctgcttttctcgaacgcgcaggagaactgcgcatcattgtttaagaagaagaagaaaagggatgggggttttatccccccgatgttacagatacaaaaggggctgtaacccccctaggtacaaacatgccgactctctcccaaacaagaggctgtggttggccaggaggctgctgcagctgagtaggatagttttgatcactattttgccacttaatatatttgaaggatatatgtactgttacctttctgtctgagaactagggtggctttattttggcgatatggtagttcatgtctgaaaacaagtcattcgtttgtggttatttggatcgcaagttctggtgacatctattcgacttattacctgaggtttagtttgg

SEQ ID NO: 24615 - protein, 605 aa, Panicum virgatum
  misc_feature: Ceres CLONE 1859666
  misc_feature (186)..(352): Pfam Name: SKIP_SNW Pfam Description: SKIP/SNW domain
  misc_feature: Useful for making plants with modulated biomass
  misc_feature: Useful for making plants with modulated flowering time
MATLKDLLPAPKTSASTFYDHSSDPWFKERYGGESAQASAAARPAGAARTIPPYGKRAGFVPRRPEDFGDGGAFPEVHVAQYPLGMGRRDDKGGSKILALTVDAHGSVAFDAVVKQGENAGKIVYSKHSDLVPKIATSDSQAPDDDEEQKQIEETTERTKAALEKVVNVRLSAAQPKNVPTHDSESKFIKYKPSQQSAAFNSGAKERIIRMSEMAVDPLEPPKFKHKRVPRASGSPPVPVMHSPPRPVTVKDQQDWKIPPCISNWKNPKGYTIPLDKRLAADGRGLQEVQINDNFAKLSEALYVAEQKAREAVQMRSKVQRELMLKEKERKEQELRALAQKARMERTGGPSAPSAVPAGGGRGAVDAIDEDMDMEQPHEPREQRRESREEREARIERDRIREERRRERERERRLEAKDAAMGKKSKITRDRDRDISEKIALGMASTGGAKGGEVMYDQRLFNQDKGMDSGFATDDQYNIYSKGLFTAQSTMSTLYRPKKDGDSDVYGDADEQLEKVMKTERFKPDKAFTGASERTGKRDRPVEFDKQEENDPFGLDQFLTEVKKGKKAVEKIGGGGTMKASGGSSMRDDYDGGSGRSRINFERGR

SEQ ID NO: 24616 - DNA, 1761 bp, Panicum virgatum
  misc_feature: Ceres CLONE 1859670
  misc_feature: Encodes the peptide sequence at SEQ ID NO. 24617
aaaaagccccccctacgtagggtggggggagctgtccggggctccgttggagctcgccttacttctcccgaatggtcgaggccatcgccccacgccactccctcctccggctcgtcccctccactgctgctctgctcgcaggcggtagatagatccggccggcctcacagtacgagtacggctcgccattgacgactcactcgctacaaggaagcgagcaagcaacgccgcgcgagtaatccaatccaatccatcgatcgatcgagagggccaagagactgactggttggttggttggtgggtgggtggggggagggaaagcggcgagagcggcgggattgatgcgcgcatggcgctgcgggcgcgggtgatggggccgcgggagctgctgctgctttccgcggccttcacggcgctcctcgtcgcctccatcctcctcctcccgtcgctcctcctcggggcgggcggcgcggcggggcccggcctcttcccgtcgtcccccgccgccggcgacgagcagccgccgcggtacccggtctcgttcgcgtacctcatctcggcgtcctcgggggacgcggcccgcgcggcgcgcctgctggcggcgctctaccacccggccaacacctacctgctgcacctcgaccgggaggcccccgccggggagcaccgccggctggcggagctggtgtccgcgcgggccgtgtacgcgcgcgccggcaacgtgtgggtcgtcggccgccccaacctcgtcacctaccggggccccaccatgctcaccaccacgctgcacgccgtcgcgctgctgctccgcctgcgccgcagctgggactggttcgtcaacctcagcgcgtccgactacccgctcgtcacccaggacgacatgatggaggcgttcgccgggctgcccagggacctcaacttcatccagcacaccagccatctcgggtggaagataaagaagcgggcgcggccggtgatcctggacacggcgctgtacgaggacgggcgggcggagctcatccgcccggtgaacatcaccaccaacctccggaggttgcccacggccttcaagctctacacagggtcggcgtggacgatgctgtcgcgtcccttcgcggagtacgtgaccatggggtgggacaacctgccccggaccctcctcctgtaccacgccaacatcatctcctcgccggagttctacttccagacggtggcctgcaactcgcggcggttccgcaacgccaccgtgaaccacgacctgcacttcatccggtgggacaacccgcccaagcagcacccgctgcacctcaccgccagggactaccgccggatgctgctcagcggcgcccccttcgcgcgcaagttccgggagggcgacccggtgctggaccggatcgaccgggacatcctgcgccggcgggggcccgcccagttcgcctacggcgggtggtgcgccggggacggggacggggacgccggcgcggcgctgtgcggcaacccacaggagcccgggaggaagggggccgtcagggccggcgccgggtcgcgccggctcaaggtgctgctgggcaaggcgctcgccccggggaacctacggagaaagcagtgtaggtgaaataaactgtttggaatgggctttttttatttaggaagaagcccatttttaaccatctaactattgttcaagtttaattttggttatcgaaccgcaaagccaaaaatgtttggccactcgactcttaaaaccgttcattttttgcc

SEQ ID NO: 24617 - protein, 421 aa, Panicum virgatum
  misc_feature: Ceres CLONE 1859670
  misc_feature (65)..(294): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MALRARVMGPRELLLLSAAFTALLVASILLLPSLLLGAGGAAGPGLFPSSPAAGDEQPPRYPVSFAYLISASSGDAARAARLLAALYHPANTYLLHLDREAPAGEHRRLAELVSARAVYARAGNVWVVGRPNLVTYRGPTMLTTTLHAVALLLRLRRSWDWFVNLSASDYPLVTQDDMMEAFAGLPRDLNFIQHTSHLGWKIKKRARPVILDTALYEDGRAELIRPVNITTNLRRLPTAFKLYTGSAWTMLSRPFAEYVTMGWDNLPRTLLLYHANIISSPEFYFQTVACNSRRFRNATVNHDLHFIRWDNPPKQHPLHLTARDYRRMLLSGAPFARKFREGDPVLDRIDRDILRRRGPAQFAYGGWCAGDGDGDAGAALCGNPQEPGRKGAVRAGAGSRRLKVLLGKALAPGNLRRKQCR

SEQ ID NO: 24618 - DNA, 519 bp, Panicum virgatum
  misc_feature: Ceres CLONE 1859702-R
  misc_feature: Encodes the peptide sequence at SEQ ID NO. 24619
acggctcgctgcgggcgctcaacctgctgggcaacccggtggaggccgccaccggcggcgacacgctgcgcagggccgtgtcgggcctgctcccgcggatcgagtacctcaacaggcaggccgtgaagccgcagcgcgcgcgggaggtggcaaaggacagcgtcgcgcgggcggcgctcgggaacgccggcgggagctcgcgcagcaggcggccgccgcgccgggcgaaccagagccccgggtcgtcgggcaagagccggggcagggacgggagcagcggcagccgcagggggagaaggagcaggtccaacaccaggcagcaggggcagggctccagcctctcgaggaagtgagctgtgagcatgaggccgccgtgtcgcagacatggaagagtgttcaactcttgatcgaagagggagagcaaatgactccgtgtgttttaaactgccgtgttcagataaataattggcattaccggaggcaatttgaatctaaacagagtgcttgcttttacttttt

SEQ ID NO: 24619 - protein, 116 aa, Panicum virgatum
  misc_feature: Ceres CLONE 1859702-R
  misc_feature: Useful for making plants with altered protein content
GSLRALNLLGNPVEAATGGDTLRRAVSGLLPRIEYLNRQAVKPQRAREVAKDSVARAALGNAGGSSRSRRPPRRANQSPGSSGKSRGRDGSSGSRRGRRSRSNTRQQGQGSSLSRK

SEQ ID NO: 24620 - DNA, 1063 bp, Panicum virgatum
  misc_feature: Ceres CLONE 1859702
agttgcctcccaccatattccactccgtttcgtgcttcctggcccgccactccctcccactgttgttgcatctcaagggcaggggccggccaggtcggctctccgatcgctctggccttccgcgtctcgccggcggccggcgcatcaaccaccgtactgcgcgcccgccggagcatgcagttgcaggcaccgttcctgtctccggctgtctcctccgccggacgggctctcgctctcccataggaaacgatcgactcggctaaccgcaacaacgtctccttccacctactctctcgccaacgttttggacaagttcgttgaggcacagaagaatcgcctgccgtgtggcgggtgactgactgttgctcgggatgggcaagatgagctgcttcgccggcctgctcctgctcggcggcaagaggaaggcatccaagggtaagaacaagggcgcttacgccaagaaggttaatggcaatgactgccccaaggtgaagccggtggagttcatgaacatggcggacgctctagacgtcagcagaggcgggggcaacgatcctgcatgcaacagcgggtttgtcgttcgcgcagccgccgagttggcaggccgtggcggtagcggggacggcgacaaggccgcaattaagatgggctcgtctgactctgmckytgacstcgtcgccggctacaccagtgacggaacaggtgaaagtgccaagcgctccgagccggacgccggcaagtcctccagcgttggccgcatgtcgccgacgccaccggcgtcgccaaagctgaagcgctcgtgctccaacatcgagacgacaaggtcctccgcgccgccgaaagggttcgacctggcggcaaggtcgcgctcctacaacaacctaaacgccctgcctccggcgtggtcggccacccccagcggcgcgccgaacgcgagcccggcggcgtccgtgaggacgtcgtgctccgccgaccgcgaaatgctcaagaagcggtcgtcgacgctggggctcccaccccggagccggaagctgtggcggcggtggttcctgtggagccaccg

SEQ ID NO: 24621 - DNA, 1437 bp, Panicum virgatum
  misc_feature: Ceres CLONE 1859705
  misc_feature: Encodes the peptide sequence at SEQ ID NO. 24622
atcgaactcgaagtgaacagcttccagacggtccaatggcttctctcctgatctcagcacaagcaatggccgtcttcactgtcgcatgcttcttcgcgctcttgtgcatggctcaacaagtccgagctgtgaactacaccttcatgagggaggcggtgaacgcgccgccggtggcctactacgactacatcatcgtcggcggcggcacggcgggctgcccgctggccgcgacgctgtcgcagggctcgcgcgtgctcctcctggagcgcgggggctcgccgtacgaggacgggcgcgtcctgagcatgctccgcttctccgacgtgctggcggacacgtcggcgtcgtccccgtcgcagcggttcgtgtcggaggacggcgtgatcaactcccggccgcgcgtgctgggcggcggcagctgcatcaacgccgggttcttcacgcgcgccggcgccggctacgtccgggccgtcgggtgggaccccagggaggtcctggcggcgtaccggtgggtggaggacgtcgtggcgttccagccggcgctgggcccgtggcaggccgccgtgcggcggggcctgctggagaccggcgtgctgccggacaacggcgtcacgtacgaccacatccccgggaccaaggtcggtgggtccatcttcgacgccgacggccggcggcacacggcggcggacctgctccggtactccaaccccgacgggatcgacctattcctccgggccagagtggccaggatcttgttcggttacaaagggaccaagccggtggcgcgaggcgtggtgtaccgcgacgcgcagggcggcacccacgtggcgtacctgaaccggggcgcggccaacgaggtgatcctctcggcgggggcgctgggcagcccgcagcagctgatgctgagcggcatcggcccgggcgagcacctccggtcgctgggcatcgacgtcatcctggacctgccgggcgtcgggcagggcatgtcggacaaccccatgaacgccatctacgtgccgtcgccgtcgccggtggaggtgtcgctgatccaggtggtcggcatcacccgcttcggcagctacatcgagggcgccagcggcgccaactggaacagccacccctccggcaccggcaccggcacgccgcctccccggaacttgggcatgttctctccgcagacggggcagctcgcgacggtgccgccggcgcagcggacgccggaggccatcgcgcgcgccgtggcggccatgagccaggtccccgacgcggcgctccggggcgggttcatcctggagaaggtgctgggcccgcagtcgacgggcagcctcgcgctccgcaacctggaccccgacgacaacccctcggtgcggttcaactacttcgcgcaccccgacgacctccgccgctgcgtcgccggcatctcggccatcgagcggt

SEQ ID NO: 24622 - protein, 457 aa, Panicum virgatum
  misc_feature: Ceres CLONE 1859705
  misc_feature (39)..(323): Pfam Name: GMC_oxred_N Pfam Description: GMC oxidoreductase
  misc_feature: SWISSPROT Homolog: EC 4.1.2.10 Mandelonitrile lyase
MAVFTVACFFALLCMAQQVRAVNYTFMREAVNAPPVAYYDYIIVGGGTAGCPLAATLSQGSRVLLLERGGSPYEDGRVLSMLRFSDVLADTSASSPSQRFVSEDGVINSRPRVLGGGSCINAGFFTRAGAGYVRAVGWDPREVLAAYRWVEDVVAFQPALGPWQAAVRRGLLETGVLPDNGVTYDHIPGTKVGGSIFDADGRRHTAADLLRYSNPDGIDLFLRARVARILFGYKGTKPVARGVVYRDAQGGTHVAYLNRGAANEVILSAGALGSPQQLMLSGIGPGEHLRSLGIDVILDLPGVGQGMSDNPMNAIYVPSPSPVEVSLIQVVGITRFGSYIEGASGANWNSHPSGTGTGTPPPRNLGMFSPQTGQLATVPPAQRTPEAIARAVAAMSQVPDAALRGGFILEKVLGPQSTGSLALRNLDPDDNPSVRFNYFAHPDDLRRCVAGISAIER

SEQ ID NO: 24623 - DNA, 594 bp, Panicum virgatum
  misc_feature: Ceres CLONE 1859746-R
  misc_feature: Encodes the peptide sequence at SEQ ID NO. 24624
caaaataaacatggacggcatccccattggaaggaaaatagacctcgcagcatacgacaactttcagaagctgtcatctgccgtccaagagttgttttctggctttcttgaagctcagaaggacttagactgtactaaaagtggagaacaaggaacggaagagaaactattttctgggttattggatggaaatggcgaatacactttggtttacgaagacgatggagggagcaggacaccagttggggacctaccatggaatgtatttgtttctactgctaagaggctgagggttatgaaaagttcagagcttccccatggcatgattaaaactacctctgggagggcagcagatcattaatatgaggccagtagtccagccattggatcatgcaaactgttttaatcaccggcttccttcatgtgactccttttcgcttgtagagataaatctgataagataaatgctagcatattgcagatgcctaaatgcactgcatattttgtaattttccttgctatttcagatatagctatgcaacatgatctagtaggattactaaacctgaaaaatgtatttttattttttactgt

SEQ ID NO: 24624 - protein, 119 aa, Panicum virgatum
  misc_feature: Ceres CLONE 1859746-R
  misc_feature: The sequence is a functional homolog of SEQ ID NO 1757 in the 11/479,226 US patent application
  misc_feature: Useful for making plants with altered alkaloid content
KINMDGIPIGRKIDLAAYDNFQKLSSAVQELFSGFLEAQKDLDCTKSGEQGTEEKLFSGLLDGNGEYTLVYEDDGGSRTPVGDLPWNVFVSTAKRLRVMKSSELPHGMIKTTSGRAADH

SEQ ID NO: 24625 - DNA, 1116 bp, Panicum virgatum
  misc_feature: Ceres CLONE 1859746
tccgccacagataacagcctacttgcttgcttcaggccttcagctggctagccggcagcgcctctcacggcctcgctccacgtctccacctcacctcatctgggttctcgagttcttcgggtctggtctttttctttttttcgcgaccgtgcgtgagcacgtttttcacgaagaggttacttcgggtctggtcgggtctggtcaggtgactgcagctggtcggtgagttcttcttggctccttggtctctgctgaattgaattttcttgccgtacgattcagttcgagaaggcctgtgaagaactagagaaacctccctcgtctggatcgactcgagaactgacgttagagtctcgattggtgtctgaactctcaagtgaccttttgctgatcctttcctctgctagcttgagcacctactccaagaacacgctttcgttgcttgacgccagctcgagagggttttgctgtctcctcgccggataggatgagctcccgggaatgcctttgacgtgatttgatttggtgacagcacgagtcatgtgtcttttcccagcttttctcttcccggctcgcgttcactttgaccttggaattgcataaatcgcacgtttgtttcacactttctccgtcccaagtagagtgcgagactcagcttttcaagtagcagcttacttgtactcctcccaactcccccgtcaaatgttatctaaagccctggctacacactaccaccatccacatatttatatgcaaattgaaggtctgttttcctcctgtgcctctcctagatcaagtgccatggaggaagactccagagggagagctccttccactcctcaactgctaaacctcatccgaggcgagggagaatggaaggtggttagggaggcagcagatggagggagatcgtcaagaaccacaagctctgaagccgaggaggacacgaagctggagctgaagctcggcctccctggtgtccaggaggaagagagaccagccggccccagagagaagatgcagcaagaacaggagagctgcacggcactctcccttggttgcttccgatcacattcgagactcgccactagcactgccactgccactgccacaggg

SEQ ID NO: 24626 - DNA, 2428 bp, Panicum virgatum
  misc_feature: Ceres CLONE 1859752
  misc_feature: Encodes the peptide sequence at SEQ ID NO. 24627
aactctgcaacaatggctcctcttgcaactctccttgctactgcttccatcctctctttctttgctctgttcccaaaagctgcatcccgtgacactctatcaccgggttcatctctcagggttgaatcctaccaaaccaacatcttgcaatcatcagatggcactttctcctctggcttctatgaagtctataccaacgccttcacattttcaatatggtactcaaaggcagccagcaggaccattgtctggagcgcaaaccctgaccgccctgtacatgccaggaggtcggctataaccttgcagaaggatggcaacatggtccttacagattatgatggaacagtcatgtggcaagctgatggcaacttcacaaatgttcaacatgctcatcttttgaacactgggaatctcatcatcaaggactcaagaggtaacattgtctggcaaagttttgattcaccaacagacactttcctaccaacacaacacatcactgataccacaaagctagtccctacaactcaatcgcatagtcctggtaactatatcttccgattcagtgaccaatcagcactttcacttatatatcatgtgcctgaagtttcggatatatactggccagaccctgatcaaagtctctacgaggttggccgaaaccagtataataatacaaggttgggaatcctcagtgagagtgggatgcttgcatcgagcgattttgcagatggccaaccacttgtagcctctgatgaagggccaagcatcaagagaaggttaactcttgatcccgatggtaatctccgtctgtatagcctgaatgattcagatgggtcatggtcagtttcaatggtagcaatgtcccgaccttgcaatattcatggtttgtgtggtcctagtggaatctgccattactcacctaaacctacatgttcatgcccaccaggttatgtgatgagaaacccaggtaactggactgaaggttgtatggctagcgttaacataacatgtgatcattatgacaaaaaatctgtgaagtttgtaaaactcccaaacacggatttttgggggtcagatcagaaacatcgtctgtcagtttcttttcatacttgtaggaatatttgcatcagtgactgcacctgtaaaggctttcaatataaggaaggtacaggatcgtgctatccaaaagcttatcttttcagtggaagaacttacccaacaaaggatgtaaggactatatatctcaagcttccaataagtgtgagtgtttcagatgttattccacattccactgtgtttgattctgtgctacgccatctggactgtgatcagatgaacaaaagcatcagagaaccatttccagatgtgcacaagactggtggaggagaatcaaagtggttttacttctatgggttcatagctgcattttttgttgttgaagtttcctttatttcgtttgcatggttctttgttttgagaagagagcttaggccatcagaactatgggcagctgaggaaggttacaaagtaatgactagtaattttcgaaggtatagttaccgagaacttgtcaaggcaactcgaaagtttaaagttgagctaggaaagggaggctcagggactgtatacaaaggtgcccttgaagatgataggcaagtggctgtgaagaagctggaaaatgtaaagcaaggcaaggaagagtttcaagctgagctaagtgtaattgggaggatcaatcacatgaatcttgtgaggatatggggcttttgttcagaaggatctcataggttgttggtttctgaatatgttgagaatggatcactggctaacattttgttcaatgacaaaaacaacatctttttggattggaagggacggtttaatatcgcgttaggcgttgcaaaagggttagcctatcttcaccatgagtgcttagagtgggtcatccattgtgatgtgaaacctgagaacatactgttagatgaaaatttggagcctaagatcactgactttgggttggcaaaattactaaacagaggtgagtcaaaccagaacgtttcccatgttagaggaacattaggttacattgctcctgaatgggtatctggtctccccatcacagcaaaagttgatgtatacagctacggagttgtgctccttgagcttttatcaggtaccagagtttcagagttggttgaaggttcagaggaggttcataatatgcttaggaagcttgtcaggatgctttctgaaaaactggaaggggaagaagaatcgtggattgatgagtttgtggattcgaaattggaccagccagtcaactacgtgcaagcaagaacactaatcaaattggcagtgtcctgcttggaggaagacagaagcaagagaccaaccatggaatatatagcaaagaccctcctggaagctg

SEQ ID NO: 24627 - protein, 805 aa, Panicum virgatum
  misc_feature: Ceres CLONE 1859752
  misc_feature (524)..(802): Pfam Name: Pkinase Pfam Description: Protein kinase domain
  misc_feature (75)..(181): Pfam Name: B_lectin Pfam Description: D-mannose binding lectin
  misc_feature (206)..(321): Pfam Name: S_locus_glycop Pfam Description: S-locus glycoprotein family
  misc_feature: SWISSPROT Homolog: EC 2.7.11.1 Non-specific serine/threonine protein kinase
MAPLATLLATASILSFFALFPKAASRDTLSPGSSLRVESYQTNILQSSDGTFSSGFYEVYTNAFTFSIWYSKAASRTIVWSANPDRPVHARRSAITLQKDGNMVLTDYDGTVMWQADGNFTNVQHAHLLNTGNLIIKDSRGNIVWQSFDSPTDTFLPTQHITDTTKLVPTTQSHSPGNYIFRFSDQSALSLIYHVPEVSDIYWPDPDQSLYEVGRNQYNNTRLGILSESGMLASSDFADGQPLVASDEGPSIKRRLTLDPDGNLRLYSLNDSDGSWSVSMVAMSRPCNIHGLCGPSGICHYSPKPTCSCPPGYVMRNPGNWTEGCMASVNITCDHYDKKSVKFVKLPNTDFWGSDQKHRLSVSFHTCRNICISDCTCKGFQYKEGTGSCYPKAYLFSGRTYPTKDVRTIYLKLPISVSVSDVIPHSTVFDSVLRHLDCDQMNKSIREPFPDVHKTGGGESKWFYFYGFIAAFFVVEVSFISFAWFFVLRRELRPSELWAAEEGYKVMTSNFRRYSYRELVKATRKFKVELGKGGSGTVYKGALEDDRQVAVKKLENVKQGKEEFQAELSVIGRINHMNLVRIWGFCSEGSHRLLVSEYVENGSLANILFNDKNNIFLDWKGRFNIALGVAKGLAYLHHECLEWVIHCDVKPENILLDENLEPKITDFGLAKLLNRGESNQNVSHVRGTLGYIAPEWVSGLPITAKVDVYSYGVVLLELLSGTRVSELVEGSEEVHNMLRKLVRMLSEKLEGEEESWIDEFVDSKLDQPVNYVQARTLIKLAVSCLEEDRSKRPTMEYIAKTLLEA

SEQ ID NO: 24628 - DNA, 460 bp, Panicum virgatum
  misc_feature: Ceres CLONE 1859752-R
tcctggaagctgatgattgaatggccgaatggactatatgtgtatttcctgcttgaacagagatagaagcaatagaccaactccatatcagctgatcaagctgataataagttgtgtataatatatttcttagacaatatttccggcttttacactaaaataagtaacctgtacagagtatttttggtttgtcagatgaatatgtgatatgtattagaagtcagtgataatcatggaaccagtggcgaaactagtaccgccatggatgaagccaggtaggcgtgcgttcttatctgaatagctgctgttcgctctcacagttgtgaaaagggtgtgttcctcaaactagtttgaagttgcattttctcctttggtgatatctagtagtctgttaccagcacagacttgtaccagtaatttaagtttcctttaagacagatactagtgtctcagttcgatg

SEQ ID NO: 24629 - DNA, 705 bp, Panicum virgatum
  misc_feature: Ceres CLONE 1859767
  misc_feature: Encodes the peptide sequence at SEQ ID NO. 24630
aacatcggcgcaggaaccgccatcgaaagccttggcccttaagcttagccccccaccgacccacctcaccgccgggatttcgaatttttcttacctcgaaaggggaaaatcctggtcttttcttttctctctcgggggagttggcggcggcggcggcggggatcgcgatgggcgccgcgagggaggagggcggcgaggcgtaccggtcgtggtacctgagccgggaggagatcgagcgcgactcgccgtcgcggcgggacggcgtcagcgcggccaaggaggcggagctccgggccacctactgctccttcatccgcgatgtctgcatcaggctccaattgccgcagattacaatcgccacggcgatcctgctctgccaccgcttctacctccgtcaatcccatgctaagaacgagtggcagactgttgcaactgtttgcatatttcttgcttcaaagattgaagacacaccttgctcattaaaaagtgtcatcattgtggcatatgaaacaatgtatcggaaaaacactgatgctgctaagagaatccaccaggaggaagttcttgctaagcagaaatccctaattttggtcggggagacactattgctttcaaccattaggtttgatttcaatatacgtcatccttacgaaccactaaagcttgctctgaagaatctggggatctcccagaaggaagtgaggc

SEQ ID NO: 24630 - protein, 179 aa, Panicum virgatum
  misc_feature: Ceres CLONE 1859767
  misc_feature (13)..(156): Pfam Name: Cyclin_N Pfam Description: Cyclin, N-terminal domain
MGAAREEGGEAYRSWYLSREEIERDSPSRRDGVSAAKEAELRATYCSFIRDVCIRLQLPQITIATAILLCHRFYLRQSHAKNEWQTVATVCIFLASKIEDTPCSLKSVIIVAYETMYRKNTDAAKRIHQEEVLAKQKSLILVGETLLLSTIRFDFNIRHPYEPLKLALKNLGISQKEVR

SEQ ID NO: 24631 - DNA, 2063 bp, Panicum virgatum
  misc_feature: Ceres CLONE 1859787
  misc_feature: Encodes the peptide sequence at SEQ ID NO. 24632
gcctggccgcgattcccagccacgctctctccccccgtccttgtctcgcgccgtggcagcacgtttctctcatctcttcctgttctacctgctttccgctaatcccctccacttccgtcgcctcaacggccccgggggagaatctcttcccagccaatcccaaagtgttctcttgcttcggtgtatatcctaccctctgccccgcgagattctcggctatttctgctgtcctgtgaaattggtgcggttcttgaatctgttctactgctgattcaaagatcctaccttctctgctgtccatttcattgattttcccgaagcctttccgggggttttttttttccttcttctctgcgatttcttccactagagcgcaagaatccgctgctctgcttttgttcggagattcgccatgggcggcggcggcggtggcaacgagcgcttcccggggggaagcgacccgctgctcccgacgaagcgggagggggaggaggacgacgccggcgcctccgcgttccacgagttcgacggggcatccttcgccggcgcggtgttcaacctctccaccaccatcgtcggcgcgggcatcatggcgctgccggccaccatgaaggtgctcggcctcgtgccggggctcgtcatgatagtgctcgccgcgctcctcaccgacgcctccatcgagttgctcgtgaggttcagccgcgccgtgggggcgcggtcctacggcgccgccatgggggatgccttcgggtggtggggcaggaggctgctccaggtctgcgtcgtcatcaacaacgtcggtgttatgatcgtctacatgatcattattggtgatgtgctttctggaactgattctggtggtgaacaccactatggtgttctagaaggatggttcggcatgcactggtggaatgggcgtttctttgttctcctggttacaaccctttgtatttttactccactagcatgcttgaagcgtattgattcattgagctatacgtccacaatatctgtagctttggctgttgtattcgttatcattactgcaggcattgctattgtcaagttgataggtggacaaattccaatgcccaaattgtttccggtggttccagatttggcatctgtttgggaactttttacagcagtaccagttcttgtcactgcttatgtttgccattacaatgttcacccaattcataatgagctaaaggactcttcgcagataaggccaatagtgcatacatcattgacactgtgctcgactatctacatcacaacaagtttctttggatacctcctctttggcgagtctacgctctctgatgtgctctcaaactttgattcaaatcttgggatcccatatagttcagttctaaatgatgctgtcagagtgagctatgctgttcaccttatgctcgtgttccctatgatattccatgcactgcgtcttaatttggatgggcttctcttcgcatctgcaaggcctctgtcttctgacaacagaagatttagtgcaatgacagcagtgctcctcctggtgatttttgggtctgcaaacttcattcctagtatatgggatgcctttcaatttactggagctactgctgctgtttgtattgcctttattttcccagctgcaatcactctaagggatccacaaggtatagcaaagaagtgggacaagattttggctgtcttcatgattgttcttgcggttgtatcaaatgtagtagcggtgtacagcgatgcctacaaaatgttccacaagaaaagtgctccttcccaggcctgaactggaaaatctgctgaagatttgtcttcatggtggtttgtacattagtagtcaataaaagattcatttaaaggtttcatgtgattgattttgataatttgtttcacgggcaaggtcgactcaatcatgttgagtttcatgtatgtatgtatactaggatgcacaaaccgttagagttcagactgaagtgcttcggtacagtataaaaagcggggcagttgtgtcaaatgtgaaattatagagttattattatggacttccttttgcg

SEQ ID NO: 24632 - protein, 460 aa, Panicum virgatum
  misc_feature: Ceres CLONE 1859787
  misc_feature (39)..(445): Pfam Name: Aa_trans Pfam Description: Transmembrane amino acid transporter protein
MGGGGGGNERFPGGSDPLLPTKREGEEDDAGASAFHEFDGASFAGAVFNLSTTIVGAGIMALPATMKVLGLVPGLVMIVLAALLTDASIELLVRFSRAVGARSYGAAMGDAFGWWGRRLLQVCVVINNVGVMIVYMIIIGDVLSGTDSGGEHHYGVLEGWFGMHWWNGRFFVLLVTTLCIFTPLACLKRIDSLSYTSTISVALAVVFVIITAGIAIVKLIGGQIPMPKLFPVVPDLASVWELFTAVPVLVTAYVCHYNVHPIHNELKDSSQIRPIVHTSLTLCSTIYITTSFFGYLLFGESTLSDVLSNFDSNLGIPYSSVLNDAVRVSYAVHLMLVFPMIFHALRLNLDGLLFASARPLSSDNRRFSAMTAVLLLVIFGSANFIPSIWDAFQFTGATAAVCIAFIFPAAITLRDPQGIAKKWDKILAVFMIVLAVVSNVVAVYSDAYKMFHKKSAPSQA

SEQ ID NO: 24633 - DNA, 1104 bp, Panicum virgatum
  misc_feature: Ceres CLONE 1859825
  misc_feature: Encodes the peptide sequence at SEQ ID NO. 24634
aatgaactctcgccatgccgcacacgacacgcacaaaatacaaaaatatcgtcgatcacctcacgtactagtttgaatgaatttcatttcataataatcactagtagcttttgcatttgcagcccgagcaaggaggcaaaagctagccaaatggaaatgcagccactctccctgctggcctcatggcctctcctcctcgtcctgctcctcctccccctcgtctgcttgctgtacctgcgccagcaggatcacggcagcaagcagcagcagcagccatcggacgacgacctcaagtcctacccgatcgtcggcaggttccctcacctggtcaagaacggccaccgcctcatcgaatggtcggtcgaggtcgcgaagcggagcccgacgcagaccacggccttcaaggccctcggcctgcccggcgtcgtcatcaccgcccacccggacaacgtcgagcacatcgccaagacgagcttcgccatctaccccaagggcgactacatgtcgtcgacgctcgaggacttcctcggccgcggcatcttcaactccgacggcgagcagtggctgtggcagcgcaaggccaccagcttcgagttcagcaaccgctcgctgcgcaagttcatcgtcgacaccgtccaggccgaggtcgccggccggttcctgccgctgctcgagcaggccgagcgccacggccgcgcgctggacatgcagcacgtcttcgagtgcttcgccttcgacaacatctgccacgtggccttcggcgacgacccgggctgcctcgccgtggaggccggcggcgcggcggcggcgccaccccagggcccggagttcgcgcgcgccttcgactacgtggagggcgccatcctgggccggtttaacccgctggcgacgttcctgtggcgcctcaagagggcgctcaacatggagcccgagaggcagatccgcgaggcgctcggcgtcgtccacgcctacgccgacaggatcgtccggaggtgccgggagaggagggaggccgccggcggggccgggccgccggagagcaggggcgacttccgggcgcacatcgccgcccgcgaggacctcagcgacgagagcctccgggac

SEQ ID NO: 24634 - protein, 317 aa, Panicum virgatum
  misc_feature: Ceres CLONE 1859825
  misc_feature: SWISSPROT Homolog: EC 1.14.14.1 Unspecific monooxygenase
MEMQPLSLLASWPLLLVLLLLPLVCLLYLRQQDHGSKQQQQPSDDDLKSYPIVGRFPHLVKNGHRLIEWSVEVAKRSPTQTTAFKALGLPGVVITAHPDNVEHIAKTSFAIYPKGDYMSSTLEDFLGRGIFNSDGEQWLWQRKATSFEFSNRSLRKFIVDTVQAEVAGRFLPLLEQAERHGRALDMQHVFECFAFDNICHVAFGDDPGCLAVEAGGAAAAPPQGPEFARAFDYVEGAILGRFNPLATFLWRLKRALNMEPERQIREALGVVHAYADRIVRRCRERREAAGGAGPPESRGDFRAHIAAREDLSDESLR

SEQ ID NO: 24635 - DNA, 1230 bp, Panicum virgatum
  misc_feature: Ceres CLONE 1859828
  misc_feature: Encodes the peptide sequence at SEQ ID NO. 24636
tgtttatagatgacctcaactccaagtgaccaagcgagcagctgttgaacaatttccttttatttctgtttctttttcctggatttggagatggaggtgaattcctctggtgaggaaatggtggtaaaggtaagaaagccgtacacaataacaaagcaacgcgagcggtggactgaggcagagcacaaacgcttccttgaagccttgaaactttatggcagagcatggcagcgcatagaagagcatgttgggacaaagacggctgtgcagattagaagtcacgctcaaaagttcttcaccaaggaagatgaaatttctgaagaggtctcatggccggatatattaatcagtaaggatcttgagtgtcttgcctttcatagaagtagcctcaaaagatctggtgctatcatgtgcatggatagtgttatgcacgagttcaatgtgcctcagttggaaaaggaagctatgaacaatggtacttctccggggcaagctcatgacattgacatacctcccccacggcctaaaaggaagcctaacagtccgtatcctcgaaaaagtggtctcagctctgagacaccatcgaaggaagttccaaatgataagtcmmcaaaatcaaatatgacagtaggcaatggcaatgtacaaatggcaggcgatgcatctctgcagaaatttcagaggaaggaggtgtctgaaaaaggaagctgctcggaagttcttaatctcttccgagatgccccatctgcatcattttcttcagttaacaaaagctcttcgaataatggtgtacccagggggattgaaccaaccaaaaaagaaatccgagatgtgactaccatggaaaagaattcaattagtcccaccatgcaagaggatgtaaaagagataaatgatcaggaaatgggaagggttaatggaatccatgtcagttctaaatgtgaccattctaatgaagaatatttggagacaacatatgtggacaaacaaactgcaagaacttcacataccctggtggagaggaatggtgcaactagcattcctgtcactggaaccaaaggaactcatcctgatcaaacaagtgatcaagtgggagtcaatggaagtatgaatccatgcatccatccaatgctttctatggatccgaaatttgatagcagtgccacaccacagtcttttgctcataattatgctgcctttgctccgatgatgcagtgcaactgcaagcaa

SEQ ID NO: 24636 - protein, 379 aa, Panicum virgatum
  misc_feature: Ceres CLONE 1859828
  misc_feature (24)..(69): Pfam Name: Myb_DNA-binding Pfam Description: Myb-like DNA-binding domain
  misc_feature (174)..(174): Xaa is any aa, unknown, or other
MEVNSSGEEMVVKVRKPYTITKQRERWTEAEHKRFLEALKLYGRAWQRIEEHVGTKTAVQIRSHAQKFFTKEDEISEEVSWPDILISKDLECLAFHRSSLKRSGAIMCMDSVMHEFNVPQLEKEAMNNGTSPGQAHDIDIPPPRPKRKPNSPYPRKSGLSSETPSKEVPNDKSXKSNMTVGNGNVQMAGDASLQKFQRKEVSEKGSCSEVLNLFRDAPSASFSSVNKSSSNNGVPRGIEPTKKEIRDVTTMEKNSISPTMQEDVKEINDQEMGRVNGIHVSSKCDHSNEEYLETTYVDKQTARTSHTLVERNGATSIPVTGTKGTHPDQTSDQVGVNGSMNPCIHPMLSMDPKFDSSATPQSFAHNYAAFAPMMQCNCK

SEQ ID NO: 24637 - DNA, 1771 bp, Panicum virgatum
  misc_feature: Ceres CLONE 1859829
  misc_feature: Encodes the peptide sequence at SEQ ID NO. 24638
aaacttctccgctcgttgagctctccggccactacactgcaatatgggctactccaacaccatgttggctctgctcacacttgcatccctgtgggcggcagaagcacgagcatcagcagttgcaaggagagggtctcttcgccacctggccaccgtccacaaagccatggccagaaggttagagactagcagatccctgcaaagccatggtgcccgtacaacttcttccaatggcaccacccttccctcggctgccacgctcgcgggctgcccaacgagctgtggcaacctgagctttgagtacccattcggcgtaggacctggttgcttccgaggtcctgacttcaggctcttttgcaacagcaccggtcagcctcctaaactgttcttacacgacggcaccatagaggttttagacagtattgaggtagccagtggttttgatctccttgatatcatgagctacaaccttcttgatgtctccttttcccaaacaatccccataagatccagagttcatgtctacaacatgtcactcaagcctccagggaattccttttcgattatcaaaatgggcatgttagttgaagttgacgtcattggctgggatttggatgtactcttaaaagatcaggacacaggttcttttagcccactttcactttgcgctaccgtccccaacgaaacggttgcagagatgctgtacatggaggattgtggtgtcggcggtgacatgttttctgaaacacctgttcaagctcttgagttccaatttgtgcctcacaaaagaggtgtgactgaaaaagtctctaattcgagcatcctatgggatcgaatcaacataactgtcatggttccactgatgtggagcatcaccgaccacacgagatgccccaaggaagaagaagacaggaggaggagcgcttgtgttagcgagcacagccattgcgagagttcatttcttcgggatgctggttatgcctgccggtgcgacaaaggatacctgcaggggaatccttacatcctcgatggctgcacccctgatgaagggtataatccgaaaccgatgaaggaggattgttctcacctgtgtgggaacattactgtcccatttccttttggcctagaagaaatttgctctgcaaggagacttttccagctcaactgctctgacccagcacattcggtcctccaatacaatgacctctttcgtgtgactaacataaatgtgacagagggtcttgtcggcatcaaaatcaactcaagtttggtagacagggaattcagtatggtactgaagatgatgacatcttccaaagaacctgacctgtttgttgatcctttggaatcagcctctttccagtgggctgttgctaatctgacctgccaacaggcgaaacagaacgcatctggatatgcttgtgtgagtaacaacagcacttgcataagtgtcataagctcctcaaaaggctatgttggctaccggtgcaaatgctcaactggttttgaaggaaatccgtacatcgaacatgattgtcacgatattgatgaatgtcggcaaacaccggggatttgcgaaggtatttgccacaatactattggaagcttcacttgcaccaagtgtcctggtcaaacaatttatgatgctaaaacaatgcagtgtatctcaacaccaaagagaaatctcatcctaggtattataattgggcttagttgtggttttggcattcttctttttggcttaagtgcattcgtgctcattcaaagatgg

SEQ ID NO: 24638 - protein, 575 aa, Panicum virgatum
  misc_feature: Ceres CLONE 1859829
  misc_feature (500)..(540): Pfam Name: EGF_CA Pfam Description: Calcium binding EGF domain
MGYSNTMLALLTLASLWAAEARASAVARRGSLRHLATVHKAMARRLETSRSLQSHGARTTSSNGTTLPSAATLAGCPTSCGNLSFEYPFGVGPGCFRGPDFRLFCNSTGQPPKLFLHDGTIEVLDSIEVASGFDLLDIMSYNLLDVSFSQTIPIRSRVHVYNMSLKPPGNSFSIIKMGMLVEVDVIGWDLDVLLKDQDTGSFSPLSLCATVPNETVAEMLYMEDCGVGGDMFSETPVQALEFQFVPHKRGVTEKVSNSSILWDRINITVMVPLMWSITDHTRCPKEEEDRRRSACVSEHSHCESSFLRDAGYACRCDKGYLQGNPYILDGCTPDEGYNPKPMKEDCSHLCGNITVPFPFGLEEICSARRLFQLNCSDPAHSVLQYNDLFRVTNINVTEGLVGIKINSSLVDREFSMVLKMMTSSKEPDLFVDPLESASFQWAVANLTCQQAKQNASGYACVSNNSTCISVISSSKGYVGYRCKCSTGFEGNPYIEHDCHDIDECRQTPGICEGICHNTIGSFTCTKCPGQTIYDAKTMQCISTPKRNLILGIIIGLSCGFGILLFGLSAFVLIQR

SEQ ID NO: 24639 - DNA, 2133 bp, Panicum virgatum
  misc_feature: Ceres CLONE 1859834
  misc_feature: Encodes the peptide sequence at SEQ ID NO. 24640
attttcgtcttggtaggatcgcaacctgcccgctcgtactcgctcgccccccagccgccttcctcccccttcctccgttgtctccccggtttccccgattccttcgccggctcgttttttttcctggcaattcgctgcgcgggcaatcgcagccggctcctgggggcagcagctacaggccaggcttctcttcgaggacaggcctcgcccgccgcctcccggcccctctccgcgggcgccgtggagcggagatccatccggacgtggatcggtctcgcctcctgataacagctattgttccactgccactttgagcaatatgggttggctgacgaagttttttagaggttcaacccacaatatctcggaaggtcagtatcacagcaggcctgcagaagagacagcatggaatgaaccctcgagctctcctgttgttactgacttcctttcagattttaacaatgaggatattgaccgtgctatagcgctctctctatcagaagaagaaaaaagaaaggcaaaggcaatagacaaggatatgcatttggaggaagatgagctacttgcaagagctatccaggaaagtttgaatgttgaatcaccacctcgcagaaatggcagtgccaatggaggcaatacatatcatctgcctcgtgaacctggcatcaccaatggtggcaatacatatcaaccacctcgcgaaaatggcactgccaatggtggcaatgcatatcaaccattaccatttatgttctcatctggattcagggcatgcgcaggatgtcaccgagagattggtcacggtcgttttctcagttgcatgggtgctgtttggcatccagaatgttttcgttgccatgcctgcagtcaaccgatatatgactatgagttctccatgtcggggaatcatccgtaccataaaacttgctacaaagagcagtttcaccccaaatgtgatgtctgcaaacaatttattcctacaaatatgaaaggccttattgaatatagggcacatcctttctggctacaaaaatactgcccttcacatgaagtggatggtactccaaggtgctgtagttgtgaaagaatggagccaagggaatcaaaatatgtattgctggatgatggtcgtaagctctgcctggagtgccttgattctgcagtaatggatacaagcgagtgtcaacctctgtatcttgaaatccaggaattttatgaaggtctgaatatgaaagtggaacagcaggttcctctgcttctggtagagagacaggctttaaatgaagccatggaaggagagaaggctggtcaccatcatcttccagaaacaagaggactgtgcttatctgaagaacagactgttagcacgatactgaggagaccaagaatggctggaaacaaaatcatggaaatgataacagagccatataggctgacaaggcgatgtgaagtgactgcaattctcattctgtatggtcttccaaggttgttgacgggttccattttagctcatgagatgatgcatgcatggttgcgacttagaggataccggacattgagtccagacgtagaagagggcatctgccaagtccttgctcacatgtggatagagtcagagattatggcaggatcaggcagcagtgctgcatcatcgtcctcaggttcttcaacgtccagatcatcgaagaaggggggacggtctcagtttgagcggaagcttggggattttttcaagcatcagattgagacggacacatccatggcctacggagagggtttcagagccgggaaccgggccgtcatgcagtacggcctgaagcgcaccctcgagcatatccggctgacagggaccttcccattttgaaacggcatggatggattcacattttggcgagaagcttacatcacatacatgattgtcatttggagttcctttacagccaaagaaatcaactgtacaaacattctttccggaatccagatacatcttggaagggctaactgaagcattggatgagtcgtgatggccagcctgaccaatcattttgtattgtattgtaaccaaactgtggaacgaaaacaatggtatatctgttacatggtgtgaatttcaataagaaaaaaatagttccg

SEQ ID NO: 24640 - protein, 514 aa, Panicum virgatum
  misc_feature: Ceres CLONE 1859834
  misc_feature (152)..(208): Pfam Name: LIM Pfam Description: LIM domain
  misc_feature: SWISSPROT Homolog: EC 2.7.11.1 Non-specific serine/threonine protein kinase
MGWLTKFFRGSTHNISEGQYHSRPAEETAWNEPSSSPVVTDFLSDFNNEDIDRAIALSLSEEEKRKAKAIDKDMHLEEDELLARAIQESLNVESPPRRNGSANGGNTYHLPREPGITNGGNTYQPPRENGTANGGNAYQPLPFMFSSGFRACAGCHREIGHGRFLSCMGAVWHPECFRCHACSQPIYDYEFSMSGNHPYHKTCYKEQFHPKCDVCKQFIPTNMKGLIEYRAHPFWLQKYCPSHEVDGTPRCCSCERMEPRESKYVLLDDGRKLCLECLDSAVMDTSECQPLYLEIQEFYEGLNMKVEQQVPLLLVERQALNEAMEGEKAGHHHLPETRGLCLSEEQTVSTILRRPRMAGNKIMEMITEPYRLTRRCEVTAILILYGLPRLLTGSILAHEMMHAWLRLRGYRTLSPDVEEGICQVLAHMWIESEIMAGSGSSAASSSSGSSTSRSSKKGGRSQFERKLGDFFKHQIETDTSMAYGEGFRAGNRAVMQYGLKRTLEHIRLTGTFPF

SEQ ID NO: 24641 - DNA, 1849 bp, Panicum virgatum
  misc_feature: Ceres CLONE 1859836
  misc_feature: Encodes the peptide sequence at SEQ ID NO. 24642
aatctgccttttgaaattggtcgacgtctccctcgcccctacgagctcgatcgttccttgcaacttccttgctcaccgatcgccaccggccgtcgcgcgtcagggcgcgcggctccatcaaaaaggttgcgcgcgcgtggagccatgcagcaggagctatagcatctgagagtatcgatcgatccgcaggcagcagatcgatcgcgccggagcgtggcggttggttgccggcggtagatcgaacgccagcatgcaggcgaacggccgcggcgagcagcactcgccgaggtcggcggcggccggctggccgtccccgcgcggcggcgggggcgagcattactccccgtcgccgtccaagaccccgcgcggcggcgcggcgtcgccgaagctgccggccagcgcggcgtggctggtggacagccggtgggcgctctcggccgcgctcagcctgctgctgttcctggccgtcgggctcgccgtgacgtccttctcctcctcgtcgtcggcgccgccgtacatctccgcgtcggccttcttctcctcctccgaccaggcccatcacgtgcacgccgccgacttggtgcaggagggcgtccacgtgagccagcagcagcagcagccggagtcccttgcctccccgccgccgccgcccggcgccgacctgccgcggctggcgtacctgatctccgggtccaagggcgacctggagcggctgtggcgcgcgctgcacgcgctctaccacccgcggaaccagtacgtggtgcacctggaccgcgaggcccccgtgtcggagcggctggcgctggcggcccgcgtgtccaacagcaccgtgttccggcgcgccggcaacgtccacgtcgtccaccgcgccaacatggtgacctaccgcggccccaccatggtggccaacacgctgcacgcctgcgccatcctcctccgccgcggcggcgcctgggactggttcatcaacctctccgcctccgactacccgctcatgacccaggacgacatcctgcaagtcttctcgacggtgcccagtaacgtcaacttcatcgagcacaccggttacctaggctggaaggaggggcagcgggcgcgtcctctgatcgtggaccccgggctgtacgggtcgaagaagcaggacatcttctgggcgtcgccgaagcgggagctccccacggcgttcaagctcttcacggggtcggcgtgggtggcgctgtcgcgggacttcgtggagtacacggtgtggggctgggacaacctgccgcggacgctgctcatgtactacgccaacttcgtctcctccccggagggctacttccagacgctcgtctgcaacgcgccccgcttcgtgcagaccgtcgccaaccacgacctccaccacatccagtgggacgtgccgccgcgccagcacccgcacgcgctcgcgctcgccgacctgccggccatggtgcgcagcggcgcgcccttcgccaggaagttccccagggacgaccccgtgctcgacgccatcgacgccgagctcctcggccgcccgccgccgccgcgcggcggcaacggcaccgcccccgcggcggcggcggcgacgttcgtgcccggcgggtggtgcggcggcgacgcgagctgcggcggcgtggacaacgactgggtgctcaggcccgggcccggcgccgagaggttccagaggctcatcgaaaggatcgtcaggtccgaggccttccccaacaggcagtgcaagtagtgctagatcatacataccgtgtgcgttttgttaccttctggatcctctcgtcagtgtacaaacaaacaccaacagattggaacatgtaatagagatgatgatcatagc

SEQ ID NO: 24642 - protein, 496 aa, Panicum virgatum
  misc_feature: Ceres CLONE 1859836
  misc_feature (141)..(366): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MQANGRGEQHSPRSAAAGWPSPRGGGGEHYSPSPSKTPRGGAASPKLPASAAWLVDSRWALSAALSLLLFLAVGLAVTSFSSSSSAPPYISASAFFSSSDQAHHVHAADLVQEGVHVSQQQQQPESLASPPPPPGADLPRLAYLISGSKGDLERLWRALHALYHPRNQYVVHLDREAPVSERLALAARVSNSTVFRRAGNVHVVHRANMVTYRGPTMVANTLHACAILLRRGGAWDWFINLSASDYPLMTQDDILQVFSTVPSNVNFIEHTGYLGWKEGQRARPLIVDPGLYGSKKQDIFWASPKRELPTAFKLFTGSAWVALSRDFVEYTVWGWDNLPRTLLMYYANFVSSPEGYFQTLVCNAPRFVQTVANHDLHHIQWDVPPRQHPHALALADLPAMVRSGAPFARKFPRDDPVLDAIDAELLGRPPPPRGGNGTAPAAAAATFVPGGWCGGDASCGGVDNDWVLRPGPGAERFQRLIERIVRSEAFPNRQCK

SEQ ID NO: 24643 - DNA, 1274 bp, Panicum virgatum
  misc_feature: Ceres CLONE 1859838
  misc_feature: Encodes the peptide sequence at SEQ ID NO. 24644
aggggcatgtgaaggtcacagtccatcgcaacttcgcaagggccttggcgctgcttgagcaccagcaccggcctcgatcactcactctcactgctccccaaagtacaaagggctagcttgttctctgccagctctctgcagcttgcctgccatggcgaccacagcgccagcagtggataggaaggcagatggagatgagcagggtagtaggaggaggaggaagagaggcttcaggaccatgccgctcatactagcgagcgaggtctgcgaccggttcgccatggccggcttcaacgccaacctgatcacgtacctgacgcagcagctgcacctgccgctggtggaggcgtccaacacgctgaccaacttcggcggcacgtccgcgatgacgcccatcctgggcgcgctcgccgccgactccttcgccggccgcttctggaccatcatcgccggctccgcgatgtaccaggtcggcatggtcggcctcgtcgtgtccgcgctcctccctcggctgcgcccgccgccgtgctccccgccggccaccccgtgccagcgcgcctccgggttgcagctcgcggtgctgtacctctcgctcctctgcacctcgctgggctccggtggcatccgcccctgcgtcgtggcgttcggcgccgaccagttcgagcaggagcagcaggacaaggcggcggcggagcggaagcgccgctacttcaacctctacttcttcaccatggggctcgccatgctgctggcgttcacggtggtggtgtacatccaggagaacgtgggctggggctggggcttcgggatcccggccctcggcatgctcgtctccatcgtggtgttcctggtcggctacccgatctacgtgctgctcaagcccggcggcagcccgttcacgcggctcgcgcaggtcgtcgccgccgcgttcaggaagcggagcgtcgccgtgccggaggaccccggcatgctctaccaggacaaggagctcgacgcgctcatctccaccaacggcaggctgctgcacaccaaccagctcacgttcttcgaccgggcagccatagtgacgccgggcgacgtctccgactccgggcagccgaagctgtggcggctgtcgacggtgcaccgcgtggaggagctcaagtccctcgtccgcctgctgcccatctggtccgccggcatcatgctcgccaccgccggctcgcacaactacacctttcacatcatgcaggcgcgcaccatggagcgccacatcgggccccacttccagtttc

SEQ ID NO: 24644 - protein, 374 aa, Panicum virgatum
  misc_feature: Ceres CLONE 1859838
  misc_feature (95)..(374): Pfam Name: PTR2 Pfam Description: POT family
MATTAPAVDRKADGDEQGSRRRRKRGFRTMPLILASEVCDRFAMAGFNANLITYLTQQLHLPLVEASNTLTNFGGTSAMTPILGALAADSFAGRFWTIIAGSAMYQVGMVGLVVSALLPRLRPPPCSPPATPCQRASGLQLAVLYLSLLCTSLGSGGIRPCVVAFGADQFEQEQQDKAAAERKRRYFNLYFFTMGLAMLLAFTVVVYIQENVGWGWGFGIPALGMLVSIVVFLVGYPIYVLLKPGGSPFTRLAQVVAAAFRKRSVAVPEDPGMLYQDKELDALISTNGRLLHTNQLTFFDRAAIVTPGDVSDSGQPKLWRLSTVHRVEELKSLVRLLPIWSAGIMLATAGSHNYTFHIMQARTMERHIGPHFQF

SEQ ID NO: 24645 - DNA, 645 bp, Panicum virgatum
  misc_feature: Ceres CLONE 1859838-R
tggcgttcagggagttcctgtacgaccaggcgcccgagagcatgcgcagcagcgccgtcgcgctcttctggctcgccagcgccatcggcaactacatgggcacggtgctcgtcacggtggtgcagcgcgtcacgcgcggccatggcgagtggctgcaggacaacatcaaccgcggcaggatcgacaactactactggctcgtcacctgcatcatgctgctcaatttcggctacttcctcgtctgcttccatttctacaccatgaagccgctggaggtggcggatcatgaacacgacgaccatgacaaggagtacgagctctcatctctccagagaaatggcggaggcgcagccaatgggatggtgtagtgtaattaaggaggattattatatataagacaattaactacaccgtatgttagttaatcacctgcacatgcacaagcattattaaaagttataaagaaattagtgtcttggagctggaattagtgtcacaggaagatacaagcaagtgtgacgatcatgatcgtgatcatgcagccaagagaatcgaggccattgaactatactgtatatagtacatgtattgtgtctggatcaccgttcactttttattactggagctcgcagatactatcacatc

SEQ ID NO: 24646 - DNA, 395 bp, Panicum virgatum
  misc_feature: Ceres CLONE 1859883
  misc_feature: Encodes the peptide sequence at SEQ ID NO. 24647
actcttcccccatcccaccacccctcctggtgcggtcgcctcgacccatcccaagcagcaggtttcctgctcaacggcagccttcaccacgcctggcagccattcgggggaacaccgctctgacaggcggtgcccactgccacctccggtccctgatgcccccagcgctgctcgcttaatgtccaccgagcctttcgctggcggccgtgcctggggaagtggcgagcagactgtgagacaagcaataacccacttcggagacggtactgaagcaaggatcatgacagaccggcatactggtccatccacagggtttggatttgtgaaattcaccaccagtgatgatgccacggcggctatgagccaaatggatggcccggaaatggaagggccgg

SEQ ID NO: 24647 - protein, 72 aa, Panicum virgatum
  misc_feature: Ceres CLONE 1859883
  misc_feature: SWISSPROT Homolog: EC 5.2.1.8 Peptidylprolyl isomerase
MSTEPFAGGRAWGSGEQTVRQAITHFGDGTEARIMTDRHTGPSTGFGFVKFTTSDDATAAMSQMDGPEMEGP

SEQ ID NO: 24648 - DNA, 599 bp, Panicum virgatum
  misc_feature: Ceres CLONE 1859887
  misc_feature: Encodes the peptide sequence at SEQ ID NO. 24649
gcaatctcaatagacaacataacacactacaaataccgttccctccaatacatcatctacattgcgagcatgttgtcgcttcactgatgatgctttggcaatggttgtgacaactctgactgtcatgggtatgaccctggtacttgctttgctgttttgccgtctcctcaaatggagcagctttggacggcaacggtgtgacaagaatttgccgcctggctcgtttggcctgcctctccttggagagacgctccagttcttcacctggagctcatcacttgacatgttcccattcttcaagaaacgaatgcagaggtatggttctattttcaaaacaaacttggtagggaaggacctgatcgtctcccttgaccccgaactcaacaacttcgtgttccaacaggaggagaaagccttccagatatggtatcctgagtcattcatgagactcctaggtgacgaaaacatcatctcttcagtcggttccttccacaagcatataaggaatatggtccttcaagtcttcagacctgagaaccttaagctgctgttgttgaaagatatgcaccacgcaatgaacaagagtttggcctcctggc

SEQ ID NO: 24649 - protein, 166 aa, Panicum virgatum
  misc_feature: Ceres CLONE 1859887
  misc_feature: SWISSPROT Homolog: EC 1.14.13.93 (+)-abscisic acid 8'-hydroxylase
MVVTTLTVMGMTLVLALLFCRLLKWSSFGRQRCDKNLPPGSFGLPLLGETLQFFTWSSSLDMFPFFKKRMQRYGSIFKTNLVGKDLIVSLDPELNNFVFQQEEKAFQIWYPESFMRLLGDENIISSVGSFHKHIRNMVLQVFRPENLKLLLLKDMHHAMNKSLASW

SEQ ID NO: 24650 - DNA, 1325 bp, Panicum virgatum
  misc_feature: Ceres CLONE 1859932
  misc_feature: Encodes the peptide sequence at SEQ ID NO. 24651
  misc_feature (361)..(361): n is a, c, t, g, unknown, or other
acgctgctcctcgcctcctctagcgccggcgacgcctcccctcggctgtgtctatcctataaataagcatcccccagctcgcttctccctttttcctttccccatttcccgtttctcgtgtcgccgtcgtcgcgactcgcatcgagattcgcgcggccgttgtcctgctcggcgctgctgtggcctgctgctgctcctcctcctcctcctctcgacctctccttgcctcggtagcgtccgcgcccagatctctcgctcgctcgccggcgccccgggctagatctgggcggagcggggaggcggggggggcggccggagcgcggtgagccggtgaggctcggaggaggaaggggaagggggnggagggggagggcaacagcgagcgagcgcgcgcgcgccatggagctggcggtgggaggcgggatgcggcgctcggcgtcgcacacctcgctgtcggagtcggacgacttcgagctcacgcgcctgctcagcaagccgcggatcaacgtcgagcgccagcgctccttcgacgaccgctcgctcagcgacgtctcgcactcgggcggctacggtaggggcggcgccttcgacggcatgtactcgccggggggcggcctccgctcgctcgtcggcacgccggcctcctccgcgctccactccttcgagccgcaccccatcgtcggcgacgcctgggaggcgctccgccgctccctcgtcttcttccgaggccagcccctcggcaccgtcgccgccgtcgaccacgcgtccgaggaggtccttaactacgaccaggtgtttgtgagggatttcgtgccgagcgcactggcgttcctaatgaacggcgagccggatatcgtcaggaacttccttctcaagaccctgctgctgcagggctgggagaagaaagtcgaccggttcaagcttggggaaggagccatgccggcgagcttcaaggtgatgcatgacgcgaagaagggtgttgaaaccctacacgccgattttggggagagcgcgattgggagggttgcgccggtggattccgggttctggtggatcattctcctgcgggcctacacaaagtccaccggggacttgacgctagcagagacacctgagtgccagaaagggatgaggctcatactgagcctgtgtctgtccgaggggtttgataccttcccgacattgttatgtgccgatggttgctgcatgatagatcgcagaatgggtgtatatggctaccccatagaaattcaagcacttttcttcatggcacttaggtgtgctcttcaaatgcttaagcatgataatgaaggggaaggagtttg

SEQ ID NO: 24651 - protein, 308 aa, Panicum virgatum
  misc_feature: Ceres CLONE 1859932
  misc_feature (85)..(308): Pfam Name: Invertase_neut Pfam Description: Plant neutral invertase
  misc_feature: Useful for making plants with altered carbohydrate content
MELAVGGGMRRSASHTSLSESDDFELTRLLSKPRINVERQRSFDDRSLSDVSHSGGYGRGGAFDGMYSPGGGLRSLVGTPASSALHSFEPHPIVGDAWEALRRSLVFFRGQPLGTVAAVDHASEEVLNYDQVFVRDFVPSALAFLMNGEPDIVRNFLLKTLLLQGWEKKVDRFKLGEGAMPASFKVMHDAKKGVETLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQMLKHDNEGEGV

SEQ ID NO: 24652 - DNA, 688 bp, Panicum virgatum
  misc_feature: Ceres CLONE 1859936
  misc_feature: Encodes the peptide sequence at SEQ ID NO. 24653
aatttcccactccactcgaattagaaccctagcggcaaaaacctcggtccgcgccgccgccgcctgctcctcccgtcccgccgccggcgccgccacccgcttccgccgagaggcttgccgtccggggcactctcgcgtggcgccgcgcctctctacgcgcagccgtcttccgccgccatgatctgcgcgatctccggcgaggtgccggacgagccggtggtgtccaagaagtcggggctcctcttcgagcggcggctcatcgagcgctacattgaggaccatggcaagtgcccggtcaccaaggaggagctcaacatggacgatatcgtgccggtcaagaccaacaaggtcgtgaagccgaggcctttgcaggctgcaagcattccaggacttcttgggatatttcaaaacgagtgggatgctcttatgctttctaattttgctttggagcagcagcttcacacagcaagacaagaacttagtcatgcactctatcagcatgatgctgcctgccgtgttatagccagattaaagaaggaaagagatgaggcaagaacacttttggctcaagctgagagacagattccttcattagttgccggagctgctcctgcagctgtagtttccaacggaaaaagaggtatcagctattcaatgtgatactaacttaacctcacatcataaatgg

SEQ ID NO: 24653 - protein, 160 aa, Panicum virgatum
  misc_feature: Ceres CLONE 1859936
  misc_feature (64)..(133): Pfam Name: Prp19 Pfam Description: Prp19/Pso4-like
MICAISGEVPDEPVVSKKSGLLFERRLIERYIEDHGKCPVTKEELNMDDIVPVKTNKVVKPRPLQAASIPGLLGIFQNEWDALMLSNFALEQQLHTARQELSHALYQHDAACRVIARLKKERDEARTLLAQAERQIPSLVAGAAPAAVVSNGKRGISYSM

SEQ ID NO: 24654 - DNA, 1937 bp, Panicum virgatum
  misc_feature: Ceres CLONE 1859941
  misc_feature: Encodes the peptide sequence at SEQ ID NO. 24655
ttttgagtgagaagagaagagacagagcagcgttgtgaaccgtctaggcaagtaaaggcgaaggaaaggacaggaacaaatcatcaccgccaacggcagccgtctagtgcgccctcagtgcgcgcccgaaacgccagtccacttttctcccctggccctgcgcgatcaatctttgctggggttcagtgcatcagggccgggcaatggcaacagcgaatgctgcagcacgatgcgccaacaaattcttactttctcatcagcgatctttggttttgatttcctgcaggggttcatactgctggcggtgcaggcgcacctgccgcagctgcgcccgccgccgtgcgacatgatggcggcggcgggggcggcggcgtgcgaggaggccggcggggtgaaggcgggcatcttcttcgcggcgctgtacctggtggcggtgggcagcgggtgcctcaagcccaacatcatcgcccacggcgcggaccagttccagcggggcggtggcggtggcggcgccggcggcgacgcccggcggctgtcgacctacttcaacgcggcctacttcagcttctgcgtgggcgagctggtggcgctcaccgtgctcgtctgggtgcagacacgctccgggatggacgtcgggttcggggtctccgccgccgccatggccgccggcctggtcagcctcgtcgccggcgtcccattctaccgcaacaagccgccccagggcagcatcttcactcccatagctaaggtatttgtcgccgctgcgacgaagaggaagcaagtgtgcccgtcgaccgccaccgtgcaggccatcgcaagcgtgaccgcccatgagatgtcggttaaccctacaaacattcgccacatcaacaagttcaggttcttggacaaggcatgcgtgaaggcgcggggcggccccggcggcggggcgtcggcggcggggaaggagggcccatggcgcctgtgcacgccggcggaggtggagcaggtgaaggtgctgctgtgcgtggtccccatcttcgcgtgcaccatcgtcttcaacaccatcctggcgcagctgcagaccttctccgtgcagcagggcagcgccatggacacccgcctcgccgcctccttccacgtcccgccggcctcgctgcaggcgatcccctacgccatgctcgtcgcgctggtcccggcctacgaggccgccttcgtgcccgccgtgcgccgcctcacgggcgtcgccacggggatcaccccgctccagcgcatcggcgtggggctcttcgccgtcaccttctccatggtcgccgcagcgctcgtcgaggcccggcgccgccacgccgccgccgacggcggccgcctcctctccatcttctggatcgcgccgcagttcctcgtcttcggactctccgagatgttcaccgccgtggggctcatcgagttcttctacaagcagtcgctcgccggcatgcaggccttcctcacctccatgaactactgctcctactccttcggcttctacctcagctccgtgctcgtgtccctggtcaacagggtcaccagcaccgccggcggcggcggcggctggcttgccaacaacgacctcaacaaggacaggctcgacctcttctactggctcctcgccgggctcagcatcctcaacttcttcaactacctcttctgggcgaggtggtactccaagagcgtagagacggcggtgcaggtcgccggagtccggggcggcggtgagcaggatgagcagcagaaggacactcccgagtgctgagatcattaacatgggtccctgaaaagtgggcccaggcatgtcagccaattaatcaattaacctagtagtgctaagtatagttaagctttttatttctttttattttgttgcttttatggttttgatttgcatttgggaagagatatatatgagtatgagttaaatt

SEQ ID NO: 24655 - protein, 513 aa, Panicum virgatum
  misc_feature: Ceres CLONE 1859941
  misc_feature (8)..(421): Pfam Name: PTR2 Pfam Description: POT family
MRQQILTFSSAIFGFDFLQGFILLAVQAHLPQLRPPPCDMMAAAGAAACEEAGGVKAGIFFAALYLVAVGSGCLKPNIIAHGADQFQRGGGGGGAGGDARRLSTYFNAAYFSFCVGELVALTVLVWVQTRSGMDVGFGVSAAAMAAGLVSLVAGVPFYRNKPPQGSIFTPIAKVFVAAATKRKQVCPSTATVQAIASVTAHEMSVNPTNIRHINKFRFLDKACVKARGGPGGGASAAGKEGPWRLCTPAEVEQVKVLLCVVPIFACTIVFNTILAQLQTFSVQQGSAMDTRLAASFHVPPASLQAIPYAMLVALVPAYEAAFVPAVRRLTGVATGITPLQRIGVGLFAVTFSMVAAALVEARRRHAAADGGRLLSIFWIAPQFLVFGLSEMFTAVGLIEFFYKQSLAGMQAFLTSMNYCSYSFGFYLSSVLVSLVNRVTSTAGGGGGWLANNDLNKDRLDLFYWLLAGLSILNFFNYLFWARWYSKSVETAVQVAGVRGGGEQDEQQKDTPEC

SEQ ID NO: 24656 - DNA, 2355 bp, Panicum virgatum
  misc_feature: Ceres CLONE 1859965
  misc_feature: Encodes the peptide sequence at SEQ ID NO. 24657
aaaacgaaaatcctctctctctctctctctccagtcaccccagccatttcgttcgctttccaatttcctttctcatccttcctttaaaaaatcgggcacggttatttatttctctcgctccgctgcgctttcctaatccgcgagcgggggggagatcgagacctagagcggcgggcggagctaacgcgaatggcggtggaggaggccgcggaaagctgcggcagccacgccgcggcagcggcggccgcggccgctgccgcgtctggcggcggcgcggcggggcccgcgacgtcctcctcgtcggccgccgcggcggcgcaggcgcggaagcagcagcagcagcagcgccacaagctcgaggtgtacacggaggtgctccgccgcctccacgagtccggcctgcccgaggcccgggcgcccgggttcgacgacgagctctggaaccacttcaaccgcctccccgcccgttacgccatggatgtgaacgtggagcgggcggaggacgtgctcacgcataggcggctgctggagcaagcgagggatccggcgcagcgaccggctttcgcggtgcgggccgtgcaggtatctccaattcttgatgggaatcagactgatgctgattcgaacactgcaggggaggaagttgcttcaagactgttgaacaggcagcaaagcatacaccctcctcctgctttcggttcttctacaaatcttgaggcccttgctcttgaagttagcaagtctcaaggccaggatcaggatagcacctctgataatggtcgatctctgtacaggcccatgcatgaaatcaccttttctaccattgacaggccaaagcttctcagtgagctgacatctctgcttggtgaacttggcctaaacatacaagaagcgcatgcattttcaacaaatgatggttactcactcgatgtctttgttgttgttggttggcatgatgaggaaacagaagatttagtagaagcagtgcagaaagaaattggcaggattgaagagacacaagcatggtcttcatctcattcgtggtctaccccagttgaaaatatgcaagttgctgagaattcagcagctgatcgtgttgagataccaacagatggtgctagtgaatgggaaactgatgtaaaactactcaagtttgggaataaagtagcatcaggatcatatggtgatctttaccggggtacttattgcagtcaagatgttgctattaaggtgctgaaacctgagagaataaatgcggacatgcagcgggaatttgctcaggaagtatttattatgaggaaggttcgtcacaagaatgttgtgcaatttattggtgcttgcactaaacccccaaatctatgtatagtcacagaatatatgtctggtgggagtgtgtatgattacctccataaacataaaggtgtcttcaaacttcctgctttaattggagttgcaatggatgtgtcaaaaggcatgagctacttacaccagaataatattattcatcgcgatttgaaaactgccaatcttctgatagacgaaaatgggactgttaaagttgctgattttggtgttgcacgtgtcaaagctcaatctggagttatgactgcagaaactggtacttaccggtggatggccccagaggtcatagagcacaaaccctatgaccacaaggctgatgtttttagttttggaattttgttgtgggaactgctcacaggcaagattccttatgagtacctgactccactacaagcagctgttggtgtggtgcagaagggattacggcctacaattccaaaacatacacatgcaaagctttctgagcttcttcagaaatgttggcagcaggaccctgctctaagaccagacttctctgaagtattagaaactctccagagaatagcagaggaggtcggagatgagcatgaggggaagcataaggacaaaatactgggaggtttcttttcagctctgagggggcggggccattgagacgctgttgaaatgtacatggtttcagttcattttgaaggatctgagctacaaccagcgccagttcctcgcacaccagcgcccagtacaaagaaatatagacctgctgcaggttgctaaaaagtggcaaattttagctgcagtcatcgtgtaccgcccgtctcctttttgtcccgagtagcattacgcggcgcaacaccggagagcattactgtggaatttacaatatcagtctggtttctctaacagagtgtaatctttctgtagatgaaaataataagccagatccaggccgtggcatgattcttttaagattccatcgtttagtttgtttataattatgttcccgtcattcttttc

SEQ ID NO: 24657 - protein, 601 aa, Panicum virgatum
  misc_feature: Ceres CLONE 1859965
  misc_feature (320)..(569): Pfam Name: Pkinase_Tyr Pfam Description: Protein tyrosine kinase
  misc_feature (205)..(271): Pfam Name: ACT Pfam Description: ACT domain
  misc_feature: SWISSPROT Homolog: EC 2.7.11.1 Non-specific serine/threonine protein kinase
MAVEEAAESCGSHAAAAAAAAAAASGGGAAGPATSSSSAAAAAQARKQQQQQRHKLEVYTEVLRRLHESGLPEARAPGFDDELWNHFNRLPARYAMDVNVERAEDVLTHRRLLEQARDPAQRPAFAVRAVQVSPILDGNQTDADSNTAGEEVASRLLNRQQSIHPPPAFGSSTNLEALALEVSKSQGQDQDSTSDNGRSLYRPMHEITFSTIDRPKLLSELTSLLGELGLNIQEAHAFSTNDGYSLDVFVVVGWHDEETEDLVEAVQKEIGRIEETQAWSSSHSWSTPVENMQVAENSAADRVEIPTDGASEWETDVKLLKFGNKVASGSYGDLYRGTYCSQDVAIKVLKPERINADMQREFAQEVFIMRKVRHKNVVQFIGACTKPPNLCIVTEYMSGGSVYDYLHKHKGVFKLPALIGVAMDVSKGMSYLHQNNIIHRDLKTANLLIDENGTVKVADFGVARVKAQSGVMTAETGTYRWMAPEVIEHKPYDHKADVFSFGILLWELLTGKIPYEYLTPLQAAVGVVQKGLRPTIPKHTHAKLSELLQKCWQQDPALRPDFSEVLETLQRIAEEVGDEHEGKHKDKILGGFFSALRGRGH

SEQ ID NO: 24658 - DNA, 469 bp, Panicum virgatum
  misc_feature: Ceres CLONE 1859966
  misc_feature: Encodes the peptide sequence at SEQ ID NO. 24659
acgcagctgctgccactctcactctcgcaaaaagctagcgcgagtccatggcgtcggcgtcggcgccgtccccgcgcgccgcagcaccacctcctcggcgccttctcgggctctcgctgctgcttctgctgctagtgctccccgccgtcgccaatgcgcaccccgtgacgacgccgtcgccggcggcgaaggcacggcgggaggcgggcatctcggcggggctggtctccacgctgcgcgagacgctggacgcgatcaggggcgtggcgggcatcatctcggcgttccccgacagcggcatcctcggcggcggcgacctccgcctctcctccgccgtcgccgactgcctcgacctcctcgacctctcctccgacgagctctcgtggtccatgtccgccacctcggcgtccgcctacggccccgcgggcgccgggggaggggcggacggccgcctcacgcaccggcgacg

SEQ ID NO: 24659 - protein, 140 aa, Panicum virgatum
  misc_feature: Ceres CLONE 1859966
  misc_feature: Useful for making plants with altered carbohydrate content
MASASAPSPRAAAPPPRRLLGLSLLLLLLVLPAVANAHPVTTPSPAAKARREAGISAGLVSTLRETLDAIRGVAGIISAFPDSGILGGGDLRLSSAVADCLDLLDLSSDELSWSMSATSASAYGPAGAGGGADGRLTHRR

SEQ ID NO: 24660 - DNA, 1879 bp, Panicum virgatum
  misc_feature: Ceres CLONE 1859969
  misc_feature: Encodes the peptide sequence at SEQ ID NO. 24661
atcactttgtttcacagccttaggtgccacatttttcttgtactggcatcttcatcttcactgaggttcaggccatggtaatggcttgtactctgaattccatcaacaagaaaagcactttgctgatgcttaccgcaccggtgaagacaataggcaggattccagcttcgtgggggagacatgcatggagtattgggagagaagatccaagaagagctgtccatgctctcaaggctgggacagctctcacgctggtctcgctcttgtacatactcgaacctttcttcaaaggaattgggaagaatgcaatgtgggcagtcatgactgtagttgttgtgcttgaattcactgcaggagccactatatgcaaagggctgaatagagggttgggaacagttctggcaggctctcttgcacttctcattgagcttgttgctgctggaaccgggaaggttttccgtgctttcattgtgggagcttcagtgtttataatagatgtgcacataaaatgaattggtcatgccataagcaatttgatcagtggattatagtgcttattattggttttatttgtaggatttgctgccacatatgttagattcttcccaacaatcaagaagagctacgattacggtgtgctgatttttctcttaaccttcaatctgataacggtgtcaagctaccgccaaaacgatgtgctcccattaacgagagatcgtttaagtactattgccatcggctgcgcaatatgtctattcatgagtctcttggttttgccaaactggtctgggcaagacctccacaatagcactgttaacaaattcgaaggattggcaacatcaattgaagcttgtgtgaatgagtatttccgagaccaggataaagacgacaacgataagcaggaagcaagagcttcaattcaaataggctatagagcggtcttggactcagaatccagtgatgagaccctagcacactatgcaagctgggagccaagacactcaatgcactgttacagttacccatggcaaaagtatgtgaagctcggatccgtgcttaggcactttgcatacacagttgctgcacttcatggatgtttggaatctgagatacagactcctccatccgtgagattactgttccgagatccatgcacaagagttgctcaagaagtcgtcaaggttctgcaggagcttgcggtgagcataaggcgtcaccggcgctgtgcccctgacgtgctctctgatcatcttcacgaagcgctgcaggatctgaactcggcaatcagatcgcagccgcggctcttccttggctccaaacgcgcgtgtgccaccaataagcatatgctcatggaactcaactctggaaatcacacggcatcgagagctacccttcattcattcaatgactgatgcgacagcactgtcagaaaggaagaacactggaacagaccaaccatcacgagcctcgagttctctcaggcgctcccgtttgccgctttcgcgtcgttgctggtggagatggtggtgcggctggagatggtgatagaggaagtgaagaacctggagcgagctgcaaatttcagagagttccctggacatgatcatctgatcattgatctcagtagcaaggagaaaacgaggaacagtaatgccgcggcattgaacccagtttctgctgcagctgagtgagtaatggatccgatcagaaatgtatcagccatgcatgcattctgagaagagaggcatattctttttttttcagtaatcatgaatcttgaactcccagtactggttgtttgagaagaaagctttccgtgtaatctaatccacctacccatgaattatttatcaacatctgaataattggagttggtgtc

SEQ ID NO: 24661 - protein, 145 aa, Panicum virgatum
  misc_feature: Ceres CLONE 1859969
  misc_feature: The sequence is a functional homolog of SEQ ID NO 1 in US patent 7138563
MVMACTLNSINKKSTLLMLTAPVKTIGRIPASWGRHAWSIGREDPRRAVHALKAGTALTLVSLLYILEPFFKGIGKNAMWAVMTVVVVLEFTAGATICKGLNRGLGTVLAGSLALLIELVAAGTGKVFRAFIVGASVFIIDVHIK

SEQ ID NO: 24662 - DNA, 1988 bp, Panicum virgatum
  misc_feature: Ceres CLONE 1859978
  misc_feature: Encodes the peptide sequence at SEQ ID NO. 24663
gcatcccctcctcccctctccctgcccagcggaactcaggcaacaataacatactcaatcaaaggcagcgtttagccctgtttccgcacaagttttgatttttgtcgcttcctcaaccccctcttcctcttcgtggaatcgcaagataccaaaatccacaagtcaaaacctcagggaatgctgaaagatgtgctttcatagaagagatttctgctgcgacatcaaggagctcgctgctccgcaagcgctgctagcctgctcaactcttgatgtgaacgaccaccttagctgcatcaattctacaccattcagactccgacacgaccagggcataagagttctgttcaccgtcatggaccatgacatgggggaggagggctaaatcattgcagtccatctgtttggcggtcagaagatagccctgtggtttatacttttgaagacatggatggtacaggaatgatactgatggagcggtatgagttggggagattgctggggaaaggtacatttggcaaggtgcactatgcaagaaaccttgagtccgacaggagtgttgctattaagatgatagaaaaggacaaagttctcaaggttgggctttcagagcagataaggcgtgagatcgcaacaatgaggttagcggcacataagaacattgttgagctccatgaggtcatggcaacacgaagcaagatctactttgtcatggagtatatgaaaggtggcgagctctttgacaagattgaggagagtggcaagctcacggagtctgctgcacacaagtacttccagcagctcattagtgcggtggattactgccacagccgaggtgtctaccaccgggacctgaagcctgagaacctgctgctggatgaggatgagaacctgaaggtttctgattttggactgagtgcactttcggagtcaaaaaggcaagatggattgctccataccacctgtggaacaccagcttatgtagctccagaggtgatcagcaagataggctatgatggtgcaaaatcagacatctggtcttgtggtgttgttctatttgtccttgttgctggttatctccctttccaaggcccaaacttgatggagatgtatcggaagatacagcatggtgatttcaggtgccccagttggttttcacacaaactcaagaagctgttgtacaagatcttggaccctaacccaagcacaagaatttcaatccagaaaataaaagagtctacctggttccgaaaaggccctgagcggacccgcacagttaaggagaaaattccctgcgagaatgccaccacaaatgctgctccaacactttctgtgaggcgcggaaagaatgcttatgaagatgtgaagccgctgcctgtgacaaacttaaatgccttcgaaattatctctttctcctcagggtttgatctatctggcttatttattgaaaagggacacagaaaggacgcacgatttacttcagataagccagcctcagcaatcatctcgaagattgaagatgttgcaaagatgctgaatctcagggtaaggaagaaggataatggtgttgtcaagattcaagggaggaaggagggaaggaatggtgtccttcagtttgacacagagatctttgagatcacaccgttccatcatctcgttgagatgaaacaaacaagcggtgattcacttgagtatcagaaattatttgaacaggacatccggccagcgctgaaggatatagtctgggcgtggcatggagatgatcagcagcaaatgcaggagtagctttggatgcctcattttttgttctgaaattttgttttcttcaggtcagagtcatgtgtgttcttttttagaagctacattctttttttttatcgtaagagaacctagtgaggggtggtgacgtgaaccatttggttgtattccatagaacaataattgtggaaaagctgagttcttgagtttcattctgaaaattgtttctcttc

SEQ ID NO: 24663 - protein, 445 aa, Panicum virgatum
  misc_feature: Ceres CLONE 1859978
  misc_feature (12)..(267): Pfam Name: Pkinase Pfam Description: Protein kinase domain
  misc_feature (310)..(369): Pfam Name: NAF Pfam Description: NAF domain
  misc_feature: SWISSPROT Homolog: EC 2.7.11.1 Non-specific serine/threonine protein kinase
  misc_feature: Useful for making plants with modulated biomass
MDGTGMILMERYELGRLLGKGTFGKVHYARNLESDRSVAIKMIEKDKVLKVGLSEQIRREIATMRLAAHKNIVELHEVMATRSKIYFVMEYMKGGELFDKIEESGKLTESAAHKYFQQLISAVDYCHSRGVYHRDLKPENLLLDEDENLKVSDFGLSALSESKRQDGLLHTTCGTPAYVAPEVISKIGYDGAKSDIWSCGVVLFVLVAGYLPFQGPNLMEMYRKIQHGDFRCPSWFSHKLKKLLYKILDPNPSTRISIQKIKESTWFRKGPERTRTVKEKIPCENATTNAAPTLSVRRGKNAYEDVKPLPVTNLNAFEIISFSSGFDLSGLFIEKGHRKDARFTSDKPASAIISKIEDVAKMLNLRVRKKDNGVVKIQGRKEGRNGVLQFDTEIFEITPFHHLVEMKQTSGDSLEYQKLFEQDIRPALKDIVWAWHGDDQQQMQE

SEQ ID NO: 24664 - DNA, 390 bp, Panicum virgatum
  misc_feature: Ceres CLONE 1859980
  misc_feature: Encodes the peptide sequence at SEQ ID NO. 24665
gaacactcaggcgagattcttcccagaccggccggggaatcaccgctcgatcgatcgctctccggcgagctaccatccactccctgatcggaatggacttcggaggggcgctgcagctgccgccggggttccggttgaccccgacggacgaggagttggggacgccctacttcctgcccaagtgcggcgggctggcgccggcggcgccggtgatcgcggaggtggacctgtacaagtatgacccgtgtagactgcaggagagggcggatggaggggagaaggagtgatacttcttatcgccgcgggaccgcacgaaccccgacgggtcgcgccccagcagcgccgccggcgccgggtactggaaggacaccgtggccgacaagcccgtga

SEQ ID NO: 24665 - protein, 64 aa, Panicum virgatum
  misc_feature: Ceres CLONE 1859980
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 891 in the 10/374,780 US patent application
  misc_feature: The sequence is a functional homolog of SEQ ID NO 854 in the 10/374,780 US patent application
  misc_feature: Useful for making plants with altered terpenoid content
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: Useful for making plants with modulated water use efficiency
  misc_feature: Useful for making plants with modulated light quality response
  misc_feature: The sequence is a functional homolog of SEQ ID NO 853 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1012 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 851 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
  misc_feature: Useful for making plants with altered alkaloid content
  misc_feature: Useful for making plants with modulated light quality sensitivity
  misc_feature: The sequence is a functional homolog of SEQ ID NO 476 in the 10/666,642 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated nitrogen use efficiency
MDFGGALQLPPGFRLTPTDEELGTPYFLPKCGGLAPAAPVIAEVDLYKYDPCRLQERADGGEKE

SEQ ID NO: 24666 - DNA, 1895 bp, Panicum virgatum
  misc_feature: Ceres CLONE 1860021
  misc_feature: Encodes the peptide sequence at SEQ ID NO. 24667
agtctgaccagaccgccattgccccaactcgaacacggggcgaaaattccttcgagagttcgagtcgagtcctcttagatctcgcttctggaagcttccggggcggcgtggctgatgaccacgaagcccgctcctatggagaacggcgccgcggccggagccggtgggggcaaccgccgacgcggcggccggtggcggtatgcggccgcgggtgccctcctcgtggccgtccttgctgtggccgtgagctcccgcagcttcccgggcaccccctcctcttcgccaggaggctgcggatgccctgctgcgaggaagtacagggggatggtcgaggactgctgctgcgactatgagacggtggactctatcaatgaagaggtcctgcatccgaccctgcaggaactcgttaagttgcccttcttcaggtacttcaaggttaaactgtggtgtgactgccctttttggccagatgatggaatgtgccgccttagagactgtagtgtctgtgagtgcccagataatgagttccctgaaccattcaagaagccttacaatggactttctccagatagtatgatatgtcaagaaggaaaaccacaggctgctgttgataaaacccttgacaccaaggttttcaaaggatgggttgaaactgacaatccatggacatctgatgacgaaactgataataatgagatgacatacgtgaatcttcaactgaatcctgaacgatacactggctatactggtgattcagcgagaagaatatgggactctatttacaaagaaaactgcccaaaatatccctcagaagaactgtgtcatgagaagaaggcattgtacaagcttatttcagggttgcactcctcaatttcggtgcacattgcttacgattatcttcttgatgaatctactaacttgtggggacaaaaccttcctttgctgtatgaccgtgtcctgaagtacccagagcgtgtccaaaatctgtatttcacatatctgtttgttcttcgagcggtgacaaaggcagcagattatcttgagcaggctgagtacaatactggcaatcctgaagacgacttgaaaacacaatctcttgtgaagcaattgctttaccatcccaagttaagatctgcatgcccaaaaccttttgatgaagcgaaactctggcaaggggagaatggtcctgagctaaagcaagagattcagaagcaatttagaaacattagtgcaattatggactgcgttagctgtgagaagtgccgactatggggaaaactccaagttcttggtctcggaactgcactgaaaattcttttctccgttgatggagataacaacttgaatcagcctttgcagctgcagagaaatgaggtcattgcactgttcaatcttctgaataggctgtcagaatctgtgaagtttgtacatgaaaaaggatcatcaattgaagaggtcattaaggagcagagccctccaactgttcaaaagggtgttcccaagccgaagcttaagctggacttcgtctgagatgtaggagtttaatttgtagttacatgaacatgccggccatgtaccgagagagcaacatgtattcctatgtggttctgttgcagccctatacaagacaatgagatacagaccccttgggagctaaatacaatgacagagttaacccagtttttcttcgctccggcccttaaaattttcgatgtatagtttacctcatttgctgtaaggttctcaccgtcatgatgaagagaggataacccaacatggcaacatacacttttcacttctgttgaattaatctcaaagaagtgaaaagaaatgtgatgacacaaccgccagtgaatcgatctcaaagaaatatgaattaatcctttagaaaagat

SEQ ID NO: 24667 - protein, 464 aa, Panicum virgatum
  misc_feature: Ceres CLONE 1860021
  misc_feature (81)..(432): Pfam Name: ERO1 Pfam Description: Endoplasmic Reticulum Oxidoreductin 1 (ERO1)
  misc_feature: The sequence is a functional homolog of SEQ ID NO 2 in US patent 7064247
MENGAAAGAGGGNRRRGGRWRYAAAGALLVAVLAVAVSSRSFPGTPSSSPGGCGCPAARKYRGMVEDCCCDYETVDSINEEVLHPTLQELVKLPFFRYFKVKLWCDCPFWPDDGMCRLRDCSVCECPDNEFPEPFKKPYNGLSPDSMICQEGKPQAAVDKTLDTKVFKGWVETDNPWTSDDETDNNEMTYVNLQLNPERYTGYTGDSARRIWDSIYKENCPKYPSEELCHEKKALYKLISGLHSSISVHIAYDYLLDESTNLWGQNLPLLYDRVLKYPERVQNLYFTYLFVLRAVTKAADYLEQAEYNTGNPEDDLKTQSLVKQLLYHPKLRSACPKPFDEAKLWQGENGPELKQEIQKQFRNISAIMDCVSCEKCRLWGKLQVLGLGTALKILFSVDGDNNLNQPLQLQRNEVIALFNLLNRLSESVKFVHEKGSSIEEVIKEQSPPTVQKGVPKPKLKLDFV

SEQ ID NO: 24668 - DNA, 1828 bp, Panicum virgatum
  misc_feature: Ceres CLONE 1860023
  misc_feature: Encodes the peptide sequence at SEQ ID NO. 24669
gtagcaccatctccatctcctgcccgggcggcgccggcctctaccccgagggggcgccgccggcctgctccgagtggggctctggggccctgccgagcaggcgccgccgcccagggggcgccggcctggctcgagcgggcgccacgtcctatcccgagcgggcgggcccgccctgtccccagtagggggcgccgccggcctgctctgagggggcaccgtggcctggcccgagggtgcgccgctagcctcgcttgagcgggcggccccgccccgccctgagccggctgagggagggagcagaagagcggcgcaccggagaggcgctggaagagcacttgacgcccggccggagggagcagaagcggcccaccggagcaccagcgatgcacggaggagcagcgctcgaagcagccgatccgtttctcttagggagaaggcagccagggaaagaatggaatagataggggcaatttcgtctttcacatacttttctattaaaaataattatattaatgggtatagtgtccaacacccaattaccttaaaagtttaatgtgtttgaacatagatatgttttttttagtgtgttatggcaaataccatctttttcggtgtcctagacctaattttgtcttccaaattcctcctccccatcgactgactcctcatcgtcctcgcttccttcgcaatccccagcagcagcagcagcagctcccctctcctctcctctcctctcccacaaccctaccctccgcgaccgagcgagctccgggaggccggccaatggacggaggaggcggattcatgggcccgccgccggtcccccgctcgccggaggacgtcttccgggatttccgcgcgcgccgggccggcctgatcagggcgctcaccaccgatgtggagaagttctacgtgatgtgcgacccagagaaggagaacctatgtttgtatggacttcccaatgagacatgggaagtcaacttgcctgcagaggaggtccctcctgaactcccagagccagctctgggaattaactttgcacgtgatgggatgaatgaaaaagattggctgtcacttgttgccgtgcatagtgactcttggttattgtcagttgcattttattttggagcaaggtttggtttcgacaaagaatccaggaaacggctcttcaccatgatcaataaccttcccacagtatatgaggttgtcacaggaacagccaagaaagagcccaaagacaaaacccctaaaaacagcaataagactaacaaaactggctccaagccacgccaatcagaacccaactcaagggccccgaagctgccacctccaaaggaagaagaggagagtgaaggggaggatggggaaccacaggaagaccatgagagcacgctgtgcggcgcatgcggccaaagttacgacgacttctggatctgctgtgacctgtgtgagaaatggttccatggcaagtgcgtgaagatcaccccagccaaagcggaacacatcaagcagtacaagtgcccctcctgcacaggcagcaagagggccaaggcttgagtctaggaaacccgaattgccaacaatgctctaaggagccttgtcgagttgtaagctaaagttctcaggttagggcagctatagattcgaataccttgtccggatattgtcggcgttgatgcttgaggatccatctaaatttagtgtcagtactatgattactgactgactgctgtagtgtgtgtgtggcctcaagcatctatgctctgtagtctactgaattgtgtgctttagattccaactatgccatgtttgatcattttgtcgtttt

SEQ ID NO: 24669 - protein, 257 aa, Panicum virgatum
  misc_feature: Ceres CLONE 1860023
  misc_feature (204)..(252): Pfam Name: PHD Pfam Description: PHD-finger
  misc_feature: SWISSPROT Homolog: EC 1.14.11.27 [Histone H3]-lysine-36 demethylase
  misc_feature: Useful for making plants with altered alkaloid content
  misc_feature: The sequence is a functional homolog of SEQ ID NO 1981 in the 11/479,226 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
MDGGGGFMGPPPVPRSPEDVFRDFRARRAGLIRALTTDVEKFYVMCDPEKENLCLYGLPNETWEVNLPAEEVPPELPEPALGINFARDGMNEKDWLSLVAVHSDSWLLSVAFYFGARFGFDKESRKRLFTMINNLPTVYEVVTGTAKKEPKDKTPKNSNKTNKTGSKPRQSEPNSRAPKLPPPKEEEESEGEDGEPQEDHESTLCGACGQSYDDFWICCDLCEKWFHGKCVKITPAKAEHIKQYKCPSCTGSKRAKA

SEQ ID NO: 24670 - DNA, 1282 bp, Panicum virgatum
  misc_feature: Ceres CLONE 1860040
  misc_feature: Encodes the peptide sequence at SEQ ID NO. 24671
ggccttccttccttcacctagcttagcagcagcatctatcctctcctcctcgaccttccttcctctctgccggccggcacaggtgaggtagatcgatactcgatggcggcggattcagtagcaacgacgacgacgacgccccggcctgtggtgcgacccaagcggaagaaggctctggtggattacctggtgacattccgatggatccctgccatcttcgtggcccttcccctctcggctctcatctacttctgcatctacatcggaggcatgctgtcctccatgaaacccgaggagcgccggcgcagggagcacgaggagaacgtccacaaggtcgtgaggcgcctcaagcagagggaccccaagaaggacggcctcgtgtgcacggccaggaagccatgggtggtggtcggcatgcgcaacgtcgactacaagcgcgcccgccgcttcgaggtggacctgtcggcgttccacaacatcctcgagatcgacacggagaggatggtggccagggtggagcctctggtgagcatgggccagatcaccaaggtcacctgccccatgaacctctccctcgccgtggcccccgagttcgacgacctcaccgtcggcggcctcatcaacagctacggcatctcagggagctcccacatctacggcctcttctccgacacggtggtgtcaatggaggtggtcctggcggacggccgggtggtgagggccaccaaggacaacgagcactcggacctcttctacgccatgccgtggtcgcagggcaccatcggcttcctggtcgcagccgagatcaagctcattcgcatcaaggagtacatgaggctgacctacacccccgtcaggggcacgctcaaggagatagcgcaggcctacgccgactcgtttgctgcaagggctgatgctgatgctgctgatgattcaaagaaggaaaatcaccagcgccagcaggtccctgactttgtggaaggcatggtgtactccccctccgagggcgtgatgatgacgggtgtgtacgccacggcggaggaggccaagaagaagggcaaccggatcaaccgcgtggggtggtggttcaagccctggttctaccagtacgcccagacggctctgcagcggggcgagttcgtggagtacatccccacgagggagtactaccaccggcacaccaggtccctctactgggaggccaagctcatcatccctttcgccgaccagttctggttcaggttcctgctcggctggctgatgccgcccaagatcaccttgc

SEQ ID NO: 24671 - protein, 393 aa, Panicum virgatum
  misc_feature: Ceres CLONE 1860040
  misc_feature (63)..(208): Pfam Name: FAD_binding_4 Pfam Description: FAD binding domain
MAADSVATTTTTPRPVVRPKRKKALVDYLVTFRWIPAIFVALPLSALIYFCIYIGGMLSSMKPEERRRREHEENVHKVVRRLKQRDPKKDGLVCTARKPWVVVGMRNVDYKRARRFEVDLSAFHNILEIDTERMVARVEPLVSMGQITKVTCPMNLSLAVAPEFDDLTVGGLINSYGISGSSHIYGLFSDTVVSMEVVLADGRVVRATKDNEHSDLFYAMPWSQGTIGFLVAAEIKLIRIKEYMRLTYTPVRGTLKEIAQAYADSFAARADADAADDSKKENHQRQQVPDFVEGMVYSPSEGVMMTGVYATAEEAKKKGNRINRVGWWFKPWFYQYAQTALQRGEFVEYIPTREYYHRHTRSLYWEAKLIIPFADQFWFRFLLGWLMPPKITL

SEQ ID NO: 24672 - DNA, 730 bp, Panicum virgatum
  misc_feature: Ceres CLONE 1860040-R
atgacaaccatgtcatccaggacgtgctggtgccgctgcacaaagtcggacaagtgctcgaatttgggcaccgagaactggaggtctaccctgtttggctctgccctcatcgcctgttcaaggcccccgtgaaggccatggtgcagcccgaggccgggttcgagcagcatccccggcagggcgacagcagctacgcccagatgtacacggacgtgggcttctactacgcccccggcgccgtgctgcgcggcgaggagttcgacggcgcggaggcggtgcggaagctggagcagtggctcatcgccaaccacggcttccaggcgcagtacgccgtgtcggagctgagcgataaggacttctggaggatgttcgacccctcccactacgaccactgccgccgcaagtacggcgccgcgggcaccttcatgagcaactactacaagtccaagaaggggaggaagacggacaaggaggtcagggacgccgaggcggaggcggcggcggccatcgtcgaaccggacgccgccgaatgaactccaatcaactgccaccagtcctgcttgcaagcccaataacaatgcatgcacccttttagtttagtttagtttaagtttatgtatgcagatgatgccgctgtgtgtccgttccgtggagcagcagcaccactttgtttgtttccgacttcctgagctagtgttgcaataaaataaagcagcaagcagttgttgtt

SEQ ID NO: 24673 - DNA, 3069 bp, Panicum virgatum
  misc_feature: Ceres CLONE 1860044
  misc_feature: Encodes the peptide sequence at SEQ ID NO. 24674
aaccatcgcgcccctcctccatttccaggcagcagccgagcgagcgatctcttccccatcgcctcatcttgctttgttccatcggcgggagcagccgcgttcccggacgccgggtgggcaggaaccgccggccccggacacggaaaagcagggctccctgaccaaccgccgcggaccgtctccatttttaaccgcgccgcggcgggcaccaccgccgtctccaccgcaccggaacgcgccgcgcgggaaataacaaggccggaaagcgatcagatcggccgcggcgagggcgcgggggcaccgcgagcgacctgccgcgcccgcgctccgtcccgcggcagccgggtcgaccgtcgtccggaccgcgatgaggggaggtttccttttcgtttcttttcctctccttcgcgtgccgcccccaccaccgagcgactcctccacccctgtggccagtggtgacctccgcccccgcgctcactccacctccagcctccagctgctgctactctactaatactgaatacccgggcggtgcgggctctgcctttagctaccacaccgaacgcgccgcgtcccggaggaggaggaggcggtgctctttgtctcttctaccttcctcctttcctcctcccgcggcgggcggcggcggcggcggcaatggcggccaccgcgctgctcctttccgcggcggcggcggtgctgctatgcctcgcgggcggctcgcgggcgaccaacgtgacgtacgaccaccgcgcgctggtcatcgacggcgtgcgccgagtgctcgtctcgggatccatccactacccgcggagcacccccgacatgtggccggggctgatccagaaggccaaggacggcggcctggacgtcatcgagacctacgtcttctgggacatccacgagcccgtccggggacagtacgacttcgagggccgcaaggacctggccgcgttcgtcaaggccgtcgccgacgccggcctctacgtgcacctccgcatcgggccctacgtctgcgccgagtggaactacgggggcttcccgctgtggctgcacttcatccccggcgtcaagttccgcaccgacaacgagcccttcaaggcggagatgcagcgcttcaccgccaaggtggtggacaccatgaagggggcgggcctctacgcgtcccagggcgggcccatcatcctgtcacagatcgagaacgagtacggcaacatcgactcggcgtacggggcggccgggaaggcgtacatgcggtgggcggccgggatggccgtctcgctcgacaccggcgtgccctgggtcatgtgccagcaggccgacgcgccggaccccctcatcaacacctgcaacggcttctactgcgacgggttcacgcccaactccgcggccaagcccaagatgtggaccgagaactggagcggctggttcctctccttcggcggcgccgtcccctaccgccccgccgaggacctcgccttcgccgtcgcgcgcttctaccagcgcggcggcaccttccagaactactacatgtaccatggcgggaccaacctggatcgcagcgcagggggacccttcatcgccacgagctacgactacgatgcacccatcgacgagtacggactagtcaggcagccgaagtggggccacttgagggatgtgcacaaggccataaagctctgcgagccagcgctcatagcaactgatccatcatacatttctctaggtcaaaacgctgaggcagctgtatacaaggccggttcagtttgcgccgcgttccttgctaacatagatggtcaatccgacaaaactgtcacattcaatggcaagatgtacaagctccctgcgtggtccgtcagcatccttcctgactgcaagaatgtggtgctgaacacggctcagatcaactctcaagtgacaagttcagaaatgaggtacttggagtcgagtactgtagcatcagatggctctttcaccacgccagaactcgcagtatctggctggagctatgccatagaacctgttggtatcacaaaggataatgcattgacaaaagctggactgatggagcagataaacaccacagcagatgccagtgacttcctctggtactcaacaagcattactgttaaaggtgatgaaccttatctaaatggcagccaatccaatctgcttgtaagctcacttgggcatgttcttcaggtctacgtgaatggtaaaattgcaggaagcgctcaaggtagtgctagcagctcactcatctcctggcagaaatcaattacacttgtacctgggaagaacaaaatagatcttctgagtgcaacagttgggctgtcgaattatggtgcattctttgacctggtaggtgctggaattactgggccagtaaagctgagtggaccaaatggtgcactcgatctgtcttctgcacaatggacataccagattggactcagaggtgaagatttgcacctgtatgatccctcagaggcctcaccagaatgggtctcatccaatgcttatccaatcaaccaaccactaatttggtacaagacaaaattcacagcccctgcaggtgatgatcctgttgccattgacttcacaggattggggaaaggtgaagcctgggtgaacgggcaaagcattggtcgatactggccaacaaatatagctccacagagcggctgtgttaactcgtgcaactatagaggatcctacacttcgagcaaatgcctcaagaagtgtgggcagccatcacagactttgtaccatgttccccgttcgtttctccaaccaggcagcaatgatatagtccttttcgagcagttcggtggtgacccaagcaagatatcctttgtgacaaggcagacaggaagtttatgcgcacaagtgtcagaagcgcatccagcccaaattgatagctggatttcttctcaacagaagatgcagagatctggacctgcacttcgcctggaatgcccgaaagaaggtcaggtcatcagcagcatcaagtttgcaagctttgggacaccaagcggcacatgcgggagctacagccatagcgaatgc

SEQ ID NO: 24674 - protein, 803 aa, Panicum virgatum
  misc_feature: Ceres CLONE 1860044
  misc_feature (33)..(339): Pfam Name: Glyco_hydro_35 Pfam Description: Glycosyl hydrolases family 35
  misc_feature: SWISSPROT Homolog: EC 3.2.1.23 Beta-galactosidase
  misc_feature: Useful for making plants with altered cell wall content and/or composition
  misc_feature: The sequence is a functional homolog of SEQ ID NO 2 in US patent 7084321
  misc_feature: Useful for making plants with altered carbohydrate content
MAATALLLSAAAAVLLCLAGGSRATNVTYDHRALVIDGVRRVLVSGSIHYPRSTPDMWPGLIQKAKDGGLDVIETYVFWDIHEPVRGQYDFEGRKDLAAFVKAVADAGLYVHLRIGPYVCAEWNYGGFPLWLHFIPGVKFRTDNEPFKAEMQRFTAKVVDTMKGAGLYASQGGPIILSQIENEYGNIDSAYGAAGKAYMRWAAGMAVSLDTGVPWVMCQQADAPDPLINTCNGFYCDGFTPNSAAKPKMWTENWSGWFLSFGGAVPYRPAEDLAFAVARFYQRGGTFQNYYMYHGGTNLDRSAGGPFIATSYDYDAPIDEYGLVRQPKWGHLRDVHKAIKLCEPALIATDPSYISLGQNAEAAVYKAGSVCAAFLANIDGQSDKTVTFNGKMYKLPAWSVSILPDCKNVVLNTAQINSQVTSSEMRYLESSTVASDGSFTTPELAVSGWSYAIEPVGITKDNALTKAGLMEQINTTADASDFLWYSTSITVKGDEPYLNGSQSNLLVSSLGHVLQVYVNGKIAGSAQGSASSSLISWQKSITLVPGKNKIDLLSATVGLSNYGAFFDLVGAGITGPVKLSGPNGALDLSSAQWTYQIGLRGEDLHLYDPSEASPEWVSSNAYPINQPLIWYKTKFTAPAGDDPVAIDFTGLGKGEAWVNGQSIGRYWPTNIAPQSGCVNSCNYRGSYTSSKCLKKCGQPSQTLYHVPRSFLQPGSNDIVLFEQFGGDPSKISFVTRQTGSLCAQVSEAHPAQIDSWISSQQKMQRSGPALRLECPKEGQVISSIKFASFGTPSGTCGSYSHSE

SEQ ID NO: 24675 - DNA, 694 bp, Panicum virgatum
  misc_feature: Ceres CLONE 1860071
  misc_feature: Encodes the peptide sequence at SEQ ID NO. 24676
gtgcggagagccaggtggaaactgacagagggccgccgcgcagtccgtcccggtaccgcgcccactcgccgcagccgcgccgccccctctcttctcctcaccacgaccgaccgcggcttcttcgcgtctcctgcagccgcgccgaggcgacacctcctggttcgcgtcggccgactggaagctaccgcccccgaggccgagcacgccggaccgcgggactgctgcggggcgccgccgaccgcgcgcggctctcctcccgcctcgggcgacggccctccgccagggtaggctgacgcccctccgccaggctcgcccgaccgcagcaagccgccgccgcatcagtactcctccaggccgtgaaagtcgaagacaaatttgtggctgaggctgaagaaaatctggatgtgcttgacttgcaagactcgctgtttttgagaggtgtctgacatagactatccaaaattcagcgccagggatcagggagtgacctaccccggggtggggagttcattccttttccagttacaaggagggcaaactcgtattccatcatgatggaagaggacatggaaaatggaaggtcgtatcaggaaagaccaagaaccttttctacagtacgaagtaaatcatctataccactggtcttccgcttgttgatgagggataatccccgtggcttgattattctctctct

SEQ ID NO: 24676 - protein, 47 aa, Panicum virgatum
  misc_feature: Ceres CLONE 1860071
  misc_feature: SWISSPROT Homolog: EC 3.6.1.1 Inorganic diphosphatase
MMEEDMENGRSYQERPRTFSTVRSKSSIPLVFRLLMRDNPRGLIILS

SEQ ID NO: 24677 - DNA, 797 bp, Panicum virgatum
  misc_feature: Ceres CLONE 1860084
  misc_feature: Encodes the peptide sequence at SEQ ID NO. 24678
atctgaccgctgttctcgcagagagagggatgggaaatgtttcctggctgttgccgttcttgttcttctcttcctgatttgagtgcactcgtagcagatctgaagcctctcgtgcctttggcgattggaggctgcggcatttgaggtggtcaggatgagcaaggaggacatcctcaaggtgcagacctgcgtgctgaaagttaacatccactgtgatgggtgcgagaagaaggtcaagaagatcctccacaagatcgatggtgtgtaccaaagcagtgtagatgcggagcaggggaaggtgacggtgtccggcctgatggatccggacaccgtcatcaagaagctgaacaaggctggcaagcccgcccagctgtggggcgccaagcctggcgtggtaagccaggtccaaaagctccacctcggcggcggcggcggcggcaagggccagcagccgaaggatgctggcggcaagggccagcccaaggatggcggtggcaagggccagcccaagggtggagcagttgctggaaacggcgccggtggaggcggaggaggtggcccgaaagatgcaaagatggtgatgccgctgccgactccgcagcatcttcagcaactgcagcagctgcaacagcacatgcagatgaaggggatgaagcttcctccgcagctcatgggcatgggcggcaagatgccgttcacagcggccgcgccgccgccggccaaggaccccatggccgtcaaattcaacgttcccgaggacgactaattctgggacgacggcagcgagttctatgacg

SEQ ID NO: 24678 - protein, 203 aa, Panicum virgatum
  misc_feature: Ceres CLONE 1860084
  misc_feature (13)..(73): Pfam Name: HMA Pfam Description: Heavy-metal-associated domain
MSKEDILKVQTCVLKVNIHCDGCEKKVKKILHKIDGVYQSSVDAEQGKVTVSGLMDPDTVIKKLNKAGKPAQLWGAKPGVVSQVQKLHLGGGGGGKGQQPKDAGGKGQPKDGGGKGQPKGGAVAGNGAGGGGGGGPKDAKMVMPLPTPQHLQQLQQLQQHMQMKGMKLPPQLMGMGGKMPFTAAAPPPAKDPMAVKFNVPEDD

SEQ ID NO: 24679 - DNA, 729 bp, Panicum virgatum
  misc_feature: Ceres CLONE 1860084-R
ccgggctggagatgatgcaggcggccgggaatcccatggcgcagcagcagtacatgtccatgatggcgcagcagcaacagcaacagatgatgatgaatggccatggtcctcatggccaccaggtccatggcgccgccggttacccgccgatggggtacgggtatgggtacggccgcccggcgatgccctacccgccgccgatgtactaccctcagccgcaccctcatgacaacatgttcagcgacgagaaccccaacagctgctcgatgatgtgaggcaagatcggtcgccggcgcctgcgaagctttctcctgctgatgccttggacaaaagcagtgaaccaaccggaaggaggggagcgcaggtcacaggtggtcatcggtcagcgtcgtcaccatggtcgaaataacaacctggatcagtcagtcagtatactacatgagaagctagtactaccagctagaatcgcccccttttttcttttttattttctagcttattttcacctttttttcccttgctttggacaaaaaaagcaacttccttgaaggggaaggtaggtatagtaattatgaatagtcgtcataagagatgatggtgctgctttacagtagaggtcaagaaggtgatgctgctggccggcttcccttcttgctccatattgtgatggtagaagaatgtgcaaaacaaggttaatctcaatgtgccttttccctgtgctttggatgc

SEQ ID NO: 24680 - DNA, 2227 bp, Panicum virgatum
  misc_feature: Ceres CLONE 1860096
  misc_feature: Encodes the peptide sequence at SEQ ID NO. 24681
acgtttaagccaaagtcgccgccgccgccgccgccgccgccccctaaaccctgtgcgccccccgagtccgctgacgagcgagccccggagctcaccccgacgaccatggcctcttccatcctctcctcctccgctaaaccctgctactccgccacaaaaacccccacccccatcgccaaccgcttgccacccccacccccatccccaaccacaaccctcccctcccgcgccgccgcgtcccgcttcgcccatggcctctacgccgccgccgtcagagcgagccccggcgcgcgccgcctccgcgcgctggcccgccccgtccgggcgtctcagcagcaccaccagcagcagccgcggcggcggcccgagtacgtccccaaccgcatcgacgaccccaactacgtccgcatcttcgacaccacgctccgcgacggcgagcagtcccccggcgccaccatgaccagcgccgagaagctcgtcgtggcccgccagctcgcccgcctcggcgtcgacatcatcgaggccggcttcccggcctcctcccccgacgacctcgacgccgtgcgctccatcgccatcgaggtcgggaacgcgcccgtcggggaggacggccacgtgcccgtcatctgcggcctctcgcgctgcaataagaaggacatcgacgccgcgtgggaggccgtcaggcacgcgcgccggccgaggatacacaccttcatcgccaccagcgagatccacatgcagcacaagctcaggaagacgcccgagcaggtggtggccattgccagggagatggtggcgtacgcccgcagcctgggatgctctgatgtcgaattcagccctgaggatgctggaaggacaaatagagagtttctgtatcatatattaggggaggtcataaaagctggagctacaactctgaatatcccggacactgttggatacaaccttccatatgaatttgggaacttaattgctgacataaaggcaaacactcctggaattgaaaatgctatcatttccacccattgccagaatgaccttggtcttgcaaccgccaacacattagcgggtgctcgtgcaggagcacgtcagttagaggtgactattaatggtattggtgaaagagccggaaatgcttctttggaggaggttgtcatggcaattaaatgtcgtccggaactcttagatggtctatatactggaatcaattcccaacatattactttgacaagcaaaatggtacaagagcacagtggacttcacgtacaaccacacaaagctattgttggtgccaatgcctttgctcatgaaagtggaattcatcaggatgggatgcttaaatataaaggaacttatgaaataatatcacctgacgatattggtttaacacgtgcaaatgaatttggtattgttctggggaaactcagtggaaggcatgctgtgagatctaagctagtggagcttggatatgaaatcagtgataaggaattcgaggacttctttaaacgctacaaagaggttgcagagaagaaaaagcgtgtaactgatgaggacatagaagcattattgtcagatgagatattccagcctaaagttatttggtcccttgctgatgtacaggcaacatgtggaacacttggtttgtctacagcaactgtgaaactgataggaccagatggcgaggagaaaatagcatgttctgttggaacaggtccggtcgatgcagcttataaagctgttgaccaaattatccagattccaactgttctccgagaatatggtatgacctcagtcacagaaggcattgacgcaatcgcaacaactcgagtggttgtcactggagacgtgagcaacaactccaagcatgccttgactggtcactctttcaatcgctccttcagtgggagtggggcatcaatggacgttgttgtgtccagcgtcagagcttacctgagtgccctgaacaagatgtgcagttttgctggcgcggtaaaagctacagcagtatctgagagcacacgtgttcaaagcaaagagtgagaccatcgtcatctgatcctcatatgggctgagcaatgtaagagctcttgaacaactgttcagagcgacattccgtttcagtaataggctggttaatattggggttcccccttggtcagtgtgaagatcgtgcgctctttctggaggatgtccgcttagaacaggcatgaagtttttggcctgtgca

SEQ ID NO: 24681 - protein, 644 aa, Panicum virgatum
  misc_feature: Ceres CLONE 1860096
  misc_feature (108)..(385): Pfam Name: HMGL-like Pfam Description: HMGL-like
  misc_feature (478)..(623): Pfam Name: LeuA_dimer Pfam Description: LeuA allosteric (dimerisation) domain
  misc_feature: SWISSPROT Homolog: EC 2.3.3.13 2-isopropylmalate synthase
MASSILSSSAKPCYSATKTPTPIANRLPPPPPSPTTTLPSRAAASRFAHGLYAAAVRASPGARRLRALARPVRASQQHHQQQPRRRPEYVPNRIDDPNYVRIFDTTLRDGEQSPGATMTSAEKLVVARQLARLGVDIIEAGFPASSPDDLDAVRSIAIEVGNAPVGEDGHVPVICGLSRCNKKDIDAAWEAVRHARRPRIHTFIATSEIHMQHKLRKTPEQVVAIAREMVAYARSLGCSDVEFSPEDAGRTNREFLYHILGEVIKAGATTLNIPDTVGYNLPYEFGNLIADIKANTPGIENAIISTHCQNDLGLATANTLAGARAGARQLEVTINGIGERAGNASLEEVVMAIKCRPELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIGPDGEEKIACSVGTGPVDAAYKAVDQIIQIPTVLREYGMTSVTEGIDAIATTRVVVTGDVSNNSKHALTGHSFNRSFSGSGASMDVVVSSVRAYLSALNKMCSFAGAVKATAVSESTRVQSKE

SEQ ID NO: 24682 - DNA, 698 bp, Panicum virgatum
  misc_feature: Ceres CLONE 1860097
  misc_feature: Encodes the peptide sequence at SEQ ID NO. 24683
aattcaattctcctccgcaacctcccacctcccctccgcctccttccccttggacgataaccccaacgcaagcgagcgggcggcaccgagcgagcgagcgagccagccatggagaaggcgatcgaccggcagcgggtcctcctcgcccacctcgtcccctcctcctcgtcctcgcggccgcagctggaggcgtcggcgtgcgcggccggggacagcgccgcgtaccagaggacctcctccttcggagatgatgttgtcgtcgtcgcgtaagccttcttcctacagtttttgtttcttctctcctccccccctctttcttagggagtactcctatttcagtattgctttgtttagaacaacaactcttcgacgtgctgactgatgggaagttagaaactgaaattgcgccccatcggatcgcgtcgattaacctcagttagtcatgaggagaactcacctcagcaattcagcccactaaccatgtcctgctatttaccaacgagaatgcgtagtctagtcagctaattcacaggaataagtacagataaggataccgctatgcagagacagacgaactcaattaatcaaaatgttcgaaaaagaaaacttagcaacccaaggatagctgctttggccctttaagtatcaatcattatgctgcatatgtgtatccattgacggatgcctcttccttgtgt

SEQ ID NO: 24683 - protein, 53 aa, Panicum virgatum
  misc_feature: Ceres CLONE 1860097
  misc_feature: SWISSPROT Homolog: EC 2.3.1.16 Acetyl-CoA C-acyltransferase
MEKAIDRQRVLLAHLVPSSSSSRPQLEASACAAGDSAAYQRTSSFGDDVVVVA

SEQ ID NO: 24684 - DNA, 704 bp, Panicum virgatum
  misc_feature: Ceres CLONE 1860100
  misc_feature: Encodes the peptide sequence at SEQ ID NO. 24685
aggaagccggaagctccagtgcggcacacacccaccgagagcgaggacgcggcggcgccggcgaggggagagctcaggaagtgccgctgccttgagcgggcgatatggccgtggtgacggcgctggcggtggtggtggtggcggcgctcgcgccggccgcgcgcggggtggaccggagcgagttcccgccggggttcctcttcggcgccgcgacgtcggcgtaccagatcgagggcgcgtacctggaggacggcaagggcctcaacaactgggacgtcttcacccacacgcactctggagggatcatggacgggcggaacggggacgtggccgacgaccactaccatcgctacatgggagacgtggaggtgctgcagtcgctgggcgtcaacgcgtacaggttctccatctcatgggcaaggattctaccaagaggcaggatcggcggcgtcaatccagacgggatagcgttctacaaccgcctgatcgatgccctcctgcagaaaggagtacagccgttcgtcacgctgcaccatttcgacatgccgcacgagctggaggtccgacacgttggctggctgggcgctggaatccgggaggagttcgagcactacgcggacgtgtgcttcggggcgttcggcgaccgggtgaggttctggacgacgttcaacgagcccaacctgctcaccaagttcatgtacatg

SEQ ID NO: 24685 - protein, 199 aa, Panicum virgatum
  misc_feature: Ceres CLONE 1860100
  misc_feature (23)..(199): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
  misc_feature: Useful for making plants with modulated biomass
MAVVTALAVVVVAALAPAARGVDRSEFPPGFLFGAATSAYQIEGAYLEDGKGLNNWDVFTHTHSGGIMDGRNGDVADDHYHRYMGDVEVLQSLGVNAYRFSISWARILPRGRIGGVNPDGIAFYNRLIDALLQKGVQPFVTLHHFDMPHELEVRHVGWLGAGIREEFEHYADVCFGAFGDRVRFWTTFNEPNLLTKFMY

SEQ ID NO: 24686 - DNA, 2699 bp, Panicum virgatum
  misc_feature: Ceres CLONE 1860139
  misc_feature: Encodes the peptide sequence at SEQ ID NO. 24687
gtcttcccccatccgaacgttgccacccggtcccagctctccgttccccacccaaggacgttacgtctcctcaccgttcccgccgccgccgcccccgcccccgcccccgcccccctgtccaagcgcaaaccatctggtgtacgtgcaccgccgcctcaccttgccccacgatcgatcccgagttctcgacctcgctcgtgcgcacgtgatggtgcggcgcggggcggctgcggtggcggcggcggcgcgcgaggaggaggagtcgccggcgcagaggctcatcgaggccgcgctgcgcggggacgcgggggccgtggaggcgtgcctgcaggcggacgcggacgtgcccgccgcgagccgcgtcggggtggcgcgcctgcgcgtgaggtctgcggacgtggcgctgcgggaggaggcgcccggtgaggtggtcgtggaggagagggaactgaagaccgacgtctcgccgctcgtcgccgcggcgcacgccgggcaagccggcatcgtccgtgccctcctggaggctggagctgacgttaatcagaagttattcctaggttatgcaacaacagctgctgcacgtgcgggaaacattgatattctagaaatgcttatgctggcgggagccacccaggagccttgtgaagatgcactatcagaagctagtctttttggtgagactgaagcagttcgaatcctagtttcttcagaggtacttggttctgaagctgtggcccgtgcattagtgacttctgcttcaaggggctttgatgatatagtggtcatattactccagaatggagctgatgttaactgcatggctcgggttctcttgaggtctgttaagcctgcgctccatgctaatgtggactgcacaccaatagtggcagcaattataagtcggcaaatttcaattgtaaaacttttgatagaggaaggttcttacttggactctcttgtgcaagttggttcttggtgttgggatcctgtgttgggtgaagaacttcgtgtaggtacatgccttggtgaacattacaacgctatttggtgtgcagtagaatactacgaatccagtggtgaaattctcaagctactgcttgatagagctccttggttgttggaatcaccaaaaaatggtcgaaatcttctgtgccatgccatactctgtcagaacccgaaagcagtaagtttgcttctgcattgtggcgcgaatcctagatttcccatcatgacagttggtggacatgtttcctatcctatgcatttggcggcaaggttgggttatgcgcaagtattgaaacagcttatggtacatggagcagatgtgaacgcaaaaacctctgctggggatactcctctcatggtctctgcaagggctggtcatcctgactgtttcctggagttgataaaatttggagctgaccttgggatagtcaaccatgaaggagatacagcaattatgatagctgatcggagttcatttcacttctcagctgtcgacattctcatgagaacattgaactgtggagcaggccttatttcatctgacatgactctcttctcaccgttacacttctttgccagaagtgggcgtgcagaacctcttctaatgatgctacatcagtcagcttcagatttaaacaagcttgatggttcagggctcactcctgttatggttgctgccgagtcaggtcatgttgatatttttaggattttagtcatggcgggggcagatatcacaatcagaaatggagaagggaaatctcttatgtcaattattcgacaaaaatcttcagagactagagattgctttgaacagatcttgctccaagcttcacttaccaccacactcactggccaaacatcattccggcctctgcattacgcagctcgaatcggcgacaagtcatctttactgcaacttctaaaaatgggctacgatcccaattcactggatgaagatgactgcacccctctgatgcatgcagctgcttccggcaggctagactcgtgcaaaatattggtatcacaaggaggggcagattacagccttgtgaatgaaagaaatgaaacagccctgtcgttagtaaggaagagcagtagatcgagcaaagcaacagaagagtggttgctagatcaactttcgcatgctcatgttcttgttggggaggagctgatgaaacacacaagagaagggaagggctcaccacaccaaaagactgtgcgcatgacaaattctggagtgctgacatggggaaccgctcgcaaaaggaatgtgacatgcaaagaggcaagatttgggccaactacgagcttcaccaagaacaggagcacggacagatctgcgcagcagttgatctttctggttgagacggtgacaggcagagaggtccattttgaggccagttgtgcttccagtgtggaattctgggttagagggatcaatctcattgtaaaagagtccacaaggtcaaggctggataaagaggcagtgggagtggaacaaacagcgtagccagtcttcatgaagcgcggccttgggattcgtagtgtgtgtgtacattttgctcttctctcaaaaaaaagtatattcttttatattacacagtaccgcttagacactttttgatctgcaagttaatagcttatattttaagtttgtaagttaataacatatttattagggattgctaagggtg

SEQ ID NO: 24687 - protein, 768 aa, Panicum virgatum
  misc_feature: Ceres CLONE 1860139
  misc_feature (483)..(515): Pfam Name: Ank Pfam Description: Ankyrin repeat
  misc_feature (379)..(411): Pfam Name: Ank Pfam Description: Ankyrin repeat
  misc_feature (346)..(378): Pfam Name: Ank Pfam Description: Ankyrin repeat
  misc_feature (585)..(618): Pfam Name: Ank Pfam Description: Ankyrin repeat
  misc_feature: SWISSPROT Homolog: EC 2.7.11.1 Non-specific serine/threonine protein kinase
MVRRGAAAVAAAAREEEESPAQRLIEAALRGDAGAVEACLQADADVPAASRVGVARLRVRSADVALREEAPGEVVVEERELKTDVSPLVAAAHAGQAGIVRALLEAGADVNQKLFLGYATTAAARAGNIDILEMLMLAGATQEPCEDALSEASLFGETEAVRILVSSEVLGSEAVARALVTSASRGFDDIVVILLQNGADVNCMARVLLRSVKPALHANVDCTPIVAAIISRQISIVKLLIEEGSYLDSLVQVGSWCWDPVLGEELRVGTCLGEHYNAIWCAVEYYESSGEILKLLLDRAPWLLESPKNGRNLLCHAILCQNPKAVSLLLHCGANPRFPIMTVGGHVSYPMHLAARLGYAQVLKQLMVHGADVNAKTSAGDTPLMVSARAGHPDCFLELIKFGADLGIVNHEGDTAIMIADRSSFHFSAVDILMRTLNCGAGLISSDMTLFSPLHFFARSGRAEPLLMMLHQSASDLNKLDGSGLTPVMVAAESGHVDIFRILVMAGADITIRNGEGKSLMSIIRQKSSETRDCFEQILLQASLTTTLTGQTSFRPLHYAARIGDKSSLLQLLKMGYDPNSLDEDDCTPLMHAAASGRLDSCKILVSQGGADYSLVNERNETALSLVRKSSRSSKATEEWLLDQLSHAHVLVGEELMKHTREGKGSPHQKTVRMTNSGVLTWGTARKRNVTCKEARFGPTTSFTKNRSTDRSAQQLIFLVETVTGREVHFEASCASSVEFWVRGINLIVKESTRSRLDKEAVGVEQTA

SEQ ID NO: 24688 - DNA, 1175 bp, Panicum virgatum
  misc_feature: Ceres CLONE 1860172
  misc_feature: Encodes the peptide sequence at SEQ ID NO. 24689
ttttgctgttgggtgtctgcagggacgaatcagagcagcatcgacagcgatatcacggcgggcgagcgagcgagcatccagggcaggagaatggcgacggtgccgtccctgtacaggcgggtcctcccgtcgccgccggcggtggacttcacctcgccggacggcaagcgcctcttcgcggaggccctcgagggcggcaccatggagggcttcttcagcctcgcctcctgcttccagacgcagtccgagccggccttctgcggcctcgcctccctcgtcgtcgtcctcaacgcgctcgccatcgaccccggccgccgctggaagggcccctggcggtggttcgacgagtccatgctcgactgctgcgaacccctcgacaaggtcaaggcccaaggcatcaccttcggcaaggtcgcctgcctcgcgcactgctccggcgccgacgttcaacccttccgcgccaaccagatcaccgtcgatgacctccgccgccacctcatccgctgcacctcctctcgggactgtcatctcatcgcttcctatcacaggaagcttttaaaacagaccgggaccgggcatttctccccaatcggtggctaccacgccacacaggatatggtgctcatcttggatgtcgcccgcttcaaataccctcctcattgggttccagtgccacttctttgggaagccatgaacacgattgatgaatcaaccggacttctcagggggtctcttatattttctcttctccatcttcctcttgatcacttccattcttcctataaccggcacttatgcagttgggattgctgtcttgttatctaggctagcatctcttacatcttggattgagggatgatagttagaactttgggatatgatttactgactatgtctatgtggatatagtagaagactagaagcaaacatcagagttgataaaaacgaaaaattagtagctggttgcttgagggcttgtatttccttcgggcctggtagcactaaacatcatgttttgttttggcctagaaactgttgtaatttaattcattcgttcttggaaaacataattgcagggaggcacgacgacaggcaccattttttcagtttgaactggtttaattatttttctctgatgttcataacaatgttttctccagagctgtgctaatatt

SEQ ID NO: 24689 - protein, 244 aa, Panicum virgatum
  misc_feature: Ceres CLONE 1860172
  misc_feature (47)..(179): Pfam Name: Phytochelatin Pfam Description: Phytochelatin synthase
  misc_feature: SWISSPROT Homolog: EC 2.3.2.15 Glutathione gamma-glutamylcysteinyltransferase
MATVPSLYRRVLPSPPAVDFTSPDGKRLFAEALEGGTMEGFFSLASCFQTQSEPAFCGLASLVVVLNALAIDPGRRWKGPWRWFDESMLDCCEPLDKVKAQGITFGKVACLAHCSGADVQPFRANQITVDDLRRHLIRCTSSRDCHLIASYHRKLLKQTGTGHFSPIGGYHATQDMVLILDVARFKYPPHWVPVPLLWEAMNTIDESTGLLRGSLIFSLLHLPLDHFHSSYNRHLCSWDCCLVI

SEQ ID NO: 24690 - DNA, 738 bp, Panicum virgatum
  misc_feature: Ceres CLONE 1860172-R
  misc_feature: Encodes the peptide sequence at SEQ ID NO. 24691
gtgaagattccattactaggattgcagcctctgtgtgtagtcaaggagccgccatgctatcaggaaaccttgtctcaagtgattgtttgtgctgcagctgcagggaaacatgttttaaaggtgtgcaagcgaatggtggtgggcctaatactgttatctcaggctctatggtatctgaaggcaatgaacagggtgttgatatgcttttaccaatgccctctctcagcatgagttcgtgcaattcaaacttgggcaatgaaatcatcaagtatccatcaggcgcagatgttctaactgttctactgctggctttgcatcccagcacatggttcagcatcatggatgagaagctgaaaacggaatttcagactcttgtttcaacagacaatctacctgatgttcttaaacaggagataattcatctaaggcggcaactctattatctgaaggcttgcgaggacgaggaatatgaggaccctgtgccatcatccccttagcagtgacgctgaagtgcggcaaccatctcacttgatgagtttatttgctggagcttgaggtcaagagaaaagttacgagagtgataccgggcaagcaatcacatgaggataattcttatagtagtgatggcataatgttgttaggcaaattgccacagcccacaggacatgaccctgattaactacatcaaattaacgcctctgcttgctgaaaggtgatattaattacgcatgattttct

SEQ ID NO: 24691 - protein, 164 aa, Panicum virgatum
  misc_feature: Ceres CLONE 1860172-R
  misc_feature: SWISSPROT Homolog: EC 2.3.2.15 Glutathione gamma-glutamylcysteinyltransferase
EDSITRIAASVCSQGAAMLSGNLVSSDCLCCSCRETCFKGVQANGGGPNTVISGSMVSEGNEQGVDMLLPMPSLSMSSCNSNLGNEIIKYPSGADVLTVLLLALHPSTWFSIMDEKLKTEFQTLVSTDNLPDVLKQEIIHLRRQLYYLKACEDEEYEDPVPSSP

SEQ ID NO: 24692 - DNA, 2068 bp, Panicum virgatum
  misc_feature: Ceres CLONE 1860183
  misc_feature: Encodes the peptide sequence at SEQ ID NO. 24693
gcggcccccggcgctttcggattttggccctggcagttcgtgctcacagcctgctagcgcggctcgggccagggctctccgtcagtgatcgcccgatcagtgggtgcgccatccctgtcagccgcttgttttccgtccaatccatccatctacttgtcacgttcgaacgttcccttccaatccagctgcgtctcgtttttatatgtaacaacatagtatcatccgactggcgagtggattttgcagcggcgcggcgcgagccgacactgtgctctctctgtactgtccgctcgtgctccctctgcctctagagcttgggcggagatggcgccggctgcgaggctgctgctggcgctgctcgcggcggcggcggtcgggccgtgcgccggcgccgggtccggccgcgtcgacctgtggccaatgccggcgtcggtggcccgcggggcgcagacgctcctcgtcagccgggacctcaagctgtccacggccgggagcaactactccgacgggaggggcatcctcagggaggcgttccagcggatgctcgccgtcgtggagctcgaccacgtcgtcaacgggagctacggcggccggggctcgcccgtgctcgccggcgtccgcgtcgtcgtccgctcgcccaacgacgagctcaacttcggggtggacgaatcgtacaagctgtccgtgcctgcgaccgggaacccgctgtacgcgcagatcgaggctcaaacagttttcggagcacttcacgccttggagacgtttagccaattatgcaaatttgatttcaatgcaaggctgattgaacttcattcagctccttggactatcatggacgtgccgaggtttcattaccgggggcttcttattgatacttcaaggcactatcttcctgtcccagtgataaaaagtgtaattgattcaatgaccttcagtaaactgaacgttcttcattggcatatcgtggatgagcaatcatttccccttcaaataccttcatacccaaaattatggaatggtgcatactcttattcagagagatatacatttgatgatgctatcgacattgtacagtatgctgaaaaacgaggtgtgaatgtcttagctgagattgatgtacctggccatgctctctcatggggtgtcggatatccatcattgtggccatcagctacatgtaaagaaccgcttgatgtcagcaatgacttcacattccaagtgattaacggaattctatcagatttcggcaagatttttaagttcaagtttgtccatttaggaggagatgaagtaaacacaagttgctggactaccacaccacgcattaaatcatggttgattcagcatggcatgaatgaatctgatgcctacagatattttgtactgagagctcaaaagatagccatatcacatggttatgacattattaactgggaagagacatttaacaactttggagacaagttggatcgtaaaaccgtggtgcataactggcttggaagtggagttgcacagaaagtggttactgctggtctgagatgcattgtaagcaaccaggataagtggtacctagatcacctggatgctacatgggaaggattttacatgaatgaaccattgacaaatatctacaacccggaacagcagagattggttcttggtggtgaggtatgcatgtggggtgaacacatagatgcatcagacattcagcaaaccatttggccacgtgctgcagcagctgcagagcggctgtggactcccattgagaagcttgcaaaggacccgggatcagtcgctgcaagattggcacgcttcaggtgcttgctgaatcaaagaggggttgctgctgcaccgctagcaggttatggtcgttcagcgccgtcggaaccaggctcctgtctaaggcagtagatattcatattaggtacatattattcatagaggaggaaaataaacatcatttcaggcatccaatttaccaccccgagcgattaagaggagctcggatcaatgtaaggctgaccaacagggttttctaatggcattccgtatctgatgttgtgcattc

SEQ ID NO: 24693 - protein, 528 aa, Panicum virgatum
  misc_feature: Ceres CLONE 1860183
  misc_feature (175)..(480): Pfam Name: Glyco_hydro_20 Pfam Description: Glycosyl hydrolase family 20, catalytic domain
  misc_feature (42)..(173): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature: Useful for making plants with altered carbohydrate content
MAPAARLLLALLAAAAVGPCAGAGSGRVDLWPMPASVARGAQTLLVSRDLKLSTAGSNYSDGRGILREAFQRMLAVVELDHVVNGSYGGRGSPVLAGVRVVVRSPNDELNFGVDESYKLSVPATGNPLYAQIEAQTVFGALHALETFSQLCKFDFNARLIELHSAPWTIMDVPRFHYRGLLIDTSRHYLPVPVIKSVIDSMTFSKLNVLHWHIVDEQSFPLQIPSYPKLWNGAYSYSERYTFDDAIDIVQYAEKRGVNVLAEIDVPGHALSWGVGYPSLWPSATCKEPLDVSNDFTFQVINGILSDFGKIFKFKFVHLGGDEVNTSCWTTTPRIKSWLIQHGMNESDAYRYFVLRAQKIAISHGYDIINWEETFNNFGDKLDRKTVVHNWLGSGVAQKVVTAGLRCIVSNQDKWYLDHLDATWEGFYMNEPLTNIYNPEQQRLVLGGEVCMWGEHIDASDIQQTIWPRAAAAAERLWTPIEKLAKDPGSVAARLARFRCLLNQRGVAAAPLAGYGRSAPSEPGSCLRQ

SEQ ID NO: 24694 - DNA, 707 bp, Panicum virgatum
  misc_feature: Ceres CLONE 1860202
  misc_feature: Encodes the peptide sequence at SEQ ID NO. 24695
gccgtctcctcctcccctcccccccactcccagatccaatccgcgagctctcccgcccgctgcaatgtcgctctccgtggagaagacctcgtcggggcgggagtacaaggtcaaggacctgtcccaggccgacttcggccgcctcgagatcgagctggccgaggtcgagatgcccgggctcatggcctgccgcgccgagttcggcccgtccaagcccttcgccggcgcaaggatctccggctccctccacatgaccatccagaccgccgtcctcatcgagaccctcaccacgctcggcgccgaggtccgctggtgctcctgcaacatcttctccacgcaggaccacgccgccgccgccatcgcgcgggactccgccgcggtcttcgcctggaagggggagacgctcgaggagtactggtggtgcaccgagcgctgcctcgactggggcgagggcggcggccccgacctcatcgtcgacgatggtggcgacgccacgctcctcatccacgagggcgtcaaggccgaggaggagtacgagaagaccggcaaagtcccagacccggagtccaccgacaacgccgagttcaagatcgtgctcaccatcatccgcgacgggctgaagtctgaccccaagaagtaccgcaagatgaaggagaggctccttggagtctcggaggagaccactaccggagtcaagaggctctacc

SEQ ID NO: 24695 - protein, 214 aa, Panicum virgatum
  misc_feature: Ceres CLONE 1860202
  misc_feature (12)..(214): Pfam Name: AdoHcyase Pfam Description: S-adenosyl-L-homocysteine hydrolase
  misc_feature: SWISSPROT Homolog: EC 3.3.1.1 Adenosylhomocysteinase
MSLSVEKTSSGREYKVKDLSQADFGRLEIELAEVEMPGLMACRAEFGPSKPFAGARISGSLHMTIQTAVLIETLTTLGAEVRWCSCNIFSTQDHAAAAIARDSAAVFAWKGETLEEYWWCTERCLDWGEGGGPDLIVDDGGDATLLIHEGVKAEEEYEKTGKVPDPESTDNAEFKIVLTIIRDGLKSDPKKYRKMKERLLGVSEETTTGVKRLY

SEQ ID NO: 24696 - DNA, 441 bp, Panicum virgatum
  misc_feature: Ceres CLONE 1860232
  misc_feature: Encodes the peptide sequence at SEQ ID NO. 24697
agacagagtaacctagctagctagcctgcacgcagcgagccagttgagaactgcttgttgcaggggacacacgcacacgcatcgctggtgtacgcccatggctgcgagcgaggctgcgtctcctcctttcagcgtggagatgatgatgagcgccgccgggctcacgggcttcgagccctgcgcgtggggcgacttcttcatcacccacgctccaccgctctcacaggtgattactcctaattaaacgccatggaaccacagaaggaggctgagaagcggatgcgggagcgggtggagcagctcaagggcgagctgcgccgccgtgtgtttggggccgccggcgaggccatgagcgtggcggacacggtggcgctggtggacacgctcgagcgcctcggcgtggacgcccacttccgcgaggagatcggcgccgcgctaaaa

SEQ ID NO: 24697 - protein, 63 aa, Panicum virgatum
  misc_feature: Ceres CLONE 1860232
  misc_feature: SWISSPROT Homolog: EC 4.2.3.9 Aristolochene synthase
MEPQKEAEKRMRERVEQLKGELRRRVFGAAGEAMSVADTVALVDTLERLGVDAHFREEIGAAL

SEQ ID NO: 24698 - DNA, 441 bp, Panicum virgatum
  misc_feature: Ceres CLONE 1860235
  misc_feature: Encodes the peptide sequence at SEQ ID NO. 24699
atgatggctaggtttcaatgagcgggggagctagcagcagcagctagcactctcgtctcggcggcatggcggcagcggtggcggtgacggcggccgctctcatggcggcggcggcgctgctcgcgctgtggttcctagcgtggcggacgcccgcggtggcgcgggcgatagcgcggcaagaggaccgtggcccgccctacacgttcctggacgggtccctgccggaaatgaagcggcagctggcggccggcctggtaggggtggcgccccacgacgccaactgccacgacataatgccagtcctgctgccccagtgcctcacacgggaggaccactatgggaaaacatttctgttgtggatgggcccctttcccgccctcttctctaatgatctccagctggttaagcaagagctccctgaacagatgcgtacaggaccag

SEQ ID NO: 24699 - protein, 125 aa, Panicum virgatum
  misc_feature: Ceres CLONE 1860235
  misc_feature: SWISSPROT Homolog: EC 1.3.3.9 Secologanin synthase
MAAAVAVTAAALMAAAALLALWFLAWRTPAVARAIARQEDRGPPYTFLDGSLPEMKRQLAAGLVGVAPHDANCHDIMPVLLPQCLTREDHYGKTFLLWMGPFPALFSNDLQLVKQELPEQMRTGP

SEQ ID NO: 24700 - DNA, 2129 bp, Panicum virgatum
  misc_feature: Ceres CLONE 1860307
  misc_feature: Encodes the peptide sequence at SEQ ID NO. 24701
accataccagaggattcgctttgcttgcttgcgtttaaaagccccaccccaccccaccgctcctccccccatctgcagcagcagcagcagcagcgctgcgccggaggaggggagacgaccagaccaccggatccttgcccttgcgattgcagcagatcggactcggagctccaagcctgaagaagaatcatcctccatccatggcggacgtgcatgaaccattggtgcgctgcaagatgaagacagttttggtggactacttggtgcagttccgatggatcctcgttatctttgtggtccttcccgtttcagctctcatctacttcaatatctatctgggcgacatgtggtccgccatgaagtcagagaagaagcgccagaagcaacatgacgacaatgtgcagaaggttgtcaagcggctcaagcagaggaacccaaagaaggatggtcttgtttgcacggccaggaagccttggattgctgttggcatgcgcaatgtggactacaagcgtgccaggcattttgaggtcgacctttctgccttcaggaacatcctggagattgacaaggagaggatggttgctaaggttgagccccttgtcaacatgggtcagattaccagagctacttgccctatgaaccttgcccttgcagtcgtcgcggagctcgacgacctcactgttggtgggctcatcaatggttatggtattgaggggagctctcacctctatggccttttctctgacacggttgttgcaatggaagttgtccttgcagatggcagggttgttagagccaccaaggacaacgagtactctgaccttttctatggcattccctggtcccagggaacacttgggttccttgtgtctgctgagatcaagctcattcccatcaaggaatacatgaagctcacctacactccggtcaatgggactctcaaggaaattgcgcaggcctatgctgattctttcgcaccaagagacggtgaccctgcaaaggtccctgactttgttgaaggaatggtgtacacagagagcgaggctgtgatgatgattggtgtttattcttcgaaagaagaggcgaagaggaagggcaacaagatcaacagcgtcgggtggtggtttaagccttggttctaccagcatgctcagacggccctgaagaggggcgagtttgtggagtacatcccgacaagagagtactaccaccgccacacccggtgcctgtactgggaggggaagctgatcttgcctttcggcgaccagttctggttcaggttcctgctgggttggctgatgccgccgaaggtgtctctgctgaaggcgacccagggtgaggctatcaggaactactaccatgacagccacgtgatccaggatatgctggtgccgctgtacaaggttggagatgcccttgagtttgtccaccgcgagatggaggtatatccgctgtggctgtgccctcaccgtctgtacaagctgcctgtgaagacaatggtgtaccctgagcctgggttcgagcaccagcacaggcagggtgacacaagctatgcgcagatgttcacggacgtgggtgtgtactacgcccccgctgctgtgctaaggggcgaggagttcaatggtgtggaagcggtgcaccggctggagcagtggctgatcgagaaccacagctaccagccgcagtacgccgtgtcggagctgaatgagaaggacttctggagaatgtttgacgcgtcccactacgagcactgccgtcgcaagtacggagcagtggggatgtttatgagcgtgtactacaagtcgaagaaggggcggaagacggagaaggaggtgcaggaggcggaggcggccatcctggagccagcctatgccgacgaggcctaatcctagctggcaatgttggtgtctggtgatttagatgtgggccgccgccgcagagtttgttttgtttacctgatgggattggaacgagatgttgtgtctcggttcttattctgcttgcttagaataacttgattccatagtgtgtctgtggtggtgagtctttgccgttgtagcgattgtgtgtttatcatttcttatggaattgctgaactttaaatgcatggctctctgttttgtgtccac

SEQ ID NO: 24701 - protein, 561 aa, Panicum virgatum
  misc_feature: Ceres CLONE 1860307
  misc_feature (55)..(200): Pfam Name: FAD_binding_4 Pfam Description: FAD binding domain
  misc_feature: SWISSPROT Homolog: EC 1.1.3.8 L-gulonolactone oxidase
MADVHEPLVRCKMKTVLVDYLVQFRWILVIFVVLPVSALIYFNIYLGDMWSAMKSEKKRQKQHDDNVQKVVKRLKQRNPKKDGLVCTARKPWIAVGMRNVDYKRARHFEVDLSAFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVNGTLKEIAQAYADSFAPRDGDPAKVPDFVEGMVYTESEAVMMIGVYSSKEEAKRKGNKINSVGWWFKPWFYQHAQTALKRGEFVEYIPTREYYHRHTRCLYWEGKLILPFGDQFWFRFLLGWLMPPKVSLLKATQGEAIRNYYHDSHVIQDMLVPLYKVGDALEFVHREMEVYPLWLCPHRLYKLPVKTMVYPEPGFEHQHRQGDTSYAQMFTDVGVYYAPAAVLRGEEFNGVEAVHRLEQWLIENHSYQPQYAVSELNEKDFWRMFDASHYEHCRRKYGAVGMFMSVYYKSKKGRKTEKEVQEAEAAILEPAYADEA

SEQ ID NO: 24702 - DNA, 3094 bp, Panicum virgatum
  misc_feature: Ceres CLONE 1860308
  misc_feature: Encodes the peptide sequence at SEQ ID NO. 24703
agacgcggcgcgctccccctccccatctccggctggtctcgccgggagtaagggaagcgaagccgctgaagcggcatggagcccaagccgtcttcggcggcgcacggtgacgcgccagcggccgaggccccccgccgccgcggcggcggcggcaagcgcaagtcgtctgggtcctcgttcacgccgtcgaagcggcaggccaaggagaggaacgctgccttccacgtgcccccgcacctgctgcacagcgggccgctcacgcgcgccgcgcgccagtcgccgcacaagctcgcgggcgcgccgccagagccgggaccagcgtcatcggcggccccagctggggatggggtcggcggcgggcagggagaggtcggtgcgatccgccccgaaagggaggagacgccggcagcggagcagccgctggtggatgaggtgttcgaggccgtccgatcccgcggcgccggcgtccatgtggtccctacctttgctggatggttttcatggaaagagatccacccggttgagaagcagaccttgccttccttttttaatggaaaatctgagaagcggacacctgagatatatttggcgattagaaattccatcatgatgaaatttcatgccaatcctcagttgcagctggagtccaaagatttggccgagttgtcaatcggggagatcgatgctcggcaggaagtcttggagttcttggatcactggggcttgataaattttcacccttttccaccagctggacaagaggagagtaagcctgaggcgagccaagacaattctcatgatgaggacaaggcttctttgatcgacaagttgtttaaatttgaaccggttcaatcatatatgatgcctttgcccaagaaagaagatgtgggagctccaccccctctgcctagcttgtttcctgatcctgtacttcttgaagatgtagttgcagcagctgagccttctgttgagtaccactgcaactcatgttcagttgattgctcgcggaagcgctaccactgtcggacccaggcagattttgacctgtgttgtgattgctataacgaaggaaagttcgatccaggcatggccaaaactgatttcatcctcatggattcttcagaagtttcaggtgctagtggtactagctggactgatgaggagaccttgcttcttttagaaggtttagaaatttttggtggaaaatgggccgagattgctgaacatgtagctactaaaacaaaaacgcaatgcatgttgcactttcttcaaatgcaaatcgaggaccgcttccatgatgccgaagatattaatcaaaatatcccaggaagtactgagcaagtcacaactgagaaaggcattgctgaaacatctgagaaaatggacgttgaagataaagcggaaggaaaagatactgcagatgagagggcctcagagaaaatagagggcaactgtgaaggaacgaaaactgaagatgcaagtgctgttgaaaataaagatactcagaactcagttagcaaagattcagctgcatccccgaacactgaagagccaaaacaatcatctgatgagcaacctactgcaaaggagaattctgctgatgtcgacacttctggtgaaaaactgtcgaattttgctattgatatcctaaaatctgtgttcgaggctgctggtcacagcccagaatacgaaggttcatttgctgatgcaggaaacccagttatggcactagcagcatttttagctggccttgtggaagatgatagtgctaccacttcctgccgtagttccctaaaagccatctctgaggtgtctcctgcgctccaattagctagtaggcactgttttattcttgaggaaccaccaaatgatctgaaagacatttgtgttagtgtaagtaataaaaatacagatggtgatcaaacgaaagatgaggagatcactaaaaattcagttgatactgagaaaaaggaaatcaatgagaacaaagataattctttatctgtgaaaaagcataataattcatctatctcacaaaacgacaaccaaggatcagacggtaagaatgtctcatgtgatgattgccccataaaggaggccaaaaccaataatgccatggagtcaggtgattcaactgctactgtggataagagtgcaactgacaatacaaaaggaagtaatataggtgcaagtaatcctaagcaagtaaatgacaaaccaaatgtcgagatggaggctcctgacgattcatctttaaaagggaaggaccggctcaataagactaaagatgcagttgctacaccagccacccaacaggaagataggcaaagtgaaacattggaaaatggcaatgtgggagaacctaacaacattgagagtgtagctgccaacgaagagaagggctctatagttactgcaaatcagaatgattccataactaggctcaaacgagcagcagccactgctatatcagcagctgctgtgaaagctaaatttcttggtgatcaggaggaatatcacattcgaaggttgacagcactgatgattgaaagactgttccaaaaaatagaagtgaagatgtcgttatttgctgagattgagcaggtggtccttcgaacaagagagtacacggagaagaccagaaagaagctcctattggagcgaaatgcgataattgcagctcgcatgggggcattgccatctaggccaaatcagcctggtgtagctggaaacagattaccgcctggatatggcaaccctgctgtacggccaccaaatgcaatgccacgacccagcagctgaggaaattcagattccagactcctagtgacctatacttcattacttcattcttttagaagcatacctgtaagactcaaaccgaccagcttgttgtagcattttttagaaagtacatgtacaattgtctgtataactgccgccatgaaaattcaacatttttcgcttgaattttcgattgtactcgcttctcgggacgccatagcaccacaaagattttaaaccttcagtcagatatggtctatgttgtaaaatagagaataattcttatcatattctgtgatagtgtgattag

SEQ ID NO: 24703 - protein, 908 aa, Panicum virgatum
  misc_feature: Ceres CLONE 1860308
  misc_feature (132)..(220): Pfam Name: SWIRM Pfam Description: SWIRM domain
  misc_feature (356)..(401): Pfam Name: Myb_DNA-binding Pfam Description: Myb-like DNA-binding domain
  misc_feature (296)..(340): Pfam Name: ZZ Pfam Description: Zinc finger, ZZ type
  misc_feature: SWISSPROT Homolog: EC 2.7.11.1 Non-specific serine/threonine protein kinase
MEPKPSSAAHGDAPAAEAPRRRGGGGKRKSSGSSFTPSKRQAKERNAAFHVPPHLLHSGPLTRAARQSPHKLAGAPPEPGPASSAAPAGDGVGGGQGEVGAIRPEREETPAAEQPLVDEVFEAVRSRGAGVHVVPTFAGWFSWKEIHPVEKQTLPSFFNGKSEKRTPEIYLAIRNSIMMKFHANPQLQLESKDLAELSIGEIDARQEVLEFLDHWGLINFHPFPPAGQEESKPEASQDNSHDEDKASLIDKLFKFEPVQSYMMPLPKKEDVGAPPPLPSLFPDPVLLEDVVAAAEPSVEYHCNSCSVDCSRKRYHCRTQADFDLCCDCYNEGKFDPGMAKTDFILMDSSEVSGASGTSWTDEETLLLLEGLEIFGGKWAEIAEHVATKTKTQCMLHFLQMQIEDRFHDAEDINQNIPGSTEQVTTEKGIAETSEKMDVEDKAEGKDTADERASEKIEGNCEGTKTEDASAVENKDTQNSVSKDSAASPNTEEPKQSSDEQPTAKENSADVDTSGEKLSNFAIDILKSVFEAAGHSPEYEGSFADAGNPVMALAAFLAGLVEDDSATTSCRSSLKAISEVSPALQLASRHCFILEEPPNDLKDICVSVSNKNTDGDQTKDEEITKNSVDTEKKEINENKDNSLSVKKHNNSSISQNDNQGSDGKNVSCDDCPIKEAKTNNAMESGDSTATVDKSATDNTKGSNIGASNPKQVNDKPNVEMEAPDDSSLKGKDRLNKTKDAVATPATQQEDRQSETLENGNVGEPNNIESVAANEEKGSIVTANQNDSITRLKRAAATAISAAAVKAKFLGDQEEYHIRRLTALMIERLFQKIEVKMSLFAEIEQVVLRTREYTEKTRKKLLLERNAIIAARMGALPSRPNQPGVAGNRLPPGYGNPAVRPPNAMPRPSS

SEQ ID NO: 24704 - DNA, 1010 bp, Panicum virgatum
  misc_feature: Ceres CLONE 1860314
  misc_feature: Encodes the peptide sequence at SEQ ID NO. 24705
gtaacacctcagtcccatttccacaccgccccccgcgggcgcctcaggcaaagaggggccgcgggcgcggctgctacacaccgggaccgaggccgaggctgcgcgcgcgttataagcaccaccgcggcacgctcgctgatcgcgcgccggccagcagcagcagcggcggggaggaggcgagccgcgggccatcgtcccttgctcgccgtgggctccagcgacgcgtcgcagccggcaggatcctcctccggtggaccgtccggcgagggcagaatgtcttcggccccgctgctcggcggcggggagcccgagcgggcgccgtcgtggctggggcgcgtggtggacacggaggaggcgcgcgcgcagctgcggttcgcggtgccgatggtgctgaccagcatggcctactacggcatcccgctggtgtcggtgatgttctcgggccacctcggcgacgtccacctcgccggcgccacgctcggcaactcctgggccaccgtcaccggctacgccttcgtgacgggcctgagcggcgccctggagacgctgtgcgggcaggcgtacggcgcgcggctgtaccggatgctgggcctgtacctgcagtcgtcgctcatcatgtcggccgccgtctccgtgctcgtctccgcgctgtggtgcttcacggagcccgtgctggtgttcctccggcaggacccggaggtgtcccgcgccgcggcgtccttcgtccggtgccagatcccgggcctcttcgccttctccttcctccagtgcctgatccggtacctgcagacgcagtccgtcgtggcgccgctcgtggactgctccgaggcgcccttcgaactccacctcgcgctgccgcacctcctggtgaacctgctcgggctgcccatcgcgagcgcctccgccaccgtgtccgccacgttctccgtctcctgcctcatgctgctcgcctacgtgacgcgctccaacgccttcccccagacctgaacggccttctacgtcgaggcctt

SEQ ID NO: 24705 - protein, 237 aa, Panicum virgatum
  misc_feature: Ceres CLONE 1860314
  misc_feature (37)..(199): Pfam Name: MatE Pfam Description: MatE
MSSAPLLGGGEPERAPSWLGRVVDTEEARAQLRFAVPMVLTSMAYYGIPLVSVMFSGHLGDVHLAGATLGNSWATVTGYAFVTGLSGALETLCGQAYGARLYRMLGLYLQSSLIMSAAVSVLVSALWCFTEPVLVFLRQDPEVSRAAASFVRCQIPGLFAFSFLQCLIRYLQTQSVVAPLVDCSEAPFELHLALPHLLVNLLGLPIASASATVSATFSVSCLMLLAYVTRSNAFPQT

SEQ ID NO: 24706 - DNA, 757 bp, Panicum virgatum
  misc_feature: Ceres CLONE 1860314-R
  misc_feature: Encodes the peptide sequence at SEQ ID NO. 24707
cggatcgcgtacatgatcacgttcgggttcagcgccgccgtgagcacgcgggtgtcgaacgagatcggcgccaggaacgtggctcgtgcgaagaacgcggtgtcggtgacgctcaagctgtccgtgttcctggccgtctctttcgtggcgctgctggcgttggggcacacccagtgggcgcggctcttcagcgggagcgccaccatcgtgtcggagttcgcggccatcgcgccgctgatggcggtgtccatcgtgctggactcggcgcagggggtgctgtccggggtggccaggggctgcggctggcagcacctggcggcggtcaccaacctggtggcgttctacttcgtgggcatgccgctggccgtgctcctcgccttcaagctggacctccgcgccaggggcctctgggcggggctcatctgcgggctcgcgtgccaggccgccgccctgctcgtcatcaccgcgcgcaccaggtggtccgacctcatcgacgccatgcgggaggagaaggccaactacgtcgcctagcaagacacccgtattacttgctcacggcatagtactagttactgctcactactgtactactaaggacgaaaatggacgagaagttgtgcatcgaaagcacacgagcgagtttttttttttgtggcgacggcagtactgtaggggtttataggagctagaggttctggagagtggagattatcatcaagatttcacacgaacctactatatatgcatgcaaacaaac

SEQ ID NO: 24707 - protein, 176 aa, Panicum virgatum
  misc_feature: Ceres CLONE 1860314-R
  misc_feature (1)..(124): Pfam Name: MatE Pfam Description: MatE
RIAYMITFGFSAAVSTRVSNEIGARNVARAKNAVSVTLKLSVFLAVSFVALLALGHTQWARLFSGSATIVSEFAAIAPLMAVSIVLDSAQGVLSGVARGCGWQHLAAVTNLVAFYFVGMPLAVLLAFKLDLRARGLWAGLICGLACQAAALLVITARTRWSDLIDAMREEKANYVA

SEQ ID NO: 24708 - DNA, 2025 bp, Panicum virgatum
  misc_feature: Ceres CLONE 1860317
  misc_feature: Encodes the peptide sequence at SEQ ID NO. 24709
gtaatagtggtggcgtgtctgcggccgtcgtcgtcccgcccgtcggcttgcattggctcgccggagccggtcggccgccgctgctataagtacgtgacccgcagcagaaggtgagcgggcgtcagtgtcagacgtgctgtctgtcagcgatcaagccttgtctctcgccgcggcggcgcgcgcgacggccatgtcggagtcggagaaggggtcctcgtcggcggcgaaggtggcgctgagccggccatgcgtccttgtcatagtgatggccggcgtggagaggttcgcgaacaaggggatggggtcgaacctggtgacgtacctcaccggcgtggtggggatgagcacggcggcggcggccaagagcgtcgtcacctggaccggggtcagcttcatgctgccgctcctcagctccatcctgaccgactcctactgggaccgctactccaccctcgccgcctcctccttgctctacgtcctggggatggtgtccctcaccgtatgggcactgctacgcccacggatgccgcgccccacgctgttcatcccgctctacctgatggccgtcgggcaaggtgggtaccaacccacgctgcaagccttcggcgccgaccagctcggcatcggcgacgacgacgccgagccgggcctgacggcggaggagaagggcaaggtgaagagcatgttcttccagtggtggtacttcggcatctgcagcggcagcctgctggggaactccaccatgtcctacgtccaggacaacttcggctgggtgctcggcttcgccatccccagcggggtcatggccctgtccgtcgcggccttcttctgctgcacacctctctacaggcagacgcaacccaagggcgccggcggcaagccgtcgtctccgagtggcttctgcaaggtcctcaagtccattctcgcaggtcgaaagatcagcctgccgtccatggacgacaatggcggcaccatgtctgagctagagttgcaagagaagccactgaaagctgaaccaggcgatgaaaataaggagggcgtggacgaggccgcgcccagcatgggcaaggtcatcctcggcctgctgccgatctgggccatcctgctcatcttcgcggtgatcttccagcagccgatgacgttcttcacgaagcagggcatgctgatggaccacacggtcgggcgcggcgccttcgtgatcccgccggcgatgctccagagctcgatcaccgtctccatcatcctgctcgtgcccatgtacgaccgggtgatcatcccgctgatcaacgccgtcacccggggcagcgacggcatcaccgtgctccagcggatcggcgtcggcatggtcctctccgtcgtcgccatggccatcgccgcgctcgtcgagtcgtggcggctccgcgtgtccgcggcgtccgggggagcctaccggctcaagatcttctggctgctgccgcagtacgtcctgctgggcgtctcggacgtgttcacggtggtggggatgcaggagttcttctacacgcaggtgccgtcgtccatgaagacgatcagcatcgggctctacctcagcgtcttcggcgtcgggggattcctcggcgccttcctgatcaccgtgctcgagatggccacggcgaggcccggcaactccaaggggtggttctccgacgacccccgggaggcgcacctcgacaactactactggttcctggctctgctgtgcttcatcagctttgtgatcttcacgcacttgtgcaagttctacagcagcaaaaatgcatcagggaagtaggatctggtggagtgggtactagagcgatttgctgttcgatcttgatgtttctttcgcggtggtttcagggatagttcaggtaatcaggtgtgctctgttttcagacttgagagtgagctgtgtagttcggaacttcaggtgtgttctgttgtgtgaaaggtgaaacacctgtacataggcagagtctacttataatctgtcagagaaaatatgctgaatacatactcttttttctc

SEQ ID NO: 24709 - protein, 532 aa, Panicum virgatum
  misc_feature: Ceres CLONE 1860317
  misc_feature (85)..(462): Pfam Name: PTR2 Pfam Description: POT family
MSESEKGSSSAAKVALSRPCVLVIVMAGVERFANKGMGSNLVTYLTGVVGMSTAAAAKSVVTWTGVSFMLPLLSSILTDSYWDRYSTLAASSLLYVLGMVSLTVWALLRPRMPRPTLFIPLYLMAVGQGGYQPTLQAFGADQLGIGDDDAEPGLTAEEKGKVKSMFFQWWYFGICSGSLLGNSTMSYVQDNFGWVLGFAIPSGVMALSVAAFFCCTPLYRQTQPKGAGGKPSSPSGFCKVLKSILAGRKISLPSMDDNGGTMSELELQEKPLKAEPGDENKEGVDEAAPSMGKVILGLLPIWAILLIFAVIFQQPMTFFTKQGMLMDHTVGRGAFVIPPAMLQSSITVSIILLVPMYDRVIIPLINAVTRGSDGITVLQRIGVGMVLSVVAMAIAALVESWRLRVSAASGGAYRLKIFWLLPQYVLLGVSDVFTVVGMQEFFYTQVPSSMKTISIGLYLSVFGVGGFLGAFLITVLEMATARPGNSKGWFSDDPREAHLDNYYWFLALLCFISFVIFTHLCKFYSSKNASGK

SEQ ID NO: 24710 - DNA, 1140 bp, Panicum virgatum
  misc_feature: Ceres CLONE 1860334
  misc_feature: Encodes the peptide sequence at SEQ ID NO. 24711
tggctgcaatggttctgcaatggaagagcaaaaggaaaaggaaaacggaaatgggaagggcaaggaaaacggaattgaaactgaaactgaaaaggtgaagaacataaagctggttcacatagattatattttggagaaggctgaaactggcatccacttcgtcggcaatgttctgtatagcagcagtcagataagacgggcacattgttggtttccttgcattgatagcactacacaacgctgtccatttgacctagagtttacagttagcatggatttaattgctgtcagcaatggtgacttactttaccaggtcttaagcaaggaagatcctacaaaaaaaacttatgtgtataagttgaacactccagttagtgcacattggatatccttggttgttgggccacttgaagttcttcctgacagcaatgacataagtgtctcacacatatgtttatcccctgctttgtcaaagcttcggaatacaatcacatttttccacgatgcatacagctgttatgaagactatcttgctacaccatttcccttaggtttgtacaagcagatttttctccctcctgaaatgacagtgttaccaacaagcttaggagcctccacatgcatattcagttcagatatcttgcatgatgagaaggttatagatcagataattggcacaagaatcaaactagcttatgcccttgcaaagcaatggtttggaatatacacaagtgcagaggagcccaatgacgaatggctattggatggtttggctggttttcttactgagatatttatcaagcttttccttgggaataatgaggcacggtataggcgcttcaaggctaacatcaccgtttgtgagtctgatgttagtggtgcaactgctttgagctctcctgctgcttcaagtgatctatatggaactcaaacaattggttcatatgggaaagttcgttcattgaaggcagtagctgttcttcaaatgttggagaagcagatggggccagactcctttcggaagattttgcagttgatagtgaccccaaatcgtgcctcgagaacacttagtacgaaagagttcagacatcttgcaaataaggttggtaacctcgaacgcccattcctaaaggaattctt

SEQ ID NO: 24711 - protein, 379 aa, Panicum virgatum
  misc_feature: Ceres CLONE 1860334
  misc_feature: SWISSPROT Homolog: EC 3.4.11.1 Leucyl aminopeptidase
GCNGSAMEEQKEKENGNGKGKENGIETETEKVKNIKLVHIDYILEKAETGIHFVGNVLYSSSQIRRAHCWFPCIDSTTQRCPFDLEFTVSMDLIAVSNGDLLYQVLSKEDPTKKTYVYKLNTPVSAHWISLVVGPLEVLPDSNDISVSHICLSPALSKLRNTITFFHDAYSCYEDYLATPFPLGLYKQIFLPPEMTVLPTSLGASTCIFSSDILHDEKVIDQIIGTRIKLAYALAKQWFGIYTSAEEPNDEWLLDGLAGFLTEIFIKLFLGNNEARYRRFKANITVCESDVSGATALSSPAASSDLYGTQTIGSYGKVRSLKAVAVLQMLEKQMGPDSFRKILQLIVTPNRASRTLSTKEFRHLANKVGNLERPFLKEF

SEQ ID NO: 24712 - DNA, 730 bp, Panicum virgatum
  misc_feature: Ceres CLONE 1860334-R
ctgcttgctggtgcaaaagcatacaataatgtatttcttcgtcatcatgtgttctgcatattgcaagttgctgctggaaggtctccaacgttatttggtgttccaaaggttgtcgaaccccctctggtggtccaggacatatgtagtgatcaccacactaaagctgattcctcgattcctcaaccatcgaggcctcaagaaccttccactagcactcctagtgtgcgtgaggtcttacctacctctggacccactaaagatgctgataatatatctaactgcagtgaaagaaggaatgtcgtcaaaattagggtgaagcttactgcatcttccagtaaagcgtcggatgctgaccacagagtccattctcatggtggaagaaatgaaaatgaagcgggtccatgtagttctatgtcagtggatgccccaatggttgaagcagcaactgaaccattaaatgtaagcaatcataacattgaggaacagaactcatgtcatgaccgtgagtcaaggatgtcagcaagcattggcaatgctaaactaattgacaggcatgagatttccaaggaactacagtgtactgctgattcaaggctggatgtccttcccaaggatcagttctctcctgccgttaatcctttgggagttgtagacaagcctggtagtcagcttgaagtagtctccaccagctacgatggaaaccaagctccagagtctgtgaatggagtgg

SEQ ID NO: 24713 - DNA, 1363 bp, Panicum virgatum
  misc_feature: Ceres CLONE 1860354
  misc_feature: Encodes the peptide sequence at SEQ ID NO. 24714
gagaaccgccaaattcgtcattgatttttttacccaaacgagtccaagtcgagacgcctctcccccctccgctggcgcagccatggcgtccgccgaaaccctagctcgctccccctcgcgcgagccctcctcagatccgccccaggccgtcgcccgagcccgtctacgacaacctcggcatacgcatcaacacccgcgagtaccgcgcccgcgagcgcctcaaccgcgagaggcaggagataatctcccagctcatccgccgcaaccccgccttcaagcccccctccgattaccgcccgcccaagctccagaagaagctctacatccccatgaaggagtacccagggtacaatttcattgggctcatcattggcccgcggggcaacacgcagaagcggatggagaaggagactggtgcgaagatcgtcatcagggggaagggtagtgtcaaagaagggaagctgttgcagaagagggatctcaagccagatcccagcgagaatgaggacctccatgtgcttgttgaggcagagactcaagaggcgttggatgcagctgctgggatggtggagaagctgctaaccccagttgatgaggtgctgaacgagcacaagcggcagcagctccgagagcttgcggcactcaatgggacaattagggacgatgagttctgtaggacatgtggggagcctggtcacaggcagtatgcttgccccaataagatgtccacgtttaagagtgatgtgcagtgcaaaatctgtggtgatggtgggcacccaacaattgattgtccagtcaagggaacagcggggaagaagatggatgatgaatatcaaaatttcctggctgagcttggtggtgggagtgcacccgagtccatgacaaaatctggtggtccgatgttggctcttacaggaggtggtggtagtggtggtgcttctgctggtagtgggaataacccgccttggtctgctgcaggtggtggtggtgcggctgccactggggccaatggtattaagaaggactatgacgagacaaatctgtatatcgggtacttgccacctacaatggatgatgcaggattgatcagtctgttttcacaatttggggatattgttatggctaaggtgatcaaggatcgaaacactgggcatagcaagggatatggatttgtaaagtattcagatgtctcacaggctaatgctgcgattgctgcaatgaatggccaccatctcgaaggtagagttattgcagttagagttgcaggcaagcctccacagccggcaccggcagtttcaagcaccaccgtcatatcctcctacagatcctgcttctggtgggctattcctcccaatcctacatg

SEQ ID NO: 24714 - protein, 344 aa, Panicum virgatum
  misc_feature: Ceres CLONE 1860354
  misc_feature (238)..(309): Pfam Name: RRM_1 Pfam Description: RNA recognition motif. (a.k.a. RRM, RBD, or RNP domain)
  misc_feature (6)..(80): Pfam Name: KH_1 Pfam Description: KH domain
  misc_feature: SWISSPROT Homolog: EC 5.2.1.8 Peptidylprolyl isomerase
MKEYPGYNFIGLIIGPRGNTQKRMEKETGAKIVIRGKGSVKEGKLLQKRDLKPDPSENEDLHVLVEAETQEALDAAAGMVEKLLTPVDEVLNEHKRQQLRELAALNGTIRDDEFCRTCGEPGHRQYACPNKMSTFKSDVQCKICGDGGHPTIDCPVKGTAGKKMDDEYQNFLAELGGGSAPESMTKSGGPMLALTGGGGSGGASAGSGNNPPWSAAGGGGAAATGANGIKKDYDETNLYIGYLPPTMDDAGLISLFSQFGDIVMAKVIKDRNTGHSKGYGFVKYSDVSQANAAIAAMNGHHLEGRVIAVRVAGKPPQPAPAVSSTTVISSYRSCFWWAIPPNPT

SEQ ID NO: 24715 - DNA, 2488 bp, Panicum virgatum
  misc_feature: Ceres CLONE 1860361
  misc_feature: Encodes the peptide sequence at SEQ ID NO. 24716
aaaatccgccgctgctcctctctcctgctcgctatccctagcgctgtccctcccttccctgcccgacactcccgcgccgtggacggagggtttgggcttttggcggagcgggagcggagacgggcggggcgagccggctcgtctcctgatgcgcgggtaggatcaggcgcgcggatccggccggtgctagccctctcgggaggctgcccgctcgtctctcctgcgagcgtgggaggaggcgcggcggcggcggaggcggaggcatgagcttcgggagcctgttcgacggcggggcgggcggaggcagcggcggcgggatgcagttcccgttctccgccgggttctcgtcctcgccggggctctctctcggcctggacaacaacgccgccgccggcggcggcatgggcggcgggcgggcgcttcccggtggccccggcgcaggcggcgggagtggggcggcgagggacgcggacgccgagaacgacagccgctcggggagcgaccacctcgacgccatgtccggcggcggggaggacgaggacgacgccgagcccggcaacccgcgcaagcgcaagaagcgctaccaccgccacacgccgcagcagatccaggagctcgaggcgctcttcaaggagtgccctcacccggacgagaagcagcgcggcgagctcagcaggaggctcggcctcgacccgcgccaggtcaagttctggttccagaaccgccgcacgcagatgaagacgcaactggagcggcacgagaacgcgctgctcaagcaggagaacgacaagctgcgcgccgagaacatgacgatccgggaggccatgcacagcccgatgtgcggcagctgcgggagccccgccatgctcggggaggtgtcccttgaggagcagcacctgtgcatcgagaacgcgaggctcaaggacgagctcaaccgcgtctacgccctcgccaccaagttcctcggcaagcccatgtccatgctcgcggggcctctgatgcagccacacctgtcgtccttgcccatgccgagctcgtcactggagctcgcaatcggcgacttccgtggcctagggtctatgccctctgctacgatgcctggttccatgggcgaattcgctgggggcgtgtctagcccattgggcacggtgattacaccagcgcgggcaactggatctgctccactggctatggtgcgcattgacgacaggtccatgctgttggagcttgcgatcaacgcgatggatgaactagtcaagctggcacagattgacgagcctttgtggcttccgagcctcaatggttctcccaacaaggagatgctgaactttgaggagtatgcccacaccttcctgccgtgcattggcgtgaagcccatggggtatgtatctgaggcctccagagagtctggcctcgtcatcatcgacgacagtgttgcccttgttgagaccctcatggatgagagacggtggtctgacatgttctcgtgcatgattgctaaggccacagtcatagaggaggtgacctccggcattgcaggaagtagaaatggtgcgctgctggtgatgaaggctgagctacaggtgctctcacctttagtccccattagggaggtcacatttctcaggttttgtaagcagctggctgagggtgcatgggcagtagtggatgtgtctattgatggattgctgagagatcagaactcggcaacaacatccaacgctgcaaatgtaaggtgcatgaggttaccttctggatgtgtgatgcaagacactcccaatggcttctgtaaggtcacatgggtcgagcatacggaatacgatgaggcatcagtacaccagctctatagaccacttctccggtccgggctggcctttggagccaggcggtggcttgcgatgctgcagcgtcagtgtgaatgcctggccatactcatgtcccctgatacagtttcagctaatgactcgtcagttataacacaagagggcaagcgaagcatgctgaagctggcacggcggatgacagagaacttctgcgctggggtcagcgcgtcatctgcgcgtgaatggagcaagctggacggtgcgacaggcagcattgaggaggatgtgcgtgtcatggcacgaaagagcgtggatgaacctggggaaccgccgggcgtggtgctgagcgctgccacatcggtgtgggtgcccgtggccccggagaagctgttcaacttcctccgtgatgagcagctgcgtgctgagtgggatatcctcagcaatggaggcccaatgcaggagatggctaacattgccaaggggcaggagcacgggaactcagtgtccctcctcagggccagtgccatgagtgccaaccagagcagcatgttgatcctccaggagacctgcactgatgcgtcgggctccatggtggtgtacgctccggtggacatcccggccatgcagctcgtcatgaacggcggggactcaacctacgttgctct

SEQ ID NO: 24716 - protein, 741 aa, Panicum virgatum
  misc_feature: Ceres CLONE 1860361
  misc_feature (321)..(553): Pfam Name: START Pfam Description: START domain
  misc_feature (104)..(160): Pfam Name: Homeobox Pfam Description: Homeobox domain
MSFGSLFDGGAGGGSGGGMQFPFSAGFSSSPGLSLGLDNNAAAGGGMGGGRALPGGPGAGGGSGAARDADAENDSRSGSDHLDAMSGGGEDEDDAEPGNPRKRKKRYHRHTPQQIQELEALFKECPHPDEKQRGELSRRLGLDPRQVKFWFQNRRTQMKTQLERHENALLKQENDKLRAENMTIREAMHSPMCGSCGSPAMLGEVSLEEQHLCIENARLKDELNRVYALATKFLGKPMSMLAGPLMQPHLSSLPMPSSSLELAIGDFRGLGSMPSATMPGSMGEFAGGVSSPLGTVITPARATGSAPLAMVRIDDRSMLLELAINAMDELVKLAQIDEPLWLPSLNGSPNKEMLNFEEYAHTFLPCIGVKPMGYVSEASRESGLVIIDDSVALVETLMDERRWSDMFSCMIAKATVIEEVTSGIAGSRNGALLVMKAELQVLSPLVPIREVTFLRFCKQLAEGAWAVVDVSIDGLLRDQNSATTSNAANVRCMRLPSGCVMQDTPNGFCKVTWVEHTEYDEASVHQLYRPLLRSGLAFGARRWLAMLQRQCECLAILMSPDTVSANDSSVITQEGKRSMLKLARRMTENFCAGVSASSAREWSKLDGATGSIEEDVRVMARKSVDEPGEPPGVVLSAATSVWVPVAPEKLFNFLRDEQLRAEWDILSNGGPMQEMANIAKGQEHGNSVSLLRASAMSANQSSMLILQETCTDASGSMVVYAPVDIPAMQLVMNGGDSTYVA

SEQ ID NO: 24717 - DNA, 650 bp, Panicum virgatum
  misc_feature: Ceres CLONE 1860361-R
ttccagatcctcgtcaacagccagccggaccgccaagctccccgtggaatcagtagtgaccgtgaacaacctcatctcatgcaccatcaagaggatcaaaactgcgctgcagtgcgacgccacctgacccgccacaggggatgtcgccgcagggggattcgccgtcgacgaggagcccgagtcaagaacgaaccgcgcgctggaaagaaacctttgctgggtgataaggatctggcttcggcgatccttagcacagagcaatggtggtggttcgggcattgactcggcctctacagtctgcggctgtcctccctggcaaccggtagttggatacagtgccatgcatactggacaatatggtagatggctaatcttatgcttcagtcccatggtttcagggaccaatcaaacattgagtttttttggctggctctttgttagttataatactattctcagttgtgaggtgagctatgtcacatctgtaaacttgcaagctcagaaatgttgggttgctgtagtggtgtcctgcatagaggttatggtagcacaagtgtagctagcatcaaactaccagccaataataatgtctggtcgataaagtggagtaggggtttatcttgaaatgcttgtttaattatatataggtt

SEQ ID NO: 24718 - DNA, 647 bp, Panicum virgatum
  misc_feature: Ceres CLONE 1860366-R
  misc_feature: Encodes the peptide sequence at SEQ ID NO. 24719
tccccccccctacccaagcaccaggacaccgtgtggtgacgaagacggtgggaagccaaagctctctggaactactccggcgatcatcggaagcacacgcacgaggccgcgggaccttccggaaccttcgcgaggatgctcaccaggttctcggcgtggttcgtgaacccgcgccggaacccgctggcgcgcctccaccggaacgccgtcgcctcccgcctccgcaaatacgggctccggtacgacgacctgtacgacccgtaccacgacctggacatcaaggaggcgctggcgcgcctgccgcgggaggtggtggacgcgcgcaaccagcgcctgaagcgggccatggacctctccatgaagcaccagtacctccccgacgacctccaggcagtacagacgccattcagaagctacctttctgacatgcttgctcttgtgaaaaaggagaatgcagagcgtgaagctctgggagcacttcccctgtaccagagaaccatcccataatgtgctttcttcattatgatctaacaatgatcgcaataaaatacagcgatggtgctatagtgtgtgttatgtttaatcaaagacactgccagtccaaatcccactgtgtcagcgcaatgtaatttgacggagcctttgtc

SEQ ID NO: 24719 - protein, 123 aa, Panicum virgatum
  misc_feature: Ceres CLONE 1860366-R
  misc_feature (8)..(111): Pfam Name: UCR_14kD Pfam Description: Ubiquinol-cytochrome C reductase complex 14kD subunit
MLTRFSAWFVNPRRNPLARLHRNAVASRLRKYGLRYDDLYDPYHDLDIKEALARLPREVVDARNQRLKRAMDLSMKHQYLPDDLQAVQTPFRSYLSDMLALVKKENAEREALGALPLYQRTIP

SEQ ID NO: 24720 - DNA, 1428 bp, Panicum virgatum
  misc_feature: Ceres CLONE 1860366
aaaaaaaaaattgaaggtctcgcgacctcatgtggtctgtgagaccctgacggccacgagagagcacgagctcctttggttgtgtttgttcccctgagcaagcggcagttggtggatgatggcgccaagcccagctgccgggccggccccggcccggtcgtcgagcagccacctgcggcgcgccgccggcgtcctccaggccatctccggctcgcgcgtcccgctgcagggaccgaggcgccgccaccagcgtctcccgggcggcgtcgttcgagctgcgccggacgcgccgccggtggtcagggcggccgtcggcgccgtcaccgagctcctccgagccattgccccaaacaagacgcccagggacgctgccgagcagggtgaggcgccggacccgccgccgtgcggcagcgtcgaggatgtgctcgccttgctcgaagacgactaccggcgcgcctacttcctcaccggggatttcactccgggcatatacactgaagattgcttgtttgaggatccgacgataaagtttcggggactatctagatactctcagaatctggatctactagtgccattcttcgacagcccttcgcttgagctcgagaacattgaaaagggtttgagggttgaaacaaagttcgtcaaagcaacatggaaactgaggacatatttgaggcttccctggaggcctttgattgcgattagagggaacacaacctatgatctgaacgaagattacaaggtggttcggcactccgagagctgggacgtctctgcgctcgaggccatcagccagatattcgtatctgctccggagcagcggaaaggcagctgaggctgaagcagaaactgcaatgcgcatgatcagaaatgtgcaaagctgtctgctagagctccattttgagaaaccagcaatgttgaaatcatcgttttctagcgtgtgaggacaaggcagcagatcaagggattctgtaagaaacaaactgggcgaacagtacagtaggtaagatgaaatgtgtcacatcgattggcctttgaagacttgtacttttccaagttgcaaaaaaaaacagctctattttctttcttcctttttttataaaaaaactgaagtaaatatgttagacagatgcttacgccaaagattaaggtaaaacattcataaacaagcctccaaatcttccggtaataaaagcattacgatttacgacccgagttcccatgatttaggtacaaatttgatctaatccttgatcaaatctgttaaaaaaaacaaaactcttatattcccaaataaaccacatctgatgatctgaatcagataggcccattcttatcctgtccatttctgaacttaccgaaatgggccggcccatccatcttgtgccgcccatcctcgtcacccccggaagcttctctggcctt

SEQ ID NO: 24721 - DNA, 1725 bp, Panicum virgatum
  misc_feature: Ceres CLONE 1860368
  misc_feature: Encodes the peptide sequence at SEQ ID NO. 24722
acaagccgacgccacagcccacagcacgcctcctcgccaacgccgctcctaaaaccacctaaaccctaaccgcccgattcctctccggactccgatctccagctcgatcgcaaccggagcgcaggcgtccatggccgcccccgccgccgcgccgctcgacgaggccaaggcgaagagcgtccttcgccaggtggagttctacttcagcgacagcaacctcccccgcgacaagttcctgcgggagactgtcgagcagagcgacgatggcctggtgagcttggccttggtatgttccttctcgcggatgaagtcccacctggggctcgacgccgctgtcaagcctgagactgtgccggaggagactgtgctcgcggtggctgaggtgcttcggcgttcttcggtgctccgtgtatcagaggatggaaagaagattggtagagcaagtgagctgctggagccagatgagataatagcgcaagtggattctaggacagtggctgcgtcaccactgccttacaatgtaaagctagaagacgtccaatcattcttcgcccaatatgcaaaggtgaacagtgtgagactaccacgtcatattgcaaacaaaaagcacttctgtggcactgctctagttgagttttctgaagaagaggaagcaaaaaaggttttcgagaatagtttggtttttgctggggcaaacctggaaataagaccaaagaaggaatttgatgctgaacaggaatataaaaaagaagaacacaaaaaggcacaccctgtcaaggatagtcgggatgaaggctatccaaaaggcctaattgtggccttcaaactggagaggactaaggttgatcctgtggttcaacaaaatagcgtagacaaagtggatgactctgccaccaaattagaaacttctaattcaacggtgaatccatcaggcgaggcatctgaagagaggattgctgagagcagtgattcaaaggaagagaagtcctcggagaacatgaccaaagaggaggtaaacattagtgaagctacggaatctgagaagtgcattggtgatgctttggtagaaagcgaaaagcgtggagatagtgagtctggcaatttgaagaatggaatctcgagggaggatctaaaagaagcactcaagaaatttggaactgttcggtatgtggacttcagcatcggggatgattcaggattccttcgttttgaagattctaaggcagctgaaaaggctcggatggctgctgtactagccgatgaaggtggcttgataataaaagaccacattattactttggagcctgtgactggtgaagctgagaaggattattggagcacaattcgtggcagtcaagagaaatacaaggacaatagaagctacaaaggaagggccgcaaagaactacagaggaggaaagcagttcagcgggaagcgtggtagaaaccccgattctgagaagaattctaacaaggcccataaggtcgaagctgccgcgtgagattaatttagctaccttgccttgatggagaagtaacatgctgcttacctgcattagtctccaagcatcggagacttgctcttatcattttggttgttttggtggcttgttctgatgtttacttgcttaacctatgatcatttggtcaagttcattgtgatattagaggtcaactaatatggtgtattattgtatataatcaaaactagggtctcatggcgtcc

SEQ ID NO: 24722 - protein, 456 aa, Panicum virgatum
  misc_feature: Ceres CLONE 1860368
  misc_feature (322)..(421): Pfam Name: RRM_3 Pfam Description: RNA binding motif
  misc_feature (17)..(89): Pfam Name: La Pfam Description: La domain
  misc_feature (122)..(192): Pfam Name: RRM_1 Pfam Description: RNA recognition motif. (a.k.a. RRM, RBD, or RNP domain)
MAAPAAAPLDEAKAKSVLRQVEFYFSDSNLPRDKFLRETVEQSDDGLVSLALVCSFSRMKSHLGLDAAVKPETVPEETVLAVAEVLRRSSVLRVSEDGKKIGRASELLEPDEIIAQVDSRTVAASPLPYNVKLEDVQSFFAQYAKVNSVRLPRHIANKKHFCGTALVEFSEEEEAKKVFENSLVFAGANLEIRPKKEFDAEQEYKKEEHKKAHPVKDSRDEGYPKGLIVAFKLERTKVDPVVQQNSVDKVDDSATKLETSNSTVNPSGEASEERIAESSDSKEEKSSENMTKEEVNISEATESEKCIGDALVESEKRGDSESGNLKNGISREDLKEALKKFGTVRYVDFSIGDDSGFLRFEDSKAAEKARMAAVLADEGGLIIKDHIITLEPVTGEAEKDYWSTIRGSQEKYKDNRSYKGRAAKNYRGGKQFSGKRGRNPDSEKNSNKAHKVEAAA

SEQ ID NO: 24723 - DNA, 1277 bp, Panicum virgatum
  misc_feature: Ceres CLONE 1860382
  misc_feature: Encodes the peptide sequence at SEQ ID NO. 24724
gactggctctccccacgcaaagcgagccgcgcgcctcggtcgccaccgcattggcatcggatcgatcgctccgccacagcccacagagaggaggaggagggaggcaggagggggagccgcgcgcggcaggccatgatgccgtcgtcgtccatgcccggcgcggcgggctcctcggagctgatctaccgcgggcagcaggcggcggtggcggaggatcaggaggaagcagcagccgccgggtactactactcgtcggcggccaacaaaaagccgccgccgccgctgccgtgggtgcggtacgtgctgggcgagcagcgcctggtgttcgcgctcctcggcatggcgctggcctcgctcgtcttcctcctgctggcgccctccggctcacctcctgcgggcgcggcgtcgagcggcggcagcgcggcgcacctcgcggcggtgggcctggcggcgcggcagtacagcagcagcaggacgttggagggcggcgtccgctccgccgcgcgcgttcctcttggcctgaagcgcaagggcctccgcgtggttgtgaccggcggcgccgggttcgtgggcagccacctggtggaccgcctgctggcgcgcggcgacagcgtgatcgtggtggacaacctgttcacggggcgcaaggagaacgtgctccaccacgccgggaacccaaacttggagatgatccggcacgacgtggtggagcccatcctgctggaggtggaccagatctaccacctggcgtgcccggcgtcgcccgtgcactacaagcacaaccccgtcaagacgatcaagaccaacgtggtgggcacgctcaacatgctgggcctggccaagcgcgtgggcgcccgcttcctgctcaccagcaccagcgaggtgtacggcgacccgctgcagcacccgcaggtggagacctactgggggaacgtcaaccccatcggcgtgcgcagctgctacgacgagggcaagcggacggcggagacgctcaccatggactaccaccgcggcgccaacctcgaggttcggatcgctcggatcttcaacacctacgggccgcgcatgtgcatcgacgacggccgagtcgtcagcaacttcgtcgctcaggcgctgaggaaggagcccctgacggtgtacggcgacggcaagcagacgaggagcttccagtacgtctccgatctggtggagggcctgatgaagctgatggagggcgatcacgtggggcccttcaacctcgggaaccccggcgagttcaccatgctggagctggccaa

SEQ ID NO: 24724 - protein, 381 aa, Panicum virgatum
  misc_feature: Ceres CLONE 1860382
  misc_feature (137)..(370): Pfam Name: Epimerase Pfam Description: NAD dependent epimerase/dehydratase family
  misc_feature: SWISSPROT Homolog: EC 4.1.1.35 UDP-glucuronate decarboxylase
  misc_feature: Useful for making plants with altered carbohydrate content
  misc_feature: Useful for making plants with altered cell wall content and/or composition
MMPSSSMPGAAGSSELIYRGQQAAVAEDQEEAAAAGYYYSSAANKKPPPPLPWVRYVLGEQRLVFALLGMALASLVFLLLAPSGSPPAGAASSGGSAAHLAAVGLAARQYSSSRTLEGGVRSAARVPLGLKRKGLRVVVTGGAGFVGSHLVDRLLARGDSVIVVDNLFTGRKENVLHHAGNPNLEMIRHDVVEPILLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELA

SEQ ID NO: 24725 - DNA, 708 bp, Panicum virgatum
  misc_feature: Ceres CLONE 1860386
  misc_feature: Encodes the peptide sequence at SEQ ID NO. 24726
aacaaagccgcaaaaatctctaaacaactcgcgagacgccgcccaaacccgcagcgcccagcagcggccggagtcggtggcagccaaggagaagcgggcgcgggggtcgcggcgcggcgtcggccatgtcggtgagctgcgggctggagtgggtggtgtgcctggggtgcacgcggtgggcgtggaagcggctcacctacatcggcgcctacgacagcgagacgtggccgccggcgacccccggcgagttcgagcccgtcccgcgcctctgccgcgtcgtgctcgccaactacgacccggacctcagcgaccccaagttcgcgccgccgggccgcgggtacgccggcgtcgaccccaggggcatcgtcaggcgcgccacctacgaggacgtcggcaaccgctgcccgccctacctcatctacgtcgacgaggcgcacaaggagatcgtcctcgccgtgcgcggcctcaacctcgtccgcaacgccgactacaaggtgctcatggacaacaagctggggatgcagatgttcgacggcggctacgtgcaccacggcctcctcaaggccgcccagttcatcctcgagcgggagacggagacgctgcgggacctgctgcgccggtaccgccccgagtacaagctcatcttcaccggtcacttcgctcggctcccgcatccccgcgctcatgaccgtgctcgtcgtcaacaac

SEQ ID NO: 24726 - protein, 194 aa, Panicum virgatum
  misc_feature: Ceres CLONE 1860386
  misc_feature (6)..(74): Pfam Name: Lipase3_N Pfam Description: Lipase 3 N-terminal region
MSVSCGLEWVVCLGCTRWAWKRLTYIGAYDSETWPPATPGEFEPVPRLCRVVLANYDPDLSDPKFAPPGRGYAGVDPRGIVRRATYEDVGNRCPPYLIYVDEAHKEIVLAVRGLNLVRNADYKVLMDNKLGMQMFDGGYVHHGLLKAAQFILERETETLRDLLRRYRPEYKLIFTGHFARLPHPRAHDRARRQQ

SEQ ID NO: 24727 - DNA, 693 bp, Panicum virgatum
  misc_feature: Ceres CLONE 1860389
  misc_feature: Encodes the peptide sequence at SEQ ID NO. 24728
gtcctctgtttcttaaaccttttcccttctctcggactctctcatcccttgctcttccttccctggcggcgacgactgggcgagcggctgcgccatttgtcctgtcttcgcccagccctttgccggcgacgagcgcatcctccaggacacttaaatcttcattctgtagccatggctcacgctaaaaaggccaaggtgaaacatacagttgatttgagttcatccacaattagcagcctacctcaagagataaaggccaaaattctctccaacctgagcatacatatggctgttagggctagtgtcctatcaagcgattggaggaatttatggactattatgccagacatatttctgtgtgatagcaagttttgttccgtctgtccttcaagtgattcttctgaagccttttatataagtggacgatccaagtttgttacattggttgatttggcactatcactccacaaggggactctagatacatttcagattcatggggcacagagctaccatgatgtgttcgcgaggtggatgtacatgctttcaacaaaaagaccaggagctattacaatcaagctgacatctggcccacagtataagattccatcaagcctcttctctatcagtcatctgtaccttctgtacctaaaaaactgcagcattagcttgccaaagaagtttgagggtttc

SEQ ID NO: 24728 - protein, 173 aa, Panicum virgatum
  misc_feature: Ceres CLONE 1860389
  misc_feature (18)..(65): Pfam Name: F-box Pfam Description: F-box domain
MAHAKKAKVKHTVDLSSSTISSLPQEIKAKILSNLSIHMAVRASVLSSDWRNLWTIMPDIFLCDSKFCSVCPSSDSSEAFYISGRSKFVTLVDLALSLHKGTLDTFQIHGAQSYHDVFARWMYMLSTKRPGAITIKLTSGPQYKIPSSLFSISHLYLLYLKNCSISLPKKFEG

SEQ ID NO: 24729 - DNA, 1586 bp, Panicum virgatum
  misc_feature: Ceres CLONE 1860394
  misc_feature: Encodes the peptide sequence at SEQ ID NO. 24730
ctctctctctctctctccaccagctcccctctctctctctctctctctctctctcattccccctccccggagcgctcgcgcggacccacgaggaggaggaagaggagaagagggggagagggagggaggcagggagccctagccctgccctgcgcgccggcgtcgccagggttagggtctcccccgcgttccgttccttgcgccaccccttcgccggctccccgctctggccgatcccgcccgcccaaccgcccagcggcgcgcgcgccgacccggacccggaccccgcggcgcggcgccgcgccggtcaatgccgcgtgcctgaccctcggtttggggataccttccgttcctagctgccctcccggtgcggcctgacgcaggagcttcgcggcgagatccggctcccggcgagatgcagcacgatcagcgcaagaagagttctgcggaggctgattttttcacagagtatggggacgcgagtcgatacaagattcaagaagtcattggtaagggaagctacggggtagtatgctccgcaatagatgtgcacacaggagagaaagtagcgatcaagaagatacatgacatctttgagcacatatctgatgctgctcggattcttcgcgagatcaagcttctgagactcctaagacatccggacattgttgagatcaaacatattatgttgcctccatcaagaagggacttcaaagatatttatgttgttttcgaacttatggagtctgatcttcaccaagttatcaaggctaatgatgacttgacaaaggaacattatcagttctttctctaccaattgctccgtgctctgaaatacattcacacagctaatgtttatcatcgggacttgaagccaaagaatatattagcaaattctaactgcaaactgaaaatttgtgattttggactagcacgagtcgcatttaatgataccccaacaacgatcttctggacggattatgttgcaacgagatggtacagagctccagagctctgtggatccttctactcaaagtatacgacagccattgacgtttggagcattggttgcatctttgctgaggtgttaacaggaaagcctttgtttcctggtaaaaatgttgtccaccagctagaccttatgactgatcttctaggcacgccatccatggatacaatttctcgggtccggaatgagaaagcaaggaagtatctaagcagcatgagaaagaaagatccaatcccattctcgcagaagtttcccaatgcagatcctttagcattggatcttttgcaaaggcttttagcatttgatccaaaagatcgtccaactgcagaacaggcactggctcatccatactttaaagggctagccaaggttgagcgagaaccatcctgtcaaccaatcacaaagatggagtttgagtttgagcgtagaagagtgacaaaagaagacataagggagctgatattccgtgagatattggaatatcacccacaattactcaaagactacatcaacggcacagagaggacaacctttctgtatccgagtgctgtcgatcaattcaggaagcaatttgctc

SEQ ID NO: 24730 - protein, 390 aa, Panicum virgatum
  misc_feature: Ceres CLONE 1860394
  misc_feature (25)..(316): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MQHDQRKKSSAEADFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFYSKYTTAIDVWSIGCIFAEVLTGKPLFPGKNVVHQLDLMTDLLGTPSMDTISRVRNEKARKYLSSMRKKDPIPFSQKFPNADPLALDLLQRLLAFDPKDRPTAEQALAHPYFKGLAKVEREPSCQPITKMEFEFERRRVTKEDIRELIFREILEYHPQLLKDYINGTERTTFLYPSAVDQFRKQFA

SEQ ID NO: 24731 - DNA, 747 bp, Panicum virgatum
  misc_feature: Ceres CLONE 1860397-R
  misc_feature: Encodes the peptide sequence at SEQ ID NO. 24732
gagagaaggcgatggcggggatcgggccgatcaggcaggactgggagccggtggtggtgcggaagaaggcgcccaccgccgccgccaagaaggatgagaaggccgtcaacgccgcgcgtcgctccggcgccgagatcgataccatgaagaagtacaacgctgggacgaacaaggccgcgtccagcggcacatccttcaacaccaagcggctcgacgacgacactgagaatctagcccatgagcgcgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagataattagcaagcttgagagggcactcggaacaaagctgcgtgggaagaaataactttcaaacttgtgccccgtagcagcatgaagctgaaggagacaaggcagtctgtctgcttattatctatgcttggttttcaatgtcatgcagactgtttctgtgtttggtacatgagtgaataacagtgtcgtggtggaccttgtaatgccttgctgcttttatgtgtcatatgatccctggtacgtaagagttacgctacgttgtgaactgatagcgtaacctgcgtggtgcatgatgcctcagctgcttgccggagtatatattgttatgttggatagaggtaaccaaggtggtattcagctgg

SEQ ID NO: 24732 - protein, 142 aa, Panicum virgatum; identical to SEQ ID NO: 13802
  misc_feature: Ceres CLONE 1860397-R
  misc_feature (9)..(79): Pfam Name: MBF1 Pfam Description: Multiprotein bridging factor 1
  misc_feature (87)..(141): Pfam Name: HTH_3 Pfam Description: Helix-turn-helix
  misc_feature: The sequence is a functional homolog of SEQ ID NO 1 in US patent 7238857
  misc_feature: Useful for making plants with altered lignin content
  misc_feature: Useful for making plants with modulated heat sensitivity

SEQ ID NO: 24733 - DNA, 1035 bp, Panicum virgatum
  misc_feature: Ceres CLONE 1860397
ttcctcgcagaagccaatctaagacgcatacgagagcacggaagtaaagtaaagaaaacgagggctcgaatgcacaaggccccgagtggccacactgtcaatacatgttaactagttttctcgcatagctaagacaaagtattaacttatttacatgggctccaaggcccagacttcctacaggttgccttctcccccctgcggatcctcagcagcatcgacttcggcttccgggaggggatcgtcctcaagcttcttggacaaggcggcggcaaagcaatcgacggcggcatcggcctcttccatagcagccatcgcagcatcctcatcgatgccaggcacgaagatgtattccgacgacactcgctcgaggttcatgtcgtagtgcgtcgaggccacggcgagggtcctctgaaccctgaggcggaaggtgctcctgatacgctcggccaccctaccgcccagcgatcgcaggcgactggccaccgagctactggatgaggctccctccccctcgagttcctgacacatggctacaacagtctgctccaggtctgcatgttcaacttgcaccgctgtgaacgcgacttggacggcttccttcaccgaggtctcatccgccaccgccttcctcagctctgaacaagaaaacaaagataagttttggcaagctaataaccaacttaataaaaaatcccaaatacttacccttgatgcattcttgcgcctcctccagctgagcacgttcggcgttcgcccgctcctggatcccggacaaggaggccttcccctccttgagggcagccaccgcgtcccgaacggccacctcctgtgcagcaaggaggacgtccttttgcacaaggttcttggcgagcgtcgtaacgaccgcctccttatcttggagctcagcctccttgccctggagatcgctttccttcgccacgagcgcctggtccttctgacgtagctcggtcgcctgctcctcaaacacctgggccttgtgctcggctgcggctctctggctattgcgctcgc

SEQ ID NO: 24734 - DNA, 666 bp, Panicum virgatum
  misc_feature: Ceres CLONE 1860424
  misc_feature: Encodes the peptide sequence at SEQ ID NO. 24735
aattctcctccgcaacctcccacctcccctccgcctccttccccttggacgacaaccccaacgcaagcgagcgagccagccagccatggagaaggcgatcgaccggcagcgggtcctcctcgcccacctcgtcccctcctcctcgtcctcgcggccgcagctggaggcgtcggcgtgcgcggccggggacagcgccgcgtaccagaggacctcctccttcggagatgatgttgtcgtcgtcgctgcataccggacgccgatatgcaaggccaagcgagggggtttcaaggacacgtacccagaggacctccttactgttgttctcaaggctgttctggacaacactaaaatcaatccaggtgacattggtgacattgtggttgggacggtgctaggtccaggttcgcagcgagcaaatgagtgcagaacggctgctttctatgctggattccctgaaactgttcctgtgagaactgtcaaccgacaatgctcatctgggttacaggcagtagctgatgtcgccgccgctataaaggctggtttctatgacatagggattggtgctggtttggaatccatgtcgataaattccattgcttgggaaggacaagtaaaccccaaaataagtgcattcccgaaagcacaggattgtcttctgcccatggg

SEQ ID NO: 24735 - protein, 193 aa, Panicum virgatum
  misc_feature: Ceres CLONE 1860424
  misc_feature (46)..(188): Pfam Name: Thiolase_N Pfam Description: Thiolase, N-terminal domain
  misc_feature: SWISSPROT Homolog: EC 2.3.1.16 Acetyl-CoA C-acyltransferase
MEKAIDRQRVLLAHLVPSSSSSRPQLEASACAAGDSAAYQRTSSFGDDVVVVAAYRTPICKAKRGGFKDTYPEDLLTVVLKAVLDNTKINPGDIGDIVVGTVLGPGSQRANECRTAAFYAGFPETVPVRTVNRQCSSGLQAVADVAAAIKAGFYDIGIGAGLESMSINSIAWEGQVNPKISAFPKAQDCLLPM

SEQ ID NO: 24736 - DNA, 468 bp, Panicum virgatum
  misc_feature: Ceres CLONE 1860425
  misc_feature: Encodes the peptide sequence at SEQ ID NO. 24737
atactatccgctagcggcgcacacaccaaaaacagcgaagaactgtataccatctgctaccggcggacacacaaatcaacaatccttgttgatcggcgacgcgcccgccatggagctcaacctcgtgtcgtgggggtcgctcctcctcctcgcggtctccgccgcctacgtctactgcacgacgcggagccgggcgccgcatcggctgccgccgtccccgccggggtggccggtgatcgggcacctgcacctgctgtccggcgggatgccacaccacgtcatgaccgagctggcgcgggccatgcgcgcgccgctgctcgggctgcgcatggccagcgtgcgcgccttggtgatctgcaagccggacctggcccgcgccgcactcaccaccaacgacgccgcgctcgcgtcgcggccgcacctgctgtcagaccagttcctgtccttcgactgctccaacgtcacgtt

SEQ ID NO: 24737 - protein, 119 aa, Panicum virgatum
  misc_feature: Ceres CLONE 1860425
  misc_feature: SWISSPROT Homolog: EC 1.14.13.68 4-hydroxyphenylacetaldehyde oxime monooxygenase
MELNLVSWGSLLLLAVSAAYVYCTTRSRAPHRLPPSPPGWPVIGHLHLLSGGMPHHVMTELARAMRAPLLGLRMASVRALVICKPDLARAALTTNDAALASRPHLLSDQFLSFDCSNVT

SEQ ID NO: 24738 - DNA, 657 bp, Panicum virgatum
  misc_feature: Ceres CLONE 1860428
  misc_feature: Encodes the peptide sequence at SEQ ID NO. 24739
cttgtacgccaacgccaacctaccccctcctacagccgccgcctctccgcccaaaaccctagctagggctaaaccccagcgcagtcccagcaaaggcagccatggccaccatccccaccaccgattccgcccttctcctcggttcatccgctctccacagggccgccaggacggggggggccgcggcggcccggttgcccggagccaaccgccgtcccccccgggccctggggcgcgcgtccgccaaggaaattgccttcaaccagggttccaaagcctccctccaggccggcgtcaagaagctcgccgccgcagtcggcgtcaccctcggcccccaaggaaggaatgttgtcttgaatgagtttggaacccccaaaggggtcaacaacggagttaccattgttcgggctattgagctcgctgatcccatggaaaatgctggtgcctcattgattcgggaagttgctagcaaaacaaacgactcggttggggatgggaccacaactgcttccgttctcgccaaaaaaatcattaaattgggtatgttgagtgttacttcaggggcaaacccggtgtctattaaaaagggcattgataaaactgttcaaaaattggtggaggaacttgagaggaagtccaggcctgtgaaggttgccg

SEQ ID NO: 24739 - protein, 185 aa, Panicum virgatum
  misc_feature: Ceres CLONE 1860428
  misc_feature: Useful for making plants with modulated nitrogen use efficiency
MATIPTTDSALLLGSSALHRAARTGGAAAARLPGANRRPPRALGRASAKEIAFNQGSKASLQAGVKKLAAAVGVTLGPQGRNVVLNEFGTPKGVNNGVTIVRAIELADPMENAGASLIREVASKTNDSVGDGTTTASVLAKKIIKLGMLSVTSGANPVSIKKGIDKTVQKLVEELERKSRPVKVA

SEQ ID NO: 24740 - DNA, 465 bp, Panicum virgatum
  misc_feature: Ceres CLONE 1860429
  misc_feature: Encodes the peptide sequence at SEQ ID NO. 24741
gtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccctcgaggggatgaacggcaaggagctggacggccgcagcatcaccgtctacgaggcccagtcccgcggcggcccgcgctccggcggcggcggcggctacgggcgccgcgagggcggcggtggctccggctgctgttccggcggctgcagctacactccccctgcgggcc

SEQ ID NO: 24741 - protein, 121 aa, Panicum virgatum
  misc_feature: Ceres CLONE 1860429
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDALEGMNGKELDGRSITVYEAQSRGGPRSGGGGGYGRREGGGGSGCCSGGCSYTPPAG

SEQ ID NO: 24742 - DNA, 1894 bp, Panicum virgatum
  misc_feature: Ceres CLONE 1860434
  misc_feature: Encodes the peptide sequence at SEQ ID NO. 24743
actgttccgaccgaaagcaaaccctaaccctagcccgcaatggcggccggcggaggggctccgtgggcggagcgggcccgggtggtggggacacagattcgcaacaggttccgcgtggcgcccgtggatcgccggtggctgtggcgccgggctgacggccgcgtcgccaccgaggcggtccggcgctggtcggatcgcgttcggaccctgctgcagggagaccgggtcgcggatcagagctcgacctcgacggggacgtctattggggcggcggcgaagccctcgtcctgtgctttgagattctaccgaaagaaagtgggcaaagaggttgatggcattgaagactctgttattttccgttcacttcaagcgttggctgttcctcttattggcaatgcctgctatgtttttatgcatggccttaattccgtccagatttatggtgcagagaagcttcatcaggcattacaagagagacctaaaggaaaaccgcttctaacggtcagcaatcatgtggcagcaatggatgacccattcgtaattgcctcccttctcccaccatctgttatgttggaagcgcaaaagctgagatggacactatgtgcgactgatcgttgctttacaaatccaattctgtctacattcttcaggtctgttaaggtgttacctgtttctcgcggtgatggtatctaccaaaagggaatggatatggctctttcaaagcttaacagtggtgggtgggttcatatatttccagaagaaagccgttcaagggatggagggaaaactattgctcctgcaaagagaggtgttggaagattggttatggatgctgacagccttccagttgtgataccctttgtccatactggaatgcaggatataatgcctgttggaaaacgtatcccaagagcagggaaacaggtgattgtggttgtgggtgacccaatcaactttgatgacctgatgattgacaacagcgatgacactcaacatatctctagaggtatcttgtatgataaagcaacacaaagaattgggcagcggttgcaggaactgaaggttgaagttgacagacttgcatcagagcggcaatctgaactccgaaaccatcacttacaaaatgtgagtgatggtggatacaggctgtggcagcaggttgattgggaaggatttggcatagggagttccatgttatcatcagaaccttcatttgtccaggagcaatcaaaggaagctgagcctgaaccgcccctggaagtggaacaaagcctttctccagccccaggtgcagcaatctcattcaatgttccacactggttccagcgtcacgtggatccttctgagctcatggggtttgccgcgcgtggcctgataaagaatggaaaattcttagaggaaggttacagggaactccaagaaccagctacactgaacagctggtggcggtctcaggctaacaatgctgtgccaagatggagcactgcctgactcaggccgcacacccccctccctttgtacatataaatctcagacaattttgacagattccaatttctcttcgtcatagtgttctgaaagatggagcttgggtgatgactgtccgctctatacaatacaatcactctgttcgcttagcttgtcagccaaccagtcagtagtgcttctctcataccaaatcagcaccaatcaccagcacaaccaaacaatcagagtgactgtcttacacaggttgtaggtgttatttgggttttgggcagactatactttttatgtaatgtaaatgccatattccatctactcgatgaaaatggctcaaatgcacaaatatggaatctcaagtttcaatacgtttctgttcgttcaccggaaacacgaacgcaccatgattttg

SEQ ID NO: 24743 - protein, 483 aa, Panicum virgatum
  misc_feature: Ceres CLONE 1860434
  misc_feature (130)..(277): Pfam Name: Acyltransferase Pfam Description: Acyltransferase
  misc_feature: SWISSPROT Homolog: EC 2.3.1.23 1-acylglycerophosphocholine O-acyltransferase
MAAGGGAPWAERARVVGTQIRNRFRVAPVDRRWLWRRADGRVATEAVRRWSDRVRTLLQGDRVADQSSTSTGTSIGAAAKPSSCALRFYRKKVGKEVDGIEDSVIFRSLQALAVPLIGNACYVFMHGLNSVQIYGAEKLHQALQERPKGKPLLTVSNHVAAMDDPFVIASLLPPSVMLEAQKLRWTLCATDRCFTNPILSTFFRSVKVLPVSRGDGIYQKGMDMALSKLNSGGWVHIFPEESRSRDGGKTIAPAKRGVGRLVMDADSLPVVIPFVHTGMQDIMPVGKRIPRAGKQVIVVVGDPINFDDLMIDNSDDTQHISRGILYDKATQRIGQRLQELKVEVDRLASERQSELRNHHLQNVSDGGYRLWQQVDWEGFGIGSSMLSSEPSFVQEQSKEAEPEPPLEVEQSLSPAPGAAISFNVPHWFQRHVDPSELMGFAARGLIKNGKFLEEGYRELQEPATLNSWWRSQANNAVPRWSTA

SEQ ID NO: 24744 - DNA, 3316 bp, Panicum virgatum
  misc_feature: Ceres CLONE 1860453
  misc_feature: Encodes the peptide sequence at SEQ ID NO. 24745
aagtctcaacccagtctctctctccctctccgcccaagtcctcccccgtcgagacgagtcgcgatcctccccgccgccgcccacccccccgtccggactcggatcgaccccgcgtcgcctcggatggctgatgataatccccacggcgccagcagttcgacggcgaaaccagctgatgatccggagaccaccattgagatcaacatcaagaccctggattcgcaagtccacaagctccgtgtcaacaagaatgcgcctgtttcggtccttaaggagaagatagttgatgcaactggtgttcctctggatcagcagcggttgatttttagaggaagggtcttgaaggatgatcacctcctgtcagaataccatttggaagatggatttacattgcatctggttgctcggcgtgcagctgagagccagaattcttctgggacttctgaaggaaacacacatactaatgtaaattttgctgcaaatggaggattattggatgatatttccaggagtgttcgggatcttcttggttccttgggtgttgcgatgtctggtggtctcaccaatacagcattttcagttcctttggctactgcaccagaaggggccaataatgtccctggaagaactcagccagtaaacccagcacaaccagggttctcagttccgaatcatcaaatccatgtaacacagcttcaaccaggagctattcctcgcagcatgattattccggattctctaacaactcttacggagtatatggaacgcgtagaccgagtcttacagaataatggtactccaccatccagggattcagaaggccagcaacgaccaacagcagatgatgccaatgttaacccaagatttccaagtcctgaggttttggcttcagttattgagcgagcccaacaacttcttagtggcagtgcatcttctgctctttctcacatcgcacaacgtattctgcaagatggcagcactggggatgcatctattcgtcatgagatccaaactgaatccgtccagctgggaattgcaatgcaacacttgggtgctatgttttttgagcttggtcggacaatgatgatgcttcgaacagggctttctccttctgaagcttttgtgaattccgggcctgctgtttatataaactccactggaccaaatccaatcatggttcagccatcttttcaaagcactcctccttttggagtttcgaacataccagttctgggaggagtttctggtgcttttggtatagttgatccttctcggtcatctggtttcagagatcctttttggaatgtccagagtagtggtgcatctgcaacaagtggttcagcagctggtaccaccaccacttctgaaggggctaacaacgggaaccgccaagatgcagcaagaactcaaggaagtaacccaccaggtcacccagctggaacacgtggattgccaacaagaacagttgttgcagctattccagcacggtcctcagtggaggcgccaaaccatgccctaagtgttttcctgcctgttcaagtgaggggtcaagttgccgtacctaaccagtcagcctcctttcaaggttctcagacagcagcgggcaatggagctcaaccaaattcaacacctgctgttccacaagcttctgtaggtggtgttccacctatagtagcgcaagtgacagcacaggtagccaatgcaccaggccaggtttcttcatctgcacacagtgcagcagaccagggatttaaccagaccacagacagcagagctggtgtgctgagttcatcaacaccagtcactatgccacagcagaatgatccctcaggtacttgcggttccactttgccatctcaggacagtatacaacagcatccacaattggaagataccagtgcaggtacaaccaacttatcaggagacgccacggtcacctgtgccattgatgttccttcgagcacatcagcagaaaattctgcgctgaagaacaaatcctcggatagagtgggttcacaatctcttgagccttctgcaagtggaagctcagaaccagtaggtcttggtggaggtctgattccaaagagacggagcagagcagcgaagccatctgggagcacaactgattgtggtagagattcatcttcagtcagccaaaaccaagatgctatttcagtggcccagcagtttctgcaaggttttgcttcacaaaatactaacgctagccgaagcaacacccccacctctggccctccatcctctaggtcacagcctactggagttcctccaagaagacagagtggtgaaggacaacctgatattggcagcatgaggtcacagcctactggagttcctccaagaagacagagtggtgaaggacaacctgatattggcagcatgatatctggtatgctcaataacccagtttttagcaacctattgtcgaatgttgcaacacaagcagggggctcaagtgctgacatgaggagcgtgatggaaggattacagagccctgctgttgtagatactataagcaatattgtgcagaatgtggatgagcaagaccttggggccatgtttggttcaggcagggggcaaggtggcatggatttgtctagaatgttgcagcaaatgatgcccgttgtatcccaagttcttggtggagcgggggcccatcctgttggtgcaaataatgggcaatctagatcacagcctcggtcaagtgacactgcaggaggaaatgtattagacaacagtagctctcatcttgatctccatgaagctctacaaagcattgaacaacatgaagctccagagaatatcttcagtgccgtccttgagattgctgctcaggcttatggtgaagatgacagcattccgagcctgctcgaagagcttgccagtgatccagagcttaccaatgactacctgaaactcctggtcgagcaagttcggcagaggttacagtcagaatcgcagtcggagagccagtcttgaagcattgaccggcaaggttgtgtagccattcaccgctaaattgatcgctaacatgggaaagcagaactaaagcgttgttgggggtgttttcgtgatgaggcgcccggtgggtgtaaatgtggcattatagttttccctgaggtattggtgcagcatattgtgtactgtgattcaaatggttttcaccaatttcgctagcggtacatacagctagttccaaaggtggaattgtctggattttgtggatgatttggctatctatgtaatggtggtggatctgtatatttaggcaaatttgtttgtttttgctgctgtgctc

SEQ ID NO: 24745 - protein, 957 aa, Panicum virgatum
  misc_feature: Ceres CLONE 1860453
  misc_feature (29)..(97): Pfam Name: ubiquitin Pfam Description: Ubiquitin family
  misc_feature: SWISSPROT Homolog: EC 3.2.1.18 Exo-alpha-sialidase
MADDNPHGASSSTAKPADDPETTIEINIKTLDSQVHKLRVNKNAPVSVLKEKIVDATGVPLDQQRLIFRGRVLKDDHLLSEYHLEDGFTLHLVARRAAESQNSSGTSEGNTHTNVNFAANGGLLDDISRSVRDLLGSLGVAMSGGLTNTAFSVPLATAPEGANNVPGRTQPVNPAQPGFSVPNHQIHVTQLQPGAIPRSMIIPDSLTTLTEYMERVDRVLQNNGTPPSRDSEGQQRPTADDANVNPRFPSPEVLASVIERAQQLLSGSASSALSHIAQRILQDGSTGDASIRHEIQTESVQLGIAMQHLGAMFFELGRTMMMLRTGLSPSEAFVNSGPAVYINSTGPNPIMVQPSFQSTPPFGVSNIPVLGGVSGAFGIVDPSRSSGFRDPFWNVQSSGASATSGSAAGTTTTSEGANNGNRQDAARTQGSNPPGHPAGTRGLPTRTVVAAIPARSSVEAPNHALSVFLPVQVRGQVAVPNQSASFQGSQTAAGNGAQPNSTPAVPQASVGGVPPIVAQVTAQVANAPGQVSSSAHSAADQGFNQTTDSRAGVLSSSTPVTMPQQNDPSGTCGSTLPSQDSIQQHPQLEDTSAGTTNLSGDATVTCAIDVPSSTSAENSALKNKSSDRVGSQSLEPSASGSSEPVGLGGGLIPKRRSRAAKPSGSTTDCGRDSSSVSQNQDAISVAQQFLQGFASQNTNASRSNTPTSGPPSSRSQPTGVPPRRQSGEGQPDIGSMRSQPTGVPPRRQSGEGQPDIGSMISGMLNNPVFSNLLSNVATQAGGSSADMRSVMEGLQSPAVVDTISNIVQNVDEQDLGAMFGSGRGQGGMDLSRMLQQMMPVVSQVLGGAGAHPVGANNGQSRSQPRSSDTAGGNVLDNSSSHLDLHEALQSIEQHEAPENIFSAVLEIAAQAYGEDDSIPSLLEELASDPELTNDYLKLLVEQVRQRLQSESQSESQS

SEQ ID NO: 24746 - DNA, 1450 bp, Panicum virgatum
  misc_feature: Ceres CLONE 1860460
  misc_feature: Encodes the peptide sequence at SEQ ID NO. 24747
aacgcatcgaattgcctccaccacgacctcaaccatggccgcgtccagcgttcacctcgccctactcctctgtttgatgatcatgatcccagccaccgtcgcctcacctcggcgcctgcgcgaatcccctgccggtgcgtcgcggccgaccaccttcttcgaggtggaccgcccgctccgcccaccaccgggcagctccggcccgtgctccacgctcctgctctccggctccttcgggtccaccctcgccaagccgcccgccaccgccgcatactccccgccgcgctgcctcgccgcggcgggcgggcgcgcctcggcgatctccctcgccgttctcgagtggcgcgccgcctgccggggagcccagctcgacaggatcttcggcgtctggctcggcggcgccgagctcctccgcggcagcaccgccgcgccgccgctggacggcatcgtctggtccgtctccaaggacgtcaccaagtacgcgtccctcgtcgccgccggcaggtccacgctcgccgtctacctcggcaacctcgtcaacagcacgctcaccggcgtgtaccgtgccaacgtgacgctccacctctacctccgccgcgcgccggcgccgaggccgccgcccgccgtggctcccgccgacctagtcctcccgatgtcgagagctctgcctccgaacagcggcggcgggctgtggcaccagatccggagcgccgccgacgttcagtccacgagcgtcgcgctgccgtccaacacctaccgcgcggttctcgagctctacatctcgtcccacggggacgacgagtcgtggtacacgaaccagcccgggtaccgcaacggcccgttccgcgaggtcaccgtccgcgtcgacggcgtcctcgccggcgcggcgtggccgttccccgtcatctaccccggcggcatctaccccctcctatggcggcccgtcgcccccatcggctcgttcaacctcccgacgtacgacgtcgagctgacgccgctgctggacggcaaggcacacgagttcgggttcgcggtgaccaacgcccaggacgtgtggtacgtcggcgccaacctccacctctggctggaccccaggagcacggccacgacggcaggcctcgtgagctacgtcgcgccaccggcgaacgcgacgtcctcgcagtccggcgaccctgtggacacgcaccaccacgcgacggccagccggctcttctccgccgccgggtgggtgaggtcgtcgtacgggaacatcacgacgaacgccacgcagacgttcggcctcgagtacacgctcaccttcgagacgctggaccggaccaccgtcgcgggagccggcgtctccgccacggaccacgccggcggcgtcgtgtacgcggtgcagacgcgccggaacttcccgctcggctggctctacgaacagggtcggctgaccgtcacgcacgggctggac

SEQ ID NO: 24747 - protein, 471 aa, Panicum virgatum
  misc_feature: Ceres CLONE 1860460
  misc_feature: SWISSPROT Homolog: EC 3.5.1.52 Peptide-N(4)-(N-acetyl-beta-glucosaminyl)asparagine amidase
MAASSVHLALLLCLMIMIPATVASPRRLRESPAGASRPTTFFEVDRPLRPPPGSSGPCSTLLLSGSFGSTLAKPPATAAYSPPRCLAAAGGRASAISLAVLEWRAACRGAQLDRIFGVWLGGAELLRGSTAAPPLDGIVWSVSKDVTKYASLVAAGRSTLAVYLGNLVNSTLTGVYRANVTLHLYLRRAPAPRPPPAVAPADLVLPMSRALPPNSGGGLWHQIRSAADVQSTSVALPSNTYRAVLELYISSHGDDESWYTNQPGYRNGPFREVTVRVDGVLAGAAWPFPVIYPGGIYPLLWRPVAPIGSFNLPTYDVELTPLLDGKAHEFGFAVTNAQDVWYVGANLHLWLDPRSTATTAGLVSYVAPPANATSSQSGDPVDTHHHATASRLFSAAGWVRSSYGNITTNATQTFGLEYTLTFETLDRTTVAGAGVSATDHAGGVVYAVQTRRNFPLGWLYEQGRLTVTHGL

SEQ ID NO: 24748 - DNA, 1900 bp, Panicum virgatum
  misc_feature: Ceres CLONE 1860466
  misc_feature: Encodes the peptide sequence at SEQ ID NO. 24749
atccaatccacggacctgtcgtggacttgtctaggcaggcgggcggggagggaggtctccgtcggccatgtccatggaccccgccgaccgcatgctggcggatcccctcctcctccccctcccagcggcggccaagcaggtgctcgccggcgtcaccgactaccgcggccgccccgtcacccgcgggacctctgggggatggcgatccgcgctcttcgtagtggccgtggagatcgccggcagcttcgcctacttcggcatctccgccaacctcatcacctacctgacggggcccctgggccagtccaacgcctccgccgccgccgccgtcaacgcctggtcggggacggcaagcctcatgcccctgctcggcgcattcctcgcggacgcatacctgggccgatacagatcaatcatcctcgcatgctcactctacgtcctggggtttggcatgctgactctgtcgtccacggtgcctccgctgcgccctgctgcctcctcgcacttgcccagcggcagcagccggccaccgcctcaggccctgcaggtggccttcttctacgtctccctctacctcatcgccctcgcccagggcgccgacaagccctgcggcctcgccttcgccgccgaccagttcgacgccaaccaccccgccgagcgcgcctcccgggcctccctcttcaactggtggttcttctgcatggccatcggcatctccgtcgccgtctccgtcgtcggatacatccaggacaacgtcggctggggcgtcggcttcggagtcccctgcgccatcgtgctcgctgcattcgccgtcttcctcatgggcacccccacctaccgcctctaccaacacaagaagaagcagccaccaaaggaggaggaggaggagcagcagcagcagcagaacaaggccatggccagcagcgcgctccgccggcttctccccatctgggccaccagcctcgcctacggcgtcgtgtacgcgcagatcatgaccctcttcaacaagcagggccgcaccctggaccgccgcatcgtgggagccatccagctcccgcccgccgcgctgcagacgctcggccccgccagcatcctgctcttcgtccccgtctacgactgcgccatcgtgccggcgctccgctgggccaccggcaacccctccggactgaccatgctgcagcgcgttggcgccggcatggccacgtccctggccgcggtgtccgtcgccgcgctcgtggaggcgcgccgcctcgccacggcgcgggagcacggcctggtggaccagccgggggtcaccgtgcccatgacctgggcatggatggtgccgcagtacgccatgatgggggtggccgacgtgctcgccgtcgtcggcctgcaggagctcttctacgaccagatgcccgacggcctccgcagcctggggctggcgctctacctcagcgtcatgggcatagggggattcatcagcagcctgctcatctccaccatcgacagcatcacatccaggggcggccgggacagctggttcgcggacaacctcaaccgcgcgcacctcgactacttctactggctgctcgcggggatcagcgccctggagctcgtgctctacctaggcttcgcaagatcctacgtttacaaccaccaacacctagctacctaggcttcgcaagatcctgcgttcggctgctcttctcccctccgcgctacagtaatttcctctcacaccactccagctactaactccagccagcccaacagtatttttctctcatcccattctagctccagcctccagctccagcctgccgaatgcggttgctagtgtcgtgtcgtgtgtaacgaacgaaccgtgcgtgggtgtaaataacaaacaaaaccattcatcattcatcaaccacac

SEQ ID NO: 24749 - protein, 530 aa, Panicum virgatum
  misc_feature: Ceres CLONE 1860466
  misc_feature (113)..(460): Pfam Name: PTR2 Pfam Description: POT family
MSMDPADRMLADPLLLPLPAAAKQVLAGVTDYRGRPVTRGTSGGWRSALFVVAVEIAGSFAYFGISANLITYLTGPLGQSNASAAAAVNAWSGTASLMPLLGAFLADAYLGRYRSIILACSLYVLGFGMLTLSSTVPPLRPAASSHLPSGSSRPPPQALQVAFFYVSLYLIALAQGADKPCGLAFAADQFDANHPAERASRASLFNWWFFCMAIGISVAVSVVGYIQDNVGWGVGFGVPCAIVLAAFAVFLMGTPTYRLYQHKKKQPPKEEEEEQQQQQNKAMASSALRRLLPIWATSLAYGVVYAQIMTLFNKQGRTLDRRIVGAIQLPPAALQTLGPASILLFVPVYDCAIVPALRWATGNPSGLTMLQRVGAGMATSLAAVSVAALVEARRLATAREHGLVDQPGVTVPMTWAWMVPQYAMMGVADVLAVVGLQELFYDQMPDGLRSLGLALYLSVMGIGGFISSLLISTIDSITSRGGRDSWFADNLNRAHLDYFYWLLAGISALELVLYLGFARSYVYNHQHLAT

SEQ ID NO: 24750 - DNA, 686 bp, Panicum virgatum
  misc_feature: Ceres CLONE 1860470
  misc_feature: Encodes the peptide sequence at SEQ ID NO. 24751
gccggtgccgtgccgctcccgagggagaggcacttcacttgaggctctagagagctcttctgcgtgctctggagagagagaaggggggaggtgaaaggtgaggggtgccatggggatggacggcggcggcggcgggaagctgccgtacagctacgccggcgccggccaccaccaggatggcaagctcgtcaagagcttcagccgcgtggagccgcgcaagttcgggatggggctcgtcgccggcttcctcctcgtcacctgcgcctacttctccaccgccaagttcgacgccatccacatcgccatggtcagccccatttccacggacgcggctgggattggcccgctggcgaccgccgccgccgacacctccaagcagcaatttgatttgggcgtgcagcaacaggaccggaacgcgctgtccaaggaggggagcagggccaatgtgttcgacaaagacgacggcgatacttcctcgtcggggccagattccggccgcgatgcgccgctggaggacacgaggagagacgaggcctctgtggggggcagcggtgacgcgggcggcgtcgatgcgtcccccgcggcggccgcgaatcctgccggcgggggtgaggttcctgccaaggacgatgacgccacggccgccgttcttcctcccgtgtcgttagaggaaaccgcgaacggca

SEQ ID NO: 24751 - protein, 192 aa, Panicum virgatum
  misc_feature: Ceres CLONE 1860470
  misc_feature: Useful for making plants with altered carbohydrate content
MGMDGGGGGKLPYSYAGAGHHQDGKLVKSFSRVEPRKFGMGLVAGFLLVTCAYFSTAKFDAIHIAMVSPISTDAAGIGPLATAAADTSKQQFDLGVQQQDRNALSKEGSRANVFDKDDGDTSSSGPDSGRDAPLEDTRRDEASVGGSGDAGGVDASPAAAANPAGGGEVPAKDDDATAAVLPPVSLEETANG

SEQ ID NO: 24752 - DNA, 2051 bp, Panicum virgatum
  misc_feature: Ceres CLONE 1860477
  misc_feature: Encodes the peptide sequence at SEQ ID NO. 24753
gaatgaattcttcctctacccgtttctagaccgcatccccccgaatcgaatccatcgaaagggggcggacgaatctatggcggcgacgacggcacccccctcctgcgagatcgcgcgcctcccggaagacctcctcgcggcgtcgatcgcccgcaccacgccgcgggacgcttgccgcgccgccgcagtctcgccggccttccgcgacgcggccgactccgacgccgtctgggcccgcttcctgccgcgtgacctcccgccgctcgccgacggggagctctcccccgcacctccgtcgaagaaggcgctgttcatgcgcctcaccgacagccccgtcctcctcgccgacggcctcatgagcacgtggttggacagggagaccggcgccaagtgctacatgctgtcggcgagggcgctgtgcatcatttggggcgatacgccgcagtactggcgctggatccctctcaccgactccaggtttgctaaatcaactgcccatctaatgtctcgctctttaactttgatgtgattgtcaactgaagtactaccaccggtgtttatttgatgtcattgtcaacatccattggcagtcgatgtttcgcgattaatcgggcttatcgttccctcagcagtcagcaccgataaggagcagcgactaggtctgggcggctagaattctagtcgtctaattagtcatcgattaaacgcaattagtcgtccgactagataggaaaaccatcagatttgcattaatgggccacggccactgagcggtgggctattaggctggcagtaggcccattaggttttaggtaaatttacatatgcgtagagaaggccattgctgaactgccaccagatcttgcagagatggctcgagatcctaagaggaaagtaagatcttctaaccctggatagaaatttagatatcaatttaatttagatatctgaatcatacctcagcccatgttgcattccacgtgcacatgaccaaatggtgttatcttatccttgcttttgagagcaaagttacatggcctttttaactttgattctataatatgaatgaatgaatgcagcataactcgtcaaagaaaaaagatgtagcatacgaactgcactttacataacggagtgcactcttttcatgtacttgccatgatgatgatgatgattttacaattctggtctgttgcgaaatttaagctttttttgtgacaggttctcagaaggtgctgagctccgggttgtttgctggttggaaatacgtggcaagatacactgcaagatgctctcgcaaaactcaacttataccacttacatggtgttcaagatttctgatgaatcctatgggctggattctccactccaggaggctgcagttatcattggggaaaacaaattcactcgtcaggtttgcctccaaggtcatgagaatgagggtgaggatgaagaagaggtgcctcagaattaccgatctcttatggttccagacatccgacgaaggttaaggagaagaaactgtcgtattcctcctggagtgattgtgcctaagaaaagggctgatggctggatggagatagagatgggtgaattcaagaatgaagaaggtgaagatggtgaggtgtctatcagtctcatggagacaataggaggcaactggaagaaaggtcttattttgcagggcattgaaattagagcaaagaaataagactgggagggtgggatatagtctttgcacatcaaagtaaataaataaggtgttctgcagcatcttgcgttggtgtgcgatgtgctgtgtttagcaacgagctgcaaactacactctaaaggtgtgtccaggttctttagggaaaacaaagtactgcagttttgtacaaattatggtgtcccagatcagttagtgcttgtctgcttgataactggcaacgtttggttcagaaaatgtaactaggtattgctgttaattggtgttccgactcccgggaccctggaccttgtttgtaagttgcgagctgcttttggaaatgaaaggatccaatgttatcatc

SEQ ID NO: 24753 - protein, 150 aa, Panicum virgatum
  misc_feature: Ceres CLONE 1860477
  misc_feature (10)..(57): Pfam Name: F-box Pfam Description: F-box domain
MAATTAPPSCEIARLPEDLLAASIARTTPRDACRAAAVSPAFRDAADSDAVWARFLPRDLPPLADGELSPAPPSKKALFMRLTDSPVLLADGLMSTWLDRETGAKCYMLSARALCIIWGDTPQYWRWIPLTDSRFAKSTAHLMSRSLTLM

SEQ ID NO: 24754 - DNA, 672 bp, Panicum virgatum
  misc_feature: Ceres CLONE 1860509-R
  misc_feature: Encodes the peptide sequence at SEQ ID NO. 24755
cgagaaatcgtgcgcaatctccggtcctttgtggagaagagggggctgcccaagggacttgtgcttggaagctgcactgtccttgaggcggccgggcagggcgcactaggtccactgtatgaattgttggagtcaactgtacaggaccgggaatatggaacactgaatcaagagcaagtaattctgctccattttggagccaacagtggttcacttaggtttgctcttgagaatcaagctgttaatgaagctactttccgttgccctgatgagctaggatggaaaccacagagggttcctatcatgtcatctgatggaagcatcttgcatgcaagacagactacactgccagtgaaggaaataagcaaatatctccaacaaatgggatacgatgtgacaccttcagatgacgctggtcgatttgtgtgcaactatgtctattaccactctcttaggtttgcagagaaacatggcatcaggtcactcttcgttcatttccccctcttctcggcaattgatgaggaagttcagatgcaatttgttgcttcccttcttgaagtcctcgcttccttaaaatcacagtaatctaatggtatagatctgtccacttccaatggtgtattgttcccaatttacaagtggtgtgaataagaatgagtaatcattcattgc

SEQ ID NO: 24755 - protein, 194 aa, Panicum virgatum
  misc_feature: Ceres CLONE 1860509-R
  misc_feature (2)..(194): Pfam Name: Peptidase_C15 Pfam Description: Pyroglutamyl peptidase
  misc_feature: SWISSPROT Homolog: EC 3.4.19.3 Pyroglutamyl-peptidase I
REIVRNLRSFVEKRGLPKGLVLGSCTVLEAAGQGALGPLYELLESTVQDREYGTLNQEQVILLHFGANSGSLRFALENQAVNEATFRCPDELGWKPQRVPIMSSDGSILHARQTTLPVKEISKYLQQMGYDVTPSDDAGRFVCNYVYYHSLRFAEKHGIRSLFVHFPLFSAIDEEVQMQFVASLLEVLASLKSQ

SEQ ID NO: 24756 - DNA, 1203 bp, Panicum virgatum
  misc_feature: Ceres CLONE 1860509
aaacaaggagataggaagccgcggccgggcgccatgcggtttcggaaatccgcagcgcctgcgtgcgtcgtggcgtccagggcgtcggtaggaaggagacctggccccgcaaaaccagaggcggccgcgggcggcgccgcggacagaggccgccgtcccgccgccggcacgctggcagtctctcagctcagcagccgcttccgttcttctcttccccccttgccccctcctgcttatcctccgtcgaatcgccgccgacacgcggggccccgccgtagccccccctgtcgctgttctgcgggcccggccgtccgctcgcgcgctttaataaggaggcagctgggcggacccggcggccgcggccggcgctagccaaagctcttttctttcttccgtgtctgctgcttcctccccccaccccgtccgtctccgattgcgagagcgagttgttgcggcgcactgaacccctgcagcctgcagcaggaggaggaggagctccttcgccgccccgctgggcttccctgtcccgaggtgagtggatggctgttcggtcctgctgctctcatgtggggaattattcatttcgcttggtagaacggggagaaatcccagtgttattatgtatgggttctgaggtctagtcatcgatgatggtggcggcggcttgggctggcacgctgctacaaacctgcgctgctacagacctgcactgctacaggtctaagaatcacgcgacgagaacagaaattagcttgcgttatttctctgtgtttccatgcttagctgttcgggcaatcgaactcgctgagggtgagctccggttaaagatagaaaaaatgggtggccacccattcaagtcgtggcttttatcattataagtttcagactctgggcgacgtctgagtcagagtcccttgcaggatggctttgccgctccgtggcgtcctgccctctcttacgcggatactcctagtaggtggcgtatccgtatccgtatccgtatccgtatcccaaagcagtaatcagcccacccaaatgctgttttggtagtaagagatacaaaatgatgaacttgctgcaatagaactagatgagcagcaactgaagaaccccttgtggaatcagttgtgcttttagagaaggctagttatagaggtaatgttatatggacatgcaagtattgcacatatgagtataggggaa

SEQ ID NO: 24757 - DNA, 620 bp, Panicum virgatum
  misc_feature: Ceres CLONE 1860511
  misc_feature: Encodes the peptide sequence at SEQ ID NO. 24758
gaggcgcgcactaccccatccgaccgcctgcctcctctctgccaattccaaatctctcgcccagcctcgaggatggcggcgcaagtggtggcaggagcgtcgggagccgcggcggcggccaggcccctgggcggcggatctggggcggacgggctgcggccgtcgccgaggctgcagctcgcccgggcgtgcgcgtcctgggagagatggggcggagccgcggccgcgagggcccgccgcgggtcgcaggccgtgtccgtgataagccgcgccccgcgcgccgagtccaaggtgctgccggtgtcgcccgacgacgacgcggccgtcaaggaagaagcagacttccagcaccttaaggctatccagcaacttgcaactgcagcaaatggtgtgtggtctaaaccaaatgtgaggcgcaagacaaagattgtgtgcaccatcggtccctcaactaacaccaaagagatgatatggaaactcgctgagactggcatgaatgtggcccggcttaatatgtcacatggagaccatgcatcacaccagaaagttattgatctggtgaaggaatataatgcatcacatgcagacaatgtgattgctattatgcttgacacgaaggg

SEQ ID NO: 24758 - protein, 182 aa, Panicum virgatum
  misc_feature: Ceres CLONE 1860511
  misc_feature: SWISSPROT Homolog: EC 2.7.1.40 Pyruvate kinase
MAAQVVAGASGAAAAARPLGGGSGADGLRPSPRLQLARACASWERWGGAAAARARRGSQAVSVISRAPRAESKVLPVSPDDDAAVKEEADFQHLKAIQQLATAANGVWSKPNVRRKTKIVCTIGPSTNTKEMIWKLAETGMNVARLNMSHGDHASHQKVIDLVKEYNASHADNVIAIMLDTK

SEQ ID NO: 24759 - DNA, 1091 bp, Panicum virgatum
  misc_feature: Ceres CLONE 1860524
  misc_feature: Encodes the peptide sequence at SEQ ID NO. 24760
gcaaaaaaaattgtaatctaccgtacaaagctcaaagtgtacatccatacatgtgaatacttgcgtcccatcccattatcccatatagagcgtacaggggacatcactgacgagcaagatcgctgcacgctgcgttggagcgagatgattgccacgggcagctcggcgaagaaggcggcggcggcggccggggcggtgggcggcaaggcggcgcgggcctgcgacgggtgcctgcgccggcgggcgaggtggtactgcgcggcggacgacgcgttcctgtgcaaggggtgcgacacgtccgtgcactccgcgaacccgctcgcgcggcgccacgagcggctgcgcctgcgcccgacgtcgccgctgcgcgcgccgccgcccgcgggggaggcgaagcgcgagccccgggacgaggtggtgcccgcgtggttcaagcgcaaggcgcgcacgccgcggggcgggcacgccaggagcctcgggcaggtgctgtcgcggcggctcgtcgtgccggaggcggcgggcggggactcgcccgacgggcggaacggggaagaaggggaggtggaggaggaggaggagcagctgctctaccgcgtgcccgtctttgaccccgcccttgccgagttctgctcgccgccgcctcttgaggacgcggcggccgtcgcgtcgtcgtgcaacgaggacggcgccgtcgaggaccccgctaagccggatccggcggcaccggcggctccgccgccggcgcagctcttccccgacggccatgccagcttcgagcccaccaacgccgagctcagggagttcgccgctgacatggaagccctcctggggcgcggcctcgacgacggcaacgaggaggactcgtcgttctacatggagacgctgggcctcctcgacccggtggacgacgacgccgcgcgagtcaaggtggagatcgacggcagcggtgccgcctgcgaaaccagtggcacgctagcgtcgtgcggcctctagctggaggcggaggcgtctgacgagatgctggacatcgacttcgactccggctcgcctgatcaggagacgccgccggacgagaaggccgggagcaacga

SEQ ID NO: 24760 - protein, 282 aa, Panicum virgatum
  misc_feature: Ceres CLONE 1860524
  misc_feature (21)..(68): Pfam Name: zf-B_box Pfam Description: B-box zinc finger
MIATGSSAKKAAAAAGAVGGKAARACDGCLRRRARWYCAADDAFLCKGCDTSVHSANPLARRHERLRLRPTSPLRAPPPAGEAKREPRDEVVPAWFKRKARTPRGGHARSLGQVLSRRLVVPEAAGGDSPDGRNGEEGEVEEEEEQLLYRVPVFDPALAEFCSPPPLEDAAAVASSCNEDGAVEDPAKPDPAAPAAPPPAQLFPDGHASFEPTNAELREFAADMEALLGRGLDDGNEEDSSFYMETLGLLDPVDDDAARVKVEIDGSGAACETSGTLASCGL

SEQ ID NO: 24761 - DNA, 714 bp, Panicum virgatum
  misc_feature: Ceres CLONE 1860524-R
  misc_feature: Encodes the peptide sequence at SEQ ID NO. 24762
cacgagcgccgacgcccagttcctgcagacgagcctctcgctcaccctcaactacgaggcgatcatccagagctggggtagctcgccgtggaccggcggctgcgagcggcagcacgtcaagctcgacgacagctggccccacgattacacgggcgtgtggttggtgggaggaatggtcggccacggcggagaggagctctgcacgccgaggctggggacgatggacggcggccgggaggcccgagtgtcccggtaccgagagaagcgccggacgcggctcttctccaagaagatccggtacgaggtgcgcaagctcaacgccgagaagcggccgcggatgaagggccgcttcgtcaagcgcgccaccgccgggggcagcgtcgtcgccgtcgccggcgtcgcgtaatgccccggcacgcgcgcgcgcgctacggtgcgtgtgcttgtacggtgtggcgcgtgcccctcgcccgtcgtcagagatgatggcacgaacaaaacaactcgtcgaagctgctttgaattagttcattcaacttgaatcaaattttgtgcctgtttttcaaggatcagttcgccactgatgttgtgcgccttcgagtggcgatggccgaataataataataataataatactagtgcagtagtgctatctaagtggattgtaatgcttggttacgttggacatatcagaagtatttttgcccttgcttc

SEQ ID NO: 24762 - protein, 134 aa, Panicum virgatum
  misc_feature: Ceres CLONE 1860524-R
  misc_feature (78)..(122): Pfam Name: CCT Pfam Description: CCT motif
  misc_feature: The sequence is a functional homolog of SEQ ID NO 172 in the 10/225,068 US patent application
  misc_feature: The sequence is a functional homolog of SEQ ID NO 250 in the 10/374,780 US patent application
  misc_feature: The sequence is a functional homolog of SEQ ID NO 274 in the 10/225,066 US patent application
  misc_feature: The sequence is a functional homolog of SEQ ID NO 530 in the 11/435,388 US patent application
  misc_feature: The sequence is a functional homolog of SEQ ID NO 794 in the 10/412,699 US patent application
  misc_feature: The sequence is a functional homolog of SEQ ID NO 1522 in the 10/374,780 US patent application
  misc_feature: The sequence is a functional homolog of SEQ ID NO 1593 in the 10/412,699 US patent application
  misc_feature: Useful for making plants with altered alkaloid content
  misc_feature: Useful for making plants with altered lignin content
  misc_feature: The sequence is a functional homolog of SEQ ID NO 1932 in the 11/479,226 US patent application
  misc_feature: The sequence is a functional homolog of SEQ ID NO 936 in the 10/412,699 US patent application
TSADAQFLQTSLSLTLNYEAIIQSWGSSPWTGGCERQHVKLDDSWPHDYTGVWLVGGMVGHGGEELCTPRLGTMDGGREARVSRYREKRRTRLFSKKIRYEVRKLNAEKRPRMKGRFVKRATAGGSVVAVAGVA

SEQ ID NO: 24763 - DNA, 685 bp, Panicum virgatum
  misc_feature: Ceres CLONE 1860527
  misc_feature: Encodes the peptide sequence at SEQ ID NO. 24764
accgtccttcctcgtcgtcttggaagcaagcaaggtagctgcacggaggcaaccacgcaataaggtgctcttggttctctgggatgatgaggcgcaggcagctcttgctggcgaccgcctgcttgtgggctctgtcgtgcgcctcgctgctccgtgcttccacccctgacgggcttctcagggtcagcctgaacaagaacaagctcgaccgcgaggcgctggccgcggccaaggttggcaggcagcacgacagccgccgcctgagggctgccggcggcgacgaggtccctctcatcgactacctcaacacccagtacttcggggtcatcggcatcggcacgccgccgcagaacttcaccgtcatcttcgacactgggagctccaacctctggatcccctcctccaaatgttatttctcgatagcatgctacttccaccacaaatacaagtccagcaagtctagcacttacaagtctgatggggagacttgcaaaattacttatggctctggatcaatttccggattcttcagcaaggataacgtgcttgttggagaccttgttgttaaaagccaggttaaatgttttatttcagtgtaattgcccatgttaacaatcacatgcaaactgtatctctaatgctgcaacttatttctccccatttcagaagttcattgagactactc

SEQ ID NO: 24764 - protein, 171 aa, Panicum virgatum
  misc_feature: Ceres CLONE 1860527
  misc_feature (77)..(171): Pfam Name: Asp Pfam Description: Eukaryotic aspartyl protease
  misc_feature: SWISSPROT Homolog: EC 3.4.23.40 Phytepsin
MMRRRQLLLATACLWALSCASLLRASTPDGLLRVSLNKNKLDREALAAAKVGRQHDSRRLRAAGGDEVPLIDYLNTQYFGVIGIGTPPQNFTVIFDTGSSNLWIPSSKCYFSIACYFHHKYKSSKSSTYKSDGETCKITYGSGSISGFFSKDNVLVGDLVVKSQVKCFISV

SEQ ID NO: 24765 - DNA, 508 bp, Panicum virgatum
  misc_feature: Ceres CLONE 1860528
  misc_feature: Encodes the peptide sequence at SEQ ID NO. 24766
accgtccttcctcctctccttggaagcgaacaaggtagctgcacggaggcaaccacacaataaggtgctcttggttctctggaatgatgacgcccaggcatctcttgctggccaccgcctgcttgtgggctctgtcctgcgcctctgtgccccgtgcttccacccctgacgggtttctcgggctccgcctgaagaagaacaagctcaaccgcgaggccctggccgcggtcaaggttggcaggcatcacgactgcccccagctgagggctgccagctgcaactatgcccctctcatcaactacctcaactcccggaacttcggggtcatcggcgtctgcgccccgccacacaacttcaccgtcctcttcgacaccgggagctgccacctctccatcccctcctacaaaaggtatttctcgacaccatgctacttccaccacaaataccagtccagcaaacctaccccttacaagtctgatggggagacttgcaaaatttcttgcgggtc

SEQ ID NO: 24766 - protein, 141 aa, Panicum virgatum
  misc_feature: Ceres CLONE 1860528
  misc_feature: SWISSPROT Homolog: EC 3.4.23.40 Phytepsin
MMTPRHLLLATACLWALSCASVPRASTPDGFLGLRLKKNKLNREALAAVKVGRHHDCPQLRAASCNYAPLINYLNSRNFGVIGVCAPPHNFTVLFDTGSCHLSIPSYKRYFSTPCYFHHKYQSSKPTPYKSDGETCKISCG

SEQ ID NO: 24767 - DNA, 1173 bp, Panicum virgatum
  misc_feature: Ceres CLONE 1860538
  misc_feature: Encodes the peptide sequence at SEQ ID NO. 24768
cactcgtttcgtttccttccgattccaactccacgccgcttcctctcggcatacgtcgtcgttgctcccgctgctctcgaacgatccccgcggcggagatggcggcgccgaacgggctcgcgcggatcgagacgcacgggaagaagcagcacgagaacggcgtgtgccacgacgacagcgcggcgccggtgcgcgcgcagaccatcgacgagctgcactcgctgcagcggaagcggtcggcgcccaccacgcccatcaaggacggcgccgcctcgcccttcgccgccgcgctctccgaggaggagcgccaccggcagcagatgcagtccatcagcgcgtcgttggcgtccctgacacgtgaaaccgggcccaaagtcgtcaagggcgacccggccaggaagggcgaggccgccgccaatggcgcgccgccgacgccgcagaagcaccatcagcaccaccaccccgccgcccccaccatcgccgtcagcgacagctccctcaagttcacccatgtcctctacaacctctcccccgccgagctgtacgagcaggcgatcaagtacgagaagggttcgttcatcacgtccaccggcgcgctggccacgctgtccggcgccaagaccggccgctcgcccagggacaagcgcgtcgtcaaggacgaggccgccgcgcaggagctctggtggggcaagggctcgcccaacatcgagatagacgagcacacgttcctgaccaaccgggagcgggccgtggactacctcaactccctggacaaggtgttcgtgaacgaccagttcctcaactgggaccccgagaaccgcatcaaggtccgcatcatctccgccagggcgtaccactccctcttcatgcacaacatgtgcatccggcccacggacgaggagctggagagcttcggcacgccggacttcaccatctacaacgccgggcagttcccctgtaaccgttacacgcactacatgacgtcgtcgacgagcgtagacatcaacctcgctaggagggagatggtgatcctgggcacgcagtacgccggggagatgaagaagggcctcttcggcgtcatgcactacctcatgcccaagcgcggcatcctctcgctgcactccggctgcaacatgggcaaggacggtgacgtcgccctcttctttgggctct

SEQ ID NO: 24768 - protein, 358 aa, Panicum virgatum
  misc_feature: Ceres CLONE 1860538
  misc_feature (135)..(358): Pfam Name: PEPCK_ATP Pfam Description: Phosphoenolpyruvate carboxykinase
  misc_feature: SWISSPROT Homolog: EC 4.1.1.49 Phosphoenolpyruvate carboxykinase (ATP)
MAAPNGLARIETHGKKQHENGVCHDDSAAPVRAQTIDELHSLQRKRSAPTTPIKDGAASPFAAALSEEERHRQQMQSISASLASLTRETGPKVVKGDPARKGEAAANGAPPTPQKHHQHHHPAAPTIAVSDSSLKFTHVLYNLSPAELYEQAIKYEKGSFITSTGALATLSGAKTGRSPRDKRVVKDEAAAQELWWGKGSPNIEIDEHTFLTNRERAVDYLNSLDKVFVNDQFLNWDPENRIKVRIISARAYHSLFMHNMCIRPTDEELESFGTPDFTIYNAGQFPCNRYTHYMTSSTSVDINLARREMVILGTQYAGEMKKGLFGVMHYLMPKRGILSLHSGCNMGKDGDVALFFGL

SEQ ID NO: 24769 - DNA, 301 bp, Panicum virgatum
  misc_feature: Ceres CLONE 1860538-R
ccccaacttctgatttcaagcagtggatccggaacgacgaggcgatggagtggggtcagaataaaacagtggtgggtgcgtgcgtgtgttaggatgatgatgatgacgaaaaaaaaggtgttggattgatgtgccaacacagtagactagccctgtatgttatcatgtgggcatgtgtgtggttttgttacctgtaagatttgttctgcctggtcctggtgtaagtctgtgcgtgcttgcatcttgcccgtgtactctctctggtttcagaatttgaatatgaagtatcttgatttcgagc

SEQ ID NO: 24770 - DNA, 1364 bp, Panicum virgatum
  misc_feature: Ceres CLONE 1860554
  misc_feature: Encodes the peptide sequence at SEQ ID NO. 24771
ggttatctcattaacccggctcttgggtctacgacgagttaagcccggagggaaaaggacaaatcacacaaagagcggaaaaaggcacacaaatcgcgccaccgtgggacgcgtacggtgcaccgcccggccgccggatctgcgccggcgacgcgaccggacatcggatctccgccgccgcaggaggagggaggcggcgctctggccgttccttgctcgcgagtgctcggatccgtcccgccggatacatataccaaccaatggttcagtgatatcgagctttcagttgatgcggaggtggtgaaagcatcttctcttctccaagactactgtctgctagttgcaagagtttgtccacaccttgctgcttatttgcttgcttctctggttgagtgcacggagaggagttagcagataaagtcagctcctttcagctcttctatgtccagggacttggactgtcctgttcagacacaaatggctgtggcagtcctagatcggagcttcagcagtgattatcctggaggtagcagaactgaggggaggcaaccgagctggaagagagtctttgtccaaactgacaatggttctgtcctaggcatcgagttggagaggggtgaaaatgtgcaagctgtgaaaaagaagctgcagatagccctcaatgtgcccactgatgagagctctctgacctttggtgatctggttttgagtaatgatcttagcagcattcgcaatgactcacctttgcttctcaaaaggaatcagcttcaccgaagcaattccacaccttgcctctcccctactggaaaggatgtttggaagcaagacaggagtgggcttattgaaatccttggctgttcaagcccttcctctcggatgaagcagcttgctaaggatgtcatcaaagccataaggaatggtgttgacccagtagcagttaacagtgggatgggtggtgcttactacttcaagaacatctggggagagcgtgttgcaattgtcaagccaactgatgaggaaccatttgccccaaacaacccaaaaggttttgtggggaaggcactgggacagccaggcctcaaaagatctgtgcgagttggtgagacaggtttccgagaggttgctgcttaccttcttgactatgatcactttgcaaatgttcctcccaccatgctggtcaagataacacacaccgtgttcaatgtgaatgactgtgttgggtgcaaaagcaaagttttctgcaacaagtcagaagctgtgagcaagattgcatcactgcagcagttcattccacatgattttgatgccagtgaccatgggacgtcaagcttccctgtatctgcagtgcataggattgccatact

SEQ ID NO: 24771 - protein, 307 aa, Panicum virgatum
  misc_feature: Ceres CLONE 1860554
  misc_feature: SWISSPROT Homolog: EC 2.7.1.67 1-phosphatidylinositol 4-kinase
  misc_feature: Useful for making plants with altered protein content
MSRDLDCPVQTQMAVAVLDRSFSSDYPGGSRTEGRQPSWKRVFVQTDNGSVLGIELERGENVQAVKKKLQIALNVPTDESSLTFGDLVLSNDLSSIRNDSPLLLKRNQLHRSNSTPCLSPTGKDVWKQDRSGLIEILGCSSPSSRMKQLAKDVIKAIRNGVDPVAVNSGMGGAYYFKNIWGERVAIVKPTDEEPFAPNNPKGFVGKALGQPGLKRSVRVGETGFREVAAYLLDYDHFANVPPTMLVKITHTVFNVNDCVGCKSKVFCNKSEAVSKIASLQQFIPHDFDASDHGTSSFPVSAVHRIAI

SEQ ID NO: 24772 - DNA, 674 bp, Panicum virgatum
  misc_feature: Ceres CLONE 1860554-R
  misc_feature: Encodes the peptide sequence at SEQ ID NO. 24773
ccatacaggtatcccaaagggtaaagtgtgtaaaacaaactaccgtggcaaagctagtgagcatcagtccgggagcaggagcgccaatgagctgctcccgcccagcaccagttttgtgaaggtgtcggacatgggccctagagagtggagtgcgttcctcgacatgttccaggagctgctcccaaacgccttccgtgcccggaagcacactactggtggcggccctcgtccgatgccgaggctgggcacgtcttgccagttttgaaagcagtagaagagaagctaccaaggtaatgtagttcttcgagctctggtttgcagcaggtactatatatactcttttaggtgtatggagcccgtagaggtggttcgagaataagaccgtccgtccttggcatatgagataagaggcttgcgggagaggggtgtgtctgtgcatagcgtttgacatatggggtcccttgttctttccttctttgtatatgtacatagtgctcctactacctcgcaacacggggctcgatctcggcccgtacctgatgatgggtggtggtgagcgtgctggcctgctggggcatgaatcgccttgtgtgtctcggcttttgccgctgtaccattttggagacgcttaccatgatgatatgaactatgatattgctacagatatgtgcatg

SEQ ID NO: 24773 - protein, 87 aa, Panicum virgatum
  misc_feature: Ceres CLONE 1860554-R
  misc_feature: Useful for making plants with altered protein content
HTGIPKGKVCKTNYRGKASEHQSGSRSANELLPPSTSFVKVSDMGPREWSAFLDMFQELLPNAFRARKHTTGGGPRPMPRLGTSCQF

SEQ ID NO: 24774 - DNA, 2084 bp, Panicum virgatum
  misc_feature: Ceres CLONE 1860584
  misc_feature: Encodes the peptide sequence at SEQ ID NO. 24775
gcatcctcctcctcgccgcgcccgcgcgctccgcctccgcgctcggtccctccgccttccctcccgcctcggtgcgtgagaactgagaacccgtcccgaattagctgttcgacttcgatctagcatcttggtgaacccatcgggttggtattggtcttgatattggggtctgctggattcgggagcaggtgctcgttcgggactctcgcggcgaccaaggggccgtcgtcgttgtcgccggcggcagcgccgttcagcaacgtggtcccgccgccccagcagcagcagcagcagccgcggagtaggaggcaggaggaggagatgacgatttcctcgtccgtcaagctcgccggcaggaccctgtcggtccgcgcccggacggtgctgtccggcgtgccggacgcggtggtggcgtcgtcggccgcggcggggggagcggttgacgggatcttcctcggcgccgacttcacggagccggccgcccggcacgtcgtctccctcggcgcactaaggggcgtgcgattcatggcgtgcttccggttcaagctctggtggatggcgcagcggatgggggagaagggcggcgacgtcccgctcgagacgcagttcctgctcgtcgagtccagggccgccggcgaggacgcggaggctgcgtacgtcgtgttcctcccgctcgtggagggcgcgttccgggccagcctccagggcggcgcgggcgacgcgctggagctctgcgtcgagagcggggacgccgacacgcgcgcggcgtccttcgaccgcgcgctcttcgtcggcgccgcggagtccgacccgttcgcggccatcgccggagccgtcgccgccgccaagtccgcgctcaagacgttccgggtcagcgccgagaagaagctcccgggcatcgtggactacttcgggtggtgcacctgggacgccttctaccaggacgtcacccaggagggcgtcgaggccgggctccgcagcctcatcgccggcggcgcgccgcccaagttcgtcatcatcgacgacggctggcagtccgtcggcaccgaccagtccgcagccgacgagcctgctggcggggacgagccgacccgcctgtctcggctcaccggcatcaaggagaacagcaagttccagaacgccgacgacccggccgccggcatcaagacggtggtgcgcgcggcgaaggagcagtacgggctcaagtacgtctacgtctggcacaccatcaccggccactggggcggcgtccgccccggcgcggccgggacggagcactaccgctcgagcttgcagttccccaaggtgtcgccgggcgtcgtggagaacgagcccggcatgaagaccgacgtgctcaccctccaggggctcggcctcgtgcacccgcgcgccgtgtaccgcttctacgacgagctccacgcgtacctcgccgccgccggcgtcgacggcgtcaaggtggacgtgcagtgcatcctcgagacgctcggcgccggccacggcggccgcgtgcagctcaccaggcagtaccaccaggcgctcgacgcctccattgccaagaacttcccggagaacggcatcatcgcttgcatgagccacaacaccgatgccctctactgctccaagcagacggcggtggtgagggcgtcggatgatttctacccgagggaccccgtctcgcacacgatccacatcgcctcggtggcgtacaacagcgtgttcctcggcgagttcatgctgccggactgggatatgttccactcgctccacccggccggcgactaccacggctcagcccgcgcgatcagtggcggccccgtctatgtcagtgatgccccagggaagcacaacttcgagctgctgaagaagattgtcttgcctgacggctccattcttcgcgcacgactgccaggccggccgaccaaggactgcctgttcaccgacccggcacgcgacggcgtcagctttgctcagatatggaacatgaacaagttcaccggcgtgcttggcgtgtacaactgccagggcgcggcgtggagctccgtggagaagaagaacgccttccaccagactggcaccgagggcct

SEQ ID NO: 24775 - protein, 587 aa, Panicum virgatum
  misc_feature: Ceres CLONE 1860584
  misc_feature (7)..(587): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
  misc_feature: Useful for making plants with altered carbohydrate content
MTISSSVKLAGRTLSVRARTVLSGVPDAVVASSAAAGGAVDGIFLGADFTEPAARHVVSLGALRGVRFMACFRFKLWWMAQRMGEKGGDVPLETQFLLVESRAAGEDAEAAYVVFLPLVEGAFRASLQGGAGDALELCVESGDADTRAASFDRALFVGAAESDPFAAIAGAVAAAKSALKTFRVSAEKKLPGIVDYFGWCTWDAFYQDVTQEGVEAGLRSLIAGGAPPKFVIIDDGWQSVGTDQSAADEPAGGDEPTRLSRLTGIKENSKFQNADDPAAGIKTVVRAAKEQYGLKYVYVWHTITGHWGGVRPGAAGTEHYRSSLQFPKVSPGVVENEPGMKTDVLTLQGLGLVHPRAVYRFYDELHAYLAAAGVDGVKVDVQCILETLGAGHGGRVQLTRQYHQALDASIAKNFPENGIIACMSHNTDALYCSKQTAVVRASDDFYPRDPVSHTIHIASVAYNSVFLGEFMLPDWDMFHSLHPAGDYHGSARAISGGPVYVSDAPGKHNFELLKKIVLPDGSILRARLPGRPTKDCLFTDPARDGVSFAQIWNMNKFTGVLGVYNCQGAAWSSVEKKNAFHQTGTEG

SEQ ID NO: 24776 - DNA, 1457 bp, Panicum virgatum
  misc_feature: Ceres CLONE 1860586
  misc_feature: Encodes the peptide sequence at SEQ ID NO. 24777
accacatcagccgtccataaggtgtcagcattcgttgaccgggatcaccgtcggccatcgccttgccgggcgccgccattgagcctgtctcctccgtacctgaaccctctgcgtccacacacattggataaaagatcatcttgtgtgaagccgtgcttgatcatcggccagggacactgatccttgatcgaattctcggttgattcttctgcttctgctgggctcgattggtgtggcacgaatggactgcgccgccgactacctgatcgccgtgggcaggtccacggcggatcccatgcggtggatgaagaagtggaggaaggccgccaacgtcatccggtcctgccacaggctggcccgcctcgccttccggtccgccgacatcctgcgccgcacgggctcctacgtcaccatcaagatccacgacgaagacgctgatgacgccgccggcacgtccaagcccgccgacgccgcgccggtggagttctccgtcgcgcccgacgacgaggacttccagggcctggtcaaggagaagcgccacggctgcttccgccgcctcggcgcgggccccgggatcgccgccgcgctggcgtccggcgcggaggccggcatccgcggcgacgaggccgacctgcgccgccgccgcgaggcgttcggcgccaacacgcacccgcggcggaagcccaaagggttctggtgccacgtgtgggacgcgctcagcgacgtcttcctcatcgtgctgctcgtctgcgccgccgtgtccctggggttcggcatcaaggagcacggcctaaaggacggctggtacgacggcgtcagcatcttcctcgccgtcttcctcgtcgcggcggtgtccgcggtcagcaaccacggccaggccaagcggttcgacaggctggccagcgagtccgacgacatcgcggtcaccgtcgtgcgcggcgggcggaggcaggaggtctccatcttcgacgtcgtcgtgggcgacgtcgtggtgctcaagatcggcgacgtcgtgcccgccgacggcgtgttcctggaggggcacgcgctgcaggtggacgagtccagcatgaccggcgagccacaccccgtggacgtcgatgccgagaagagccccttcctctcctctggcgtcaaggtcatcgacggctacggtaagatgatcgtcacggccgtcggcacggacaccgcgtggggcgagatgatgagcagcatcaccagggagaagaccgagccgacgccgctccaggagcgcctcgagggcctcacctccagtatcggcaaggtcggcgtcgccgtggcggtgctcgtcttcgccgtgctcaccgcgcggcacttcaccggcagcacccgggatgagcagggcaaacccctgttcgacaagcagcacgtcaccttcaacaccgtcttcagcgcgctcgtcgggatcttccagcaggcggtgaccatcatcgtcg

SEQ ID NO: 24777 - protein, 405 aa, Panicum virgatum
  misc_feature: Ceres CLONE 1860586
  misc_feature (193)..(405): Pfam Name: E1-E2_ATPase Pfam Description: E1-E2 ATPase
  misc_feature (96)..(178): Pfam Name: Cation_ATPase_N Pfam Description: Cation transporter/ATPase, N-terminus
  misc_feature: SWISSPROT Homolog: EC 3.6.3.8 Calcium-transporting ATPase
MDCAADYLIAVGRSTADPMRWMKKWRKAANVIRSCHRLARLAFRSADILRRTGSYVTIKIHDEDADDAAGTSKPADAAPVEFSVAPDDEDFQGLVKEKRHGCFRRLGAGPGIAAALASGAEAGIRGDEADLRRRREAFGANTHPRRKPKGFWCHVWDALSDVFLIVLLVCAAVSLGFGIKEHGLKDGWYDGVSIFLAVFLVAAVSAVSNHGQAKRFDRLASESDDIAVTVVRGGRRQEVSIFDVVVGDVVVLKIGDVVPADGVFLEGHALQVDESSMTGEPHPVDVDAEKSPFLSSGVKVIDGYGKMIVTAVGTDTAWGEMMSSITREKTEPTPLQERLEGLTSSIGKVGVAVAVLVFAVLTARHFTGSTRDEQGKPLFDKQHVTFNTVFSALVGIFQQAVTIIV

SEQ ID NO: 24778 - DNA, 602 bp, Panicum virgatum
  misc_feature: Ceres CLONE 1860586-R
  misc_feature: Encodes the peptide sequence at SEQ ID NO. 24779
cgctcatcagcaacgccatgtggcgcaacctcgccgcgcaggcggcgttccaggtggccgtgctgctggcgctccagtaccgcggccgcgacgtcctgggcgtcggcgagaaggccaacggcaccatcatcttcaacgccttcgtgctctgccaggtgttcaacgagttcaacgccagggagatcgagcgcaagaacgtcttcgccggcgtgctccggaacaggatgttcctgggcatcatcgccgtcaccatcgcaatgcaagtggtgatggtggagctgctgacgaggttcgccggcacccagaggcttggcgtggcgcagtggggtgtctgcgtcgccatagcggccatgtcgtggccgattggatgggcggtcaagttcatccccgtgccagaccggccgctccatgagatcgtggcaaccaggaaattcttctaggcatctgtagggatgtcacggcggcactggttttttaaatttttttcatatgaaatcactctaggcatgtaggcgtgcctactgtatatatgattattgtttcatttgttctattgtagtgtttggtaacagaagaaatacatacctttgatttcatcggcg

SEQ ID NO: 24779 - protein, 145 aa, Panicum virgatum
  misc_feature: Ceres CLONE 1860586-R
  misc_feature (1)..(131): Pfam Name: Cation_ATPase_C Pfam Description: Cation transporting ATPase, C-terminus
  misc_feature: SWISSPROT Homolog: EC 3.6.3.8 Calcium-transporting ATPase
LISNAMWRNLAAQAAFQVAVLLALQYRGRDVLGVGEKANGTIIFNAFVLCQVFNEFNAREIERKNVFAGVLRNRMFLGIIAVTIAMQVVMVELLTRFAGTQRLGVAQWGVCVAIAAMSWPIGWAVKFIPVPDRPLHEIVATRKFF

SEQ ID NO: 24780 - DNA, 1491 bp, Panicum virgatum
  misc_feature: Ceres CLONE 1860602
  misc_feature: Encodes the peptide sequence at SEQ ID NO. 24781
gagagcttgcctttgcctccttcagagaacaaggcgagggagagggacaccaccaccaagtacgcactcggattgggggcagcaaaggggacggacgcatcccatttgcctgggcaaatctcctgttcctccgttctctgctccatctctctctgcacgccccctctcgtgcgagcaagctagccttgttgaggacaatgatggcctgcgggtctcgaagtcggagcaacgagatggtcgacgagttcgagaagctggtcatccgaatgaactctccaagggtcaccgtggacaacgactccgacatgactgccaccttggtgaaggtggacagcgcgaacaagtatgggaccttgctggaggtggttcaggtgctgaccgatctgaagctgaccatcaagaggggctacatttcctccgacggcgagtggttcatggatgtgttccatgtcgtggatcaggatgggaataaactttatgatggccaagtcatcgacagaattgaacagtccctgggagcgggatcgctgagcttccgggcggcgccggagcggccggtgggcgtggaggcggaggcggaggaggagcagaccaccatcgagctgatcggccgcgaccggccgggcctgctgtcggaggtgttcgcggtgctcacggacctcaagtgcaacatcgtggcgtcggaggtgtggacccacgacgcccgcgtggcggcgctggtgcgcgtgacgaacgccgacgccggcggcgccgtcgcggaccccgaccgcctggacaccgtgaagcgcctcctccgccacgtcctccgcgggagcagccgcgacaagaaggccgcccgcgccgccatctcggcgcgcgccgcgcacgcgcagcgccggctccaccagatgatgcacgcggacaggcgccgcggcggcgaggacggcggcttcgacggctccgacgacgacggcgacggcggcgccgcgtcgcgcggcggctccggccgggcggtggtcgaggtggaggactgcgccgagcgcgggtacacgctcgtcaacgtgcggtgccgtgaccggcccaagctgctgttcgacacggtgtgcaccctcaccgacatgcagtacgtggtcttccacggcaccgtcatcgccgagggctccgaggcctaccaggagtactacatcaggcacctcggcgacagcgccggcagctccggcgaggaccgcgaccgcctctgccgcgccctcgaggccgcgatcgagcggcggtacaccgagggcttgaggctggagctgtgctgcgaagaccgcgtcgggttgctgtccgacgtgacgcgcatcttccgggagcacgggctgtcggtgacgcacgccgaggtggagacccgcggggcgcgggcggccaacgtgttctacgtggtggacgcgtcggggcagcccgtgcaggggcaggccgtggaggccgtgcgcgcggagatcggcgagcacgtcctgtccgtcaaggagccgg

SEQ ID NO: 24781 - protein, 430 aa, Panicum virgatum
  misc_feature: Ceres CLONE 1860602
  misc_feature (355)..(421): Pfam Name: ACT Pfam Description: ACT domain
  misc_feature (131)..(199): Pfam Name: ACT Pfam Description: ACT domain
  misc_feature: SWISSPROT Homolog: EC 2.7.7.59 [Protein-PII] uridylyltransferase
MACGSRSRSNEMVDEFEKLVIRMNSPRVTVDNDSDMTATLVKVDSANKYGTLLEVVQVLTDLKLTIKRGYISSDGEWFMDVFHVVDQDGNKLYDGQVIDRIEQSLGAGSLSFRAAPERPVGVEAEAEEEQTTIELIGRDRPGLLSEVFAVLTDLKCNIVASEVWTHDARVAALVRVTNADAGGAVADPDRLDTVKRLLRHVLRGSSRDKKAARAAISARAAHAQRRLHQMMHADRRRGGEDGGFDGSDDDGDGGAASRGGSGRAVVEVEDCAERGYTLVNVRCRDRPKLLFDTVCTLTDMQYVVFHGTVIAEGSEAYQEYYIRHLGDSAGSSGEDRDRLCRALEAAIERRYTEGLRLELCCEDRVGLLSDVTRIFREHGLSVTHAEVETRGARAANVFYVVDASGQPVQGQAVEAVRAEIGEHVLSVKEP

SEQ ID NO: 24782 - DNA, 1710 bp, Panicum virgatum
  misc_feature: Ceres CLONE 1860616
  misc_feature: Encodes the peptide sequence at SEQ ID NO. 24783
aaccctccgtcctccgccgagctcccaccgccgctgccccaatgcgcccgccgcgaacaccccgccggcgcgacgcggcgtcgttgcagcctgccgcggcgtttagccccggcgacctcgtggaggtgctccctgacgagcccggcctgcgcggtgcccacttcgcggctgttgtcgtggggcccagcaccaagccccggggctacaccgtcgagtacgacgccctcctcgagtccgaggattccgaccgcaagctccgggaggccgtgccggctcggaacctccgcccgcgcccgccgccgcaccgggcgcccaccacgggggaggcgcccgcggtgcacgccgccgtcgatgcgctcctggacgacgcctggtggcacggggtcaccctcggcggcgcggatggggccgggaaggtgaaggtgtgcttcccggagaccagggaggtcatggagttcgacgcctccgacgtccggccccacctcgagtgggccgacggcgagtggtgctcccccgatagcatggagatacccaggacaatgccatacacaaaaggaatgcaaatagaagtttccaaagttgaggataattctgttgttgcttggttacctgcagttgtggcaaagactatctggaagaacaacctcttagtggagtacactgtatcgaagagtggtggtattgccttgtctgaggagattgttgatgtgaagcatgttaggccttgcccaccacaagcatcagctattagtttctgcatcaatgatgaggttgaagcattccaaggtggtggctggtggctaggggtgattactgaggttcatccagaattaaaatacacaattaagtcaatacatttaggggtggaagttcagttgagccagaaattactgaggcttcgatatgactgggttgatggtcaatggaaacaagaatcacagaatacactcaaaccaaaatttacacatggcgtcaaggttgaagtcagcagcgatgatgaaggttttcgcggagcttggtttgaggcaactgttgttaaatccgctggcagcaagtttctggtggaatatgttgcactgaaggccgatgacgagaccaaacctttgaaagaagctgtagaagcgcggcacattagaccttcccctccatgtatccctgttgtcgacggattcaagttacttgatgaggttgatgcctactgcaacgatggatggtgggttggtgtggtatccaaggttatcagcaatcagaagtacatggtctacttcaggccttggaaggaagagagggaattcgagcatggacagctgaggtttcactgcgactggatgggtggaaggtggatgcgggcctccccggcactggagatgtgaaggctgaaaaactgggcgcacatttgtacaggatcttggccttactagcttatcacgcccctttcgtctccgcactcaagttccctcgtgtcatatgcatggcaaaggtcagaaagttgggtgatgatcattttgcacttgctgcaagttgccactccgtcagatcaggtgtgcattctggtaggcgcattctgctagtgttgatggtgacgaactggcatctggactctgcagtgctaatgttagagagttgagtgaccacgatcgctctagtatctttcttccgtgccatgtttgcagtagcttgcttgaacacccatgaagatttttccccccc

SEQ ID NO: 24783 - protein, 443 aa, Panicum virgatum
  misc_feature: Ceres CLONE 1860616
  misc_feature (307)..(372): Pfam Name: Agenet Pfam Description: Agenet domain
  misc_feature (21)..(89): Pfam Name: Agenet Pfam Description: Agenet domain
  misc_feature (169)..(234): Pfam Name: Agenet Pfam Description: Agenet domain
MRPPRTPRRRDAASLQPAAAFSPGDLVEVLPDEPGLRGAHFAAVVVGPSTKPRGYTVEYDALLESEDSDRKLREAVPARNLRPRPPPHRAPTTGEAPAVHAAVDALLDDAWWHGVTLGGADGAGKVKVCFPETREVMEFDASDVRPHLEWADGEWCSPDSMEIPRTMPYTKGMQIEVSKVEDNSVVAWLPAVVAKTIWKNNLLVEYTVSKSGGIALSEEIVDVKHVRPCPPQASAISFCINDEVEAFQGGGWWLGVITEVHPELKYTIKSIHLGVEVQLSQKLLRLRYDWVDGQWKQESQNTLKPKFTHGVKVEVSSDDEGFRGAWFEATVVKSAGSKFLVEYVALKADDETKPLKEAVEARHIRPSPPCIPVVDGFKLLDEVDAYCNDGWWVGVVSKVISNQKYMVYFRPWKEEREFEHGQLRFHCDWMGGRWMRASPALEM

SEQ ID NO: 24784 - DNA, 2338 bp, Panicum virgatum
  misc_feature: Ceres CLONE 1860629
  misc_feature: Encodes the peptide sequence at SEQ ID NO. 24785
acgggtgcctcttgcaagtagccaagtagcctatccacccgccgccgacgccggaggcccaaccgaccgcatcgatgccgtcgatcgccggcggcgggcgcgggcacctcttcgccgcgcaccggggcgcgatctggtggctccgccgccgccagcacccgcacttctcctccctcgccggcgggggacgccgaggcgacgcgccgcatctgccggtgctcatcgtcggagctgggcccgtcgggctcgtcctctccttcctcctcgccaaattcgggatcaaatgcgcggtgatagagaagaatgtgaagttcactcggcacccccgagcgcacttcatcaacaaccgcacaatggagatcttccgcaagttggatggcttggctggggacatcgagaggtcccagccaccagtggatttgtggaggaagttcgtctactgtacttcactctccggctccgttcttggatcggttgatcacatgaagccggaagattttgacaaggttattagtcctatatcagttgcacacttctcgcagtacaagttagttgatttgttactcgagaagctagaaggtattggcttcaggacatgctttcccagtgagattggtatcttaacacaggatgtgggactggaaagcaagatattgatgggacatgagtgcacatcccttcagcagactgatgagggcattttggttggaacatcagttaataatggcgacaggatgctagagagaaagctacactgtggtattctactagggacagatggtgcaagaagcacagtgcgtaaattagcaggcatatctatggagggtgaaagggacttgcagaaactggtcagtgtacattttcttagcagagatctaggcagatatttatccagtcagaggcctgggatgctattctttgttttcaacccgggcgcaattggtgtgctcgttgcacatgacctggagcatggggaattcgtattgcagattccattttatcctcctcagcagatgtttgaagaattcagctctaaggtttgtgagcaaattattgtcaaattagttggatgggagccagcagatgttcaggttttagacataaagccatgggcaatgcatgctgaagttgcagaaaagtacatcagctgcagcaatcgtgttgtccttgttggtgatgctgctcaccgttttcctcctgccggtggttttggaatgaacactggtgttcaggatgcacataatttggcttggaaattgggcttaatgctgaatggtgttgcttcaccatcaatactgcaaacttatgaatctgagcgccgacctgttgcaattttcaatactgagctaagtgtggagaacttcaaagcagcaatgtctattcctgcaagccttggtcttgatccaactgttgcaaattcagtgcatcaagttatcaacagaagcctaggatcaatcattccaagaaatgtacagaaggcagtgttggaagggttgttttccattggtcgggcacaagtctcagattatattctgaatgagaaaaatccccttgggtcattgagattagcaaggctgagaagtattcttgatgaagggaaaagtctgcagctgcagttccctgcagaggatcttggcttctgctatgaagaaggagcactagttgatgaagattgcagtcagaagactcagacaggagtaaagctagagcattctgagaggacatcaagagagtacatcccatccgctaaggttggttcgcggctaccccacatgcttgtaagagcactgcctgcttcaagcgagggcgtgttctcaacactggacctggtaagtgtggataaacttgagtttgtactcatcatcgcaccactgaaagagtcatatatgatcgcccatgctaccctcaaggtagcagatgagttcaagctgtcagtcaaagtatgtgtcatgtggcctcaaggctctgctgatgtggaagtggaggagagcagatctgagctagcgccctggacgaactatgtcaatgtcgaggaattgcctagggtatcttgtaattcatggtgggagatgtgtcagattagcaggaagaatgtcattctggttaggcctgatgagcacatagcatggagaacggaatgggacatggtgagagacgctgattcagaagttaggggagtcttttctcaaattctgtgcctaaattgtcaccagacgtagggatttccattcattgtctgactgagttttacggtgtcactaaattagtatagcaaagaacatgttcttgttgtgattataaccaatagggaattgcatttaagtaattgttggcatgc

SEQ ID NO: 24785 - protein, 714 aa, Panicum virgatum
  misc_feature: Ceres CLONE 1860629
  misc_feature (45)..(426): Pfam Name: FAD_binding_3 Pfam Description: FAD binding domain
  misc_feature: SWISSPROT Homolog: EC 1.14.13.20 2,4-dichlorophenol 6-monooxygenase
MPSIAGGGRGHLFAAHRGAIWWLRRRQHPHFSSLAGGGRRGDAPHLPVLIVGAGPVGLVLSFLLAKFGIKCAVIEKNVKFTRHPRAHFINNRTMEIFRKLDGLAGDIERSQPPVDLWRKFVYCTSLSGSVLGSVDHMKPEDFDKVISPISVAHFSQYKLVDLLLEKLEGIGFRTCFPSEIGILTQDVGLESKILMGHECTSLQQTDEGILVGTSVNNGDRMLERKLHCGILLGTDGARSTVRKLAGISMEGERDLQKLVSVHFLSRDLGRYLSSQRPGMLFFVFNPGAIGVLVAHDLEHGEFVLQIPFYPPQQMFEEFSSKVCEQIIVKLVGWEPADVQVLDIKPWAMHAEVAEKYISCSNRVVLVGDAAHRFPPAGGFGMNTGVQDAHNLAWKLGLMLNGVASPSILQTYESERRPVAIFNTELSVENFKAAMSIPASLGLDPTVANSVHQVINRSLGSIIPRNVQKAVLEGLFSIGRAQVSDYILNEKNPLGSLRLARLRSILDEGKSLQLQFPAEDLGFCYEEGALVDEDCSQKTQTGVKLEHSERTSREYIPSAKVGSRLPHMLVRALPASSEGVFSTLDLVSVDKLEFVLIIAPLKESYMIAHATLKVADEFKLSVKVCVMWPQGSADVEVEESRSELAPWTNYVNVEELPRVSCNSWWEMCQISRKNVILVRPDEHIAWRTEWDMVRDADSEVRGVFSQILCLNCHQT

SEQ ID NO: 24786 - DNA, 1480 bp, Panicum virgatum
  misc_feature: Ceres CLONE 1860674
  misc_feature: Encodes the peptide sequence at SEQ ID NO. 24787
agttttctgctctctacacagacgagcggattcttgtgttccgtttcaaaagttcagaggccgtgggactttaacagcgctcactgcccactcctccaggggtcgcgggccatggccgccgcagcagccatggccacgtctcgcggcggcaaacagcggcagccgctcctccactctcccacgcccaccgcccccaacggcggcggcgcggccgggaggcgtaggttcctcgccttcctcgccgtcacggcggctctggtggcgtcgtaccaactcctcgagccaaccgattcgtcgcggtaccacgcgctcttcctcaccctcggctccaacgccaccgcggccgcccacctccgcgcgctcaccctccgcccccacgtcgccggcaccgaggccaacgcggccgcggcacgctacgtgctccacgccttctcctccctctccttccccgcacacatcaccccttactcggtgctcctctcctaccccgcccaccgctccctcaccctcgccgcggcgcgcggccttgccgccaagcccttctccctggtgcaggagacctacaacggcgaccccttcgccgaggcctcggcggaggtcatcccgacgtacttcgcctactcggcgtccggctcggtcgccgccgaggtcgtctacgccaattacgggcacaacgaggactacgcctacctcgcctcccgcggcgtcgacgtcgcgggcaaggtcgcgctcgtgcggtacggcgacatccactgcgaggacatggtgcggaacgcgcgcgccgcgggcgccgccgcagcgatcgtgtacaccgacgccaaggacttcggcggcggcgccaccaggggggcgaagcggaagtggttccccgacgcgcggtggctgccgccgaccggcgtgcaggtggggaccctgtactacgggaacggcgacccgaccacgcccatgtggccgtcgtgcgcggctggggacgactgcgagcggctgagcgcggaggacctgagcgggagcgaggccatgcccggcatcccggcgctgccggtgtcggccagggacggcgacacgatcctcaaggcgatgggcggcgacgtggcgccgccgaagtggcagggcggcgaggatgcgcccgtgtaccggctcgggcccggcccggcggtgttgaatctcacctacattggaaacgaaaccttagcaaccatcgaaaatgtttatgcggtgatccaagggaaagaagagcctgatagatacgtgatcataggcaaccatcgtgatgcgtggacatttggagcaatcgatcctaacagtgggacagcagccatgcttgagatcgcggagcggctgtccaagctacaagccaaagggtggaggcctagacgaacaataatcctgtgcagttgggacgcagaagagtttgctctgatcgggtcaactgaatgggtagaggagaacatggacactctagcttcgagagctattgctt

SEQ ID NO: 24787 - protein, 450 aa, Panicum virgatum
  misc_feature: Ceres CLONE 1860674
  misc_feature (165)..(274): Pfam Name: PA Pfam Description: PA domain
  misc_feature: SWISSPROT Homolog: EC 3.4.17.21 Glutamate carboxypeptidase II
MATSRGGKQRQPLLHSPTPTAPNGGGAAGRRRFLAFLAVTAALVASYQLLEPTDSSRYHALFLTLGSNATAAAHLRALTLRPHVAGTEANAAAARYVLHAFSSLSFPAHITPYSVLLSYPAHRSLTLAAARGLAAKPFSLVQETYNGDPFAEASAEVIPTYFAYSASGSVAAEVVYANYGHNEDYAYLASRGVDVAGKVALVRYGDIHCEDMVRNARAAGAAAAIVYTDAKDFGGGATRGAKRKWFPDARWLPPTGVQVGTLYYGNGDPTTPMWPSCAAGDDCERLSAEDLSGSEAMPGIPALPVSARDGDTILKAMGGDVAPPKWQGGEDAPVYRLGPGPAVLNLTYIGNETLATIENVYAVIQGKEEPDRYVIIGNHRDAWTFGAIDPNSGTAAMLEIAERLSKLQAKGWRPRRTIILCSWDAEEFALIGSTEWVEENMDTLASRAIA

SEQ ID NO: 24788 - DNA, 723 bp, Panicum virgatum
  misc_feature: Ceres CLONE 1860674-R
  misc_feature: Encodes the peptide sequence at SEQ ID NO. 24789
ggtctgattgctctgaaacttgctgatgatgagatcataccctcaaattatgtctcttatgcgtccgaactggaggaatgcacaaaagatatcgcagagaaatgtaaaggattccctgtcactttatctcctttacagaagtccatcaagcagcttgaaagcgcagccactaaaattcatgaggagaagaagttgctgcaagcagaaaactggagcctaaagacaaggcagtacacactgaaagtcagggagataaacgaccggttgatgatggccgagcgagcgttcaccaaccgagagggactggccggcagaccatggtacaagcatatgatctatgcatcctcggatcaagatgactggggcaccaaagcattccctggtatcgtctcggccatggacaaggcgaagaagtccaacacaaccgaatcctggcggtcgctgcagcatgagatttacagggttgcaagggcagtgtccaaggcttctgcagtcctggatggtgggctaacatgatacgcgctccaactctcattctcattctatacagaattacagatcaaagtactggatggcttcagcttttcccccctttttttggaaactaaaagggcttgaaatagctgccagatataaatttgggtaatggcgtgtaaatccatatgctgaactttactggtgtacactgtatactgactaagagtagtgaatcttctttcatgg

SEQ ID NO: 24789 - protein, 171 aa, Panicum virgatum
  misc_feature: Ceres CLONE 1860674-R
  misc_feature (29)..(169): Pfam Name: TFR_dimer Pfam Description: Transferrin receptor-like dimerisation domain
  misc_feature: SWISSPROT Homolog: EC 3.4.17.21 Glutamate carboxypeptidase II
GLIALKLADDEIIPSNYVSYASELEECTKDIAEKCKGFPVTLSPLQKSIKQLESAATKIHEEKKLLQAENWSLKTRQYTLKVREINDRLMMAERAFTNREGLAGRPWYKHMIYASSDQDDWGTKAFPGIVSAMDKAKKSNTTESWRSLQHEIYRVARAVSKASAVLDGGLT

SEQ ID NO: 24790 - DNA, 634 bp, Panicum virgatum
  misc_feature: Ceres CLONE 1860677
  misc_feature: Encodes the peptide sequence at SEQ ID NO. 24791
gcctgctctgctctgctctgctcatctccctccgctcgccaatcctgcagccacgcgctgctccaccagacccgaccaccaggatgctcaggaccgccgccgccgtccgcatggattccgcccacggtcacgggccgtcaccctcctcctccacctcgccggcggcggcgccgccgccatggctcccagccgacgaccactgcctccacctccactacgaccacacggcgtccactccctccacgacgcccgccaccgccgcgccgccgaaccgccaccacctccgcaccgtgaccaccgcaacccggcgcgccacgaaacgccgcccgcgaccgtcgcggaagctgcccaccacctacatcaccgctgaccccgccagcttccgtcgcatggtgcaccaggtcaccggcgccgacgacctgctgcctgtgcctccgcctgcgcctccggaagccctctgccgcccggcgccccaccgcgctggcgccgccggcgcgctgacgctgcccacgctcgacacgtcggctttcctgctcggcgcgcccggagtggccgcgcggacggacgcgccgtgcgcggcctcgcccgggttttcgacggcggcgccagcactggatcgggcggaggccggtgg

SEQ ID NO: 24791 - protein, 183 aa, Panicum virgatum
  misc_feature: Ceres CLONE 1860677
  misc_feature (86)..(116): Pfam Name: VQ Pfam Description: VQ motif
MLRTAAAVRMDSAHGHGPSPSSSTSPAAAPPPWLPADDHCLHLHYDHTASTPSTTPATAAPPNRHHLRTVTTATRRATKRRPRPSRKLPTTYITADPASFRRMVHQVTGADDLLPVPPPAPPEALCRPAPHRAGAAGALTLPTLDTSAFLLGAPGVAARTDAPCAASPGFSTAAPALDRAEAG

SEQ ID NO: 24792 - DNA, 1300 bp, Panicum virgatum
  misc_feature: Ceres CLONE 1860680
  misc_feature: Encodes the peptide sequence at SEQ ID NO. 24793
tcgcttcgtcccctgcagatctcctcgccctcgacgcgctcaccctcaggtcaaccacacccctccgcccctctacgcgtatcgcattccacacccgcctcgggcctcagatctcacttcccgttcttggcttcgtttcgacctctggcagcgagcatgtcttcgtcggagaaccccacggtgaccgagcgcggcagcaaggaccgccgcgacgaggacggcgacaagaaggagggcggcggcggcttcatcgacaaggtcaaggacttcatccacgacatcggcgagaagatcgagtaggtcgtcggcttcggcaagcccagcgccgacgtctccggcatccacatcccgcacatcagcctccaccgcgccgacctcgtcgtcgacgtgctcatcaagaaccccaaccccgtccccatcccgctcgtcgacatcgactacctcatcgacagcgacggccgcaagctcgtctccggcctcatccccgacgccggcaccatccacgcgcacggcgaggagaccgtcaagatccccgtctccctcgtcttcgacgacatcaagagcacctacaaggacatccagccagggagcatcatcccctacctcgtccgcgtcgtcctcctcgtcgacgtccccatcatcggccggatcaagatcccgctccagaagtccggcgagatccccgtcccctacaagcccgacgtcgacgtcgagaagatcaagttccaccatttctccttcgaggagaccaccgccacgctgcacatcaagctcgagaacaagaacgacttcgacctgggcctcaacatgctcgagtacgagatgtggctcggcgacgacagcatcgcctccgccgagctcacgcagagcgccaagattgagaagcagggaatcaccaggatgcagattcccttcagcttcaggcccaaggacttcggatccgcggtctgggacatgatcaggggcagggggacaggctacaccttcaagggcaagattgatgtcgacactccctttgggaacatgaagctgcccataagcaaagagggtggaaccacccgcatcaagaaggacgaggacgacgacgacgacgacgataactgaggtaccatctgcctgcttctggtgctgctggctgccgctgattgattcgtcatctttgcttcatcagttcagtactcttttagactttggcttactagaatgcccatggaaaagatatagctttagcataagcatgcatcttttcaattcaacttgaggtgtcttgataagctaaattttctagtatatgttgcag

SEQ ID NO: 24793 - protein, 98 aa, Panicum virgatum
  misc_feature: Ceres CLONE 1860680
  misc_feature: Useful for making plants with altered alkaloid content
MLEYEMWLGDDSIASAELTQSAKIEKQGITRMQIPFSFRPKDFGSAVWDMIRGRGTGYTFKGKIDVDTPFGNMKLPISKEGGTTRIKKDEDDDDDDDN

SEQ ID NO: 24794 - DNA, 1676 bp, Panicum virgatum
  misc_feature: Ceres CLONE 1860681
  misc_feature: Encodes the peptide sequence at SEQ ID NO. 24795
acaaccaccaacagacccgggcacggccagcgacacccccacctccgcctttttcctccctccgctcacctcatcgcctcgtctccacctccaaaagtcgcgagccgtctctgcggggttttgcggggggacggttggcgtcttgcgctgctggtggagggccgtttggccggccgccgggctttccatccttcccctgcctttggggaggtttcttgaggggttttagccggagcacggtggcgcagtcatcaaatgcgagtggagtgatgtgggccttggaggaggagatgttcgtggcggtgaggcgcacggagcacgtcgaggtcacctcccgggccgcgccggggccgaggaccgtcagggtcttctgcgacgactacgacgccacggactcgtccggcgacgacgacgacgcaggcgccgccgcgcgccggagggtgaagcgctacgtgcaggagatccgcctggagcgggcggtgaaggaggcgccgcccgcccggcccgcggcgtccccggcggccccggccgcggcgagggtgaagctggtgctccccggccggaagaggaaggccgacggcgccggcgccgcggagccgcggttccgcggcgtgcggcggcggccctggggcaagtacgcggcggagatccgagacccgtggcggcgggtgcgggtgtggctcggcaccttcgacaccgccgaggaggccgccaaagtctacgactcggcggccgtccagctgcgcgggcccgacgccaccaccaacttcgagcaggtcgacgacgccgccctcgccgtccccgcggaggtcgccgagcgcctcccccagccgcctcaggcggcggcgtccaagaacgcgtcctcgtctgccacctcctacgactccggcgaggagtcccacgcggctgcggcgtccccgacctccgtgctccgctcattcccggcgtccggggtcgccaacgacacctgcagcaagaagccggcgccggctccggctcccgcggcgccagcaccactgccggcgtcccgcgccccggagaccgacgagtccagcggcgtggtgttccgctgccccttctccagcgccgacggcttcgccggcgagttccctcccatgtacaccgacttcgacctccttgccgacttcccggagccgtcgctcgacttcctcgccgacatccccgaggagcccctgtccctgccgttcttctccgccgccaccaccaccacaagcagcgagtcctcgtcggagccgccgtcgccggcgaggtggcagcaggtggacgacttgttccaagacatcaccgacctgttccaaatcgacccgctgcccgtcgtctagctagcgcagcaccaactgtaaacaccgggcttagcgcagcagctgctgctaatccggccaattttgtttgcattccgtcgtttttctttctttttagtatttcttttaggggcgtgagaagagagaagcttgttcggcagggcggcgtagctgctgccactaccacccccgccgaggaggaagaagaggccttggacggggcgagttgcgagagagagaggtgtgtggtggtgggatgggaatgggatcttccgccatgtatggtcctgtgtccttggactgtgaccaccatcaagttatcatcagtaattagagagaaattaagctatgagc

SEQ ID NO: 24795 - protein, 357 aa, Panicum virgatum
  misc_feature: Ceres CLONE 1860681
  misc_feature (110)..(161): Pfam Name: AP2 Pfam Description: AP2 domain
  misc_feature: The sequence is a functional homolog of SEQ ID NO 1158 in the 10/374,780 US patent application
  misc_feature: The sequence is a functional homolog of SEQ ID NO 1361 in the 10/412,699 US patent application
  misc_feature: Useful for making plants with altered lignin content
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: Useful for biocontainment applications
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MWALEEEMFVAVRRTEHVEVTSRAAPGPRTVRVFCDDYDATDSSGDDDDAGAAARRRVKRYVQEIRLERAVKEAPPARPAASPAAPAAARVKLVLPGRKRKADGAGAAEPRFRGVRRRPWGKYAAEIRDPWRRVRVWLGTFDTAEEAAKVYDSAAVQLRGPDATTNFEQVDDAALAVPAEVAERLPQPPQAAASKNASSSATSYDSGEESHAAAASPTSVLRSFPASGVANDTCSKKPAPAPAPAAPAPLPASRAPETDESSGVVFRCPFSSADGFAGEFPPMYTDFDLLADFPEPSLDFLADIPEEPLSLPFFSAATTTTSSESSSEPPSPARWQQVDDLFQDITDLFQIDPLPVV

SEQ ID NO: 24796 - DNA, 2135 bp, Panicum virgatum
  misc_feature: Ceres CLONE 1860708
  misc_feature: Encodes the peptide sequence at SEQ ID NO. 24797
actttccccgcctccatcaccatcacaatctcctctcgtctcccgcaccgcaccgcacctcgcaaaccctgcgcgcggaattctcctccgcagcaaccgccatgggcggctcccacagccgcgaggacatcgacctcacttcctccgacgaggaggaggagtacgaggaggactacgacgcccgatcccccatctccgagcccgccgcgagcgcgggccagcgcgacgacgacctcctccgcaccgccaccccctcgtcgctcgaggccatcgacgccaagctcaggtcgctcgacctcaagtaccagcaccccaccgccgccaagctctacctccacgtcggggggtcctcgccctcagcgcgctgggtgctcgacgagcgccgcgcgacctacgccttcgtcgacaaggcgagcgacgacgcctcctcccccaggtggttcctggaggtccgcccggggccgcgggtctccgcccccgtggactcagcgctccagctgaagacgaaccctactcagcgccgggcggacttcgctgcgggcggctccgtatgggctctgcgactgcccaccgacgccgaattccgccggttcgggttggagtacgagcggtgcattttcgagaatacctacggggtcgaggccacggacgagggccggaaggaggtgttcggcgctgacttcgccgcgtgggcgcgccccgacgaggccgacgacgccgtttgggccgacgcagaggaaagcctcaaccctcccgccgccgctccagcgagggacctccttgaggagttcgaggaggacgccggcgacggcgacagcatccagagcctcgcgcttggagcgctcgacaacagcttcttggtcggcggcgccgggatacaggttgtgaagaacttccagcatggcttgcacgggaagggcgcatcggtgaggatttcaggtggcagtgggatcgcctattcgacaccgaagaaggctctccttatgcgcggcgagacaaacatgctgctgatgagccctggagaggctctgcgttctaatggagtccaccatgttgatattgaaactggaaaggtcgtagccgaatggcggttcgagaaggatggaactgacatcacgatgcgcgatattgccaacgacagtaagggcgcacagctggaaccctccggatcgacattcttggggctggatgacaaccgattgtgcagatgggatatgcgcgatgccagaggcagagtgcagactattggtagctcatcagaatcaccggtgctgaaatggtcgcagggtcatcagttctcgcggggcactaacttccagtgcttcgcaagtactggggacggttcaattgtagttggttctgtggatggcaagatcagactctattctaagagctcaatgcgtatggcaaagacggcattcccagggctcgggtccccaatcacccatgtggatgttacatttgatgggaaatggattctgggcacaactgacacatacttgattttgatctgcaccatctttaaggacaaggatgggaaagaaaagactgggtttagtgggcggatgggaaataggattgctgcaccaaggctactcaagctcactccgctggattcaattttagcagggactgacaacaaattccatgggggccagttctcatgggtgacagagaatggaaagcaggaaaagcatcttgttgcaacagttggcaaattcagtgtcatatggaattttcagcaagtaaaggacagcaaccatgaatgctaccgtgatcagcagggccttaagagctgctactgctacaaggtcgtgctcaaggatgaatcaattgttgacagccgctttatgcatgagaagttcgcaactggtgactctcccgaggctcctctagtggtcgcgacaccgatgaaagtcagctctttcagtatagcaaatagacgctaactccggcagttttgattgttcttttgttggtgtaatatagtgtgagaagtgacagattcctgttcgtttagtggttggtttgttggttcttagttcttacacggtttggttggtttcattacaatggttgacttgtaatgcaaagctgatctagcttcattgaggaagttggtaacaacttgtacg

SEQ ID NO: 24797 - protein, 615 aa, Panicum virgatum
  misc_feature: Ceres CLONE 1860708
  misc_feature (1)..(595): Pfam Name: VID27 Pfam Description: VID27 cytoplasmic protein
MGGSHSREDIDLTSSDEEEEYEEDYDARSPISEPAASAGQRDDDLLRTATPSSLEAIDAKLRSLDLKYQHPTAAKLYLHVGGSSPSARWVLDERRATYAFVDKASDDASSPRWFLEVRPGPRVSAPVDSALQLKTNPTQRRADFAAGGSVWALRLPTDAEFRRFGLEYERCIFENTYGVEATDEGRKEVFGADFAAWARPDEADDAVWADAEESLNPPAAAPARDLLEEFEEDAGDGDSIQSLALGALDNSFLVGGAGIQVVKNFQHGLHGKGASVRISGGSGIAYSTPKKALLMRGETNMLLMSPGEALRSNGVHHVDIETGKVVAEWRFEKDGTDITMRDIANDSKGAQLEPSGSTFLGLDDNRLCRWDMRDARGRVQTIGSSSESPVLKWSQGHQFSRGTNFQCFASTGDGSIVVGSVDGKIRLYSKSSMRMAKTAFPGLGSPITHVDVTFDGKWILGTTDTYLILICTIFKDKDGKEKTGFSGRMGNRIAAPRLLKLTPLDSILAGTDNKFHGGQFSWVTENGKQEKHLVATVGKFSVIWNFQQVKDSNHECYRDQQGLKSCYCYKVVLKDESIVDSRFMHEKFATGDSPEAPLVVATPMKVSSFSIANRR

SEQ ID NO: 24798 - DNA, 2018 bp, Panicum virgatum
  misc_feature: Ceres CLONE 1860711
  misc_feature: Encodes the peptide sequence at SEQ ID NO. 24799
gcggccaacgccccccgcgccagcaataatacaacccccccaccacccgggccgcgcctgcccgtcgccggacatgggcaagaagggcggcgccacgtcctggctcaccgccgtcaagcgggccttccgctcgccctccaaggacgacgccgcctcgcccgcaaggaaggcctcgcgcctccgcgaccgcgacgacgcccccgccgacgccgaccaagacaaggtgcccgcccctctcccctgttccctgctcctcctcctccttcttcttcgccgatgctgcggcggctcacgtttccagttgcgcgtccagcaggggaagcgggagcagcgccggcgatggctgttccggaggtcctcctccccgtccccgtcccctgcccccgccgcgccggagcacccggccgtcacggaggagcagcgccacgccatcgcgctggcgctggcgaccgccgccacggccgaggccgccgtggccacggcgcaggcggcggcggaggtggtccgcctcaccctccccggcggcctcgccgcccgcgagcactacgccgccgtcctcatccagaccgccttccggggctacctggcgcgccgcgcgctgcgggcgctcaggggcctcgtcaagctgcaggcgctcgtgcgcggccacaacgtccgcaagcaggccaacatgacgctccgctgcatgcaggcgctggtgcgcgtccaggcgcgcgtccgggaccagcggatgcgcctctcccaggactccatgtccctgtccatgccgctgtccgccgccggcgccgccgcggcgccgtgcggcagcagcaagtcgtcgtacagcgtcgacacatccacgttctgggactccaagtacacccacgactacgccgaccgccgctccgtcgagcgatcgcgcgacggcagcagcttcgccgccgacgactgggacgaccggccgcggacgatagaggagatccaggccatgctgcagacgaggaaggacgcggcgctcaagcgtgagagggcgctgtcctacgccttctcgcatcaactttggaggaacccggcgccggcggcggatgagatggacgtggacggcggcgggcagcagccgcggtggatggcgtcgcgcgcgtccttcgacacgaaccggagcagcagcatccgcggcgcggcggtgcccgggcgcgcgtccatggaccaccgcgagcccgtgaagacgctggggatggacacggcgcggcccttctcgtactcgacgccgcggcagcaggcgccgtcgtcctcgccgatgcaccaccgcgggcactcgccggtgacgccgtcgccggggaaggcgcggcccccgatccaggtccggtcggcgagcccgcgcgtggaccgcggcgcgggcggcgggagctacacgccgagcctgctgcactcccagcggcaccaccaccaccaggcgggggcggcggtgcccaactacatggcggcgacggagtcggccaaggcccgggtgcggtcccagagcgcgccgcggcagcggcccgcgacgcccgagcgcgaccggctctccggcggcggcgggagcgcgaagaagcggctgtcgttcccggcggcggcggaggcgtacgcgcagtccctgcggagcccgagcttcaagagcgcggcggggcggttctcgtcggagcagcggtcgacggtgtcgtcgtcgtgcgcggagagcctcggcggggagccggcgtcgccgtcgtccaccaccgacctccgccgctggctccgctgagggccggccggccgtccgttctccgttgtagcagtaacgccgccttttggctcggcagacacgaccacgtgcccctgtagcatcatcttctctctcggtgtaattcatggcagcttttttcgagcgagcgatggagtgtcagagccagagcgtgagtgcggtgggtcccgcgtgtcaggagcacgcgggcagctaggcaggctggactggaaagcgtaggccccggtttgggaaggcgggaaagaagaatccttttttgcgt

SEQ ID NO: 24799 - protein, 560 aa, Panicum virgatum
  misc_feature: Ceres CLONE 1860711
  misc_feature (157)..(177): Pfam Name: IQ Pfam Description: IQ calmodulin-binding motif
MGKKGGATSWLTAVKRAFRSPSKDDAASPARKASRLRDRDDAPADADQDKVPAPLPCSLLLLLLLLRRCCGGSRFQLRVQQGKREQRRRWLFRRSSSPSPSPAPAAPEHPAVTEEQRHAIALALATAATAEAAVATAQAAAEVVRLTLPGGLAAREHYAAVLIQTAFRGYLARRALRALRGLVKLQALVRGHNVRKQANMTLRCMQALVRVQARVRDQRMRLSQDSMSLSMPLSAAGAAAAPCGSSKSSYSVDTSTFWDSKYTHDYADRRSVERSRDGSSFAADDWDDRPRTIEEIQAMLQTRKDAALKRERALSYAFSHQLWRNPAPAADEMDVDGGGQQPRWMASRASFDTNRSSSIRGAAVPGRASMDHREPVKTLGMDTARPFSYSTPRQQAPSSSPMHHRGHSPVTPSPGKARPPIQVRSASPRVDRGAGGGSYTPSLLHSQRHHHHQAGAAVPNYMAATESAKARVRSQSAPRQRPATPERDRLSGGGGSAKKRLSFPAAAEAYAQSLRSPSFKSAAGRFSSEQRSTVSSSCAESLGGEPASPSSTTDLRRWLR

SEQ ID NO: 24800 - DNA, 1441 bp, Panicum virgatum
  misc_feature: Ceres CLONE 1860733
  misc_feature: Encodes the peptide sequence at SEQ ID NO. 24801
aatcctccagccctcgccgcataattgctcctcgcatcttccgagccgggaaggcatttaaatccccccccccccaccaaaccctaccctctctcctcatccaccgcccccttctgagttctgacctccctcgcatcacacccagcccttggcggcggcggcgcgcaccaggtgttcgacggaagtccccgcccggcgggtggcccgaaggcggcagcaaaatgtacgtggtgaagcgggacgggcggcaggagacggtgcacttcgacaagatcacggcgcgcctcaagaagctcagctacggcctcagccaggaccactgcgaccccgtgctcgtcgcgcagaaggtctgcgcgggggtctacaagggcgtcaccaccagccagctcgacgagctcgccgccgagaccgccgcggccatgaccgcctcccacccggactacgcctcgctggcggcgaggattgctgtgtcgaacctgcacaagaacaccaagaagtccttctcggagacgattaaggacatgtacatgcacttcaacgagagatctgggctgatggcccctctggtcgctgacgatatttatgaaatcatcatcaagaatgctgctcgcttggacagtgagataatttatgatagggactttgattatgactactttggcttcaagactcttgagaggtcttacctcttgaagcttgcggggaaggttgttgaaaggccacagcacatgctaatgagggtttctgtggggatacacaaggaagacattgagtctgccatcaagacataccatctcatgtctcagcgctggtttacacatgcctcaccaacacttttcaatgctggcactccaaggccccaattaagcagctgtttccttatctgcatgaaagatgacagcattgagggcatttatgatactctgaaagaatgtgctgtcataagcaaatcagctggaggaattggtgtgtcagttcacaatattcgtgctactgggagttacattcgaggaacaaacggagcatccaatgggattgtacctatgttacgtgtcttcaatgatactgctcgttatgttgatcaaggaggtggcaaaagaaagggtgcatttgctgtatacttggagccttggcatgctgatatttttgagttccttgatctgagaaagaaccatgggaaggaggaacatcgtgcaagggatcttttctacgcattatgggttcccgatctattcatgcaaagggtccagaataacggagaatggtcattgttttgccctaatgaagctccagggttggctgattgctggggcgatgagtttgagaatttgtacaagaaatatgaaaaagaaggcaaggcaaagaaagttgttccagcacagaccctctggtttgacattttgaaggcacagatagaaactgggacaccatatatgcttta

SEQ ID NO: 24801 - protein, 406 aa, Panicum virgatum
  misc_feature: Ceres CLONE 1860733
  misc_feature (141)..(213): Pfam Name: Ribonuc_red_lgN Pfam Description: Ribonucleotide reductase, all-alpha domain
  misc_feature (1)..(91): Pfam Name: ATP-cone Pfam Description: ATP cone domain
  misc_feature (215)..(406): Pfam Name: Ribonuc_red_lgC Pfam Description: Ribonucleotide reductase, barrel domain
  misc_feature: SWISSPROT Homolog: EC 1.17.4.1 Ribonucleoside-diphosphate reductase
MYVVKRDGRQETVHFDKITARLKKLSYGLSQDHCDPVLVAQKVCAGVYKGVTTSQLDELAAETAAAMTASHPDYASLAARIAVSNLHKNTKKSFSETIKDMYMHFNERSGLMAPLVADDIYEIIIKNAARLDSEIIYDRDFDYDYFGFKTLERSYLLKLAGKVVERPQHMLMRVSVGIHKEDIESAIKTYHLMSQRWFTHASPTLFNAGTPRPQLSSCFLICMKDDSIEGIYDTLKECAVISKSAGGIGVSVHNIRATGSYIRGTNGASNGIVPMLRVFNDTARYVDQGGGKRKGAFAVYLEPWHADIFEFLDLRKNHGKEEHRARDLFYALWVPDLFMQRVQNNGEWSLFCPNEAPGLADCWGDEFENLYKKYEKEGKAKKVVPAQTLWFDILKAQIETGTPYML

SEQ ID NO: 24802 - DNA, 765 bp, Panicum virgatum
  misc_feature: Ceres CLONE 1860733-R
  misc_feature: Encodes the peptide sequence at SEQ ID NO. 24803
tctgaaaaaccagataatatatgaagatggttctgtccaaaagatgacagaaatccaagatgatcttaaagcaatctacaagactgtctgggagatcaagcagaaaactttggttgacatggcggttgatcgtggatgctatattgaccagagccagagcctcaatgtccatatggagcaacccaactttgggaagctaacatcgctgcacttccatgcttggtccaagggcctgaaaactgggatgtactatctacgcacaagagcagctgcagatgcgatcaagtttacagttgataccacacttctgaaggagaacggggtggctaatggcaagcctacagaggaagacgtggaagccaagatggcacaaatggtctgttctctgaacaaccgtgaagagtgcctggcgtgcggaagctagacggatccgtgctttctttcttcatgaccccaatattatacaaccggctgatgattggagttcaataaccagaaggaagtctgtgatgtaggttgagttatagattcccatgctgggaatgccttggtccccgaatgctgctacctcccgcttgtgttgtactgaaatatttgggctgatgcccatcccatgtatatatatctactactgtcaatgttattgatgtgtgcaatcacattttcttgtgaaatatttgcaactctctttgcatcagtgacagcgacagaataattaggctagactggaactggataatattaacaaggtttttactccttggt

SEQ ID NO: 24803 - protein, 140 aa, Panicum virgatum
  misc_feature: Ceres CLONE 1860733-R
  misc_feature: SWISSPROT Homolog: EC 1.17.4.1 Ribonucleoside-diphosphate reductase
LKNQIIYEDGSVQKMTEIQDDLKAIYKTVWEIKQKTLVDMAVDRGCYIDQSQSLNVHMEQPNFGKLTSLHFHAWSKGLKTGMYYLRTRAAADAIKFTVDTTLLKENGVANGKPTEEDVEAKMAQMVCSLNNREECLACGS

SEQ ID NO: 24804 - DNA, 338 bp, Panicum virgatum
  misc_feature: Ceres CLONE 1860738
  misc_feature: Encodes the peptide sequence at SEQ ID NO. 24805
ctccaccacacgccgaggcttgctcttcttcttcttgttgttgttgttgttgatagaaaaataccaattcaggggcagccggggcccgagatcggcgaggccggccgtgcttgctgctctcgccattgccacatcgtccatctgctaccgcacaggtactgaggtagtagcaatggacacccgggacatcgccccctcctccacgccgctcccctactcctactcgcagctgccggtcgccgacgccgccaccaccgacgtctggggcgccccggcccgcaggaggtccctccgcgacgccgcgcttaagaaggacgacacgctgatgctcatctccg

SEQ ID NO: 24805 - protein, 55 aa, Panicum virgatum
  misc_feature: Ceres CLONE 1860738
  misc_feature: Useful for making plants with altered carbohydrate content
MDTRDIAPSSTPLPYSYSQLPVADAATTDVWGAPARRRSLRDAALKKDDTLMLIS

SEQ ID NO: 24806 - DNA, 1392 bp, Panicum virgatum
  misc_feature: Ceres CLONE 1860743
  misc_feature: Encodes the peptide sequence at SEQ ID NO. 24807
gtcacacaagaacacgagcttgatctcacactagctagccactcgagagcgagcgaggggggggagggagagagaggcagagctcgctcgtcacgggctagcctagctagacgacacagccagcggcgcgcgccagcagggagagacgacatgccggaggcgccgggcgccatgcgagaggcggcggcgcccgaggcgcaccgcgaggcgctcgagtacatcgagcgcgtgacggcgggcgcgggccaggtgcagcgccgcgtgctggcggagatcctggcgcagaacgcgccggccgagtacctgcgccgcctgggcgtcgcgggggacgcgccgggcgccgccgaggcgttcctccgcgccgcgccgctcgtcacctacgaggacatcctccaggacgtcttgcgcatcgccaacggcgacacctcgcccatcctctccggcaagcccatccgggagttcctcaccagctccggcacgtcgggaggggagcggaagctgatgccgtcgatcgccgacgagatggaccggcgctcgctgctctacagcctgctgatgccggtcatgagccaggccgtgccggggctggacaagggcaagtgcatgtacctctacttcgtcaaggcggagtcgcgcacgccggccggcctcccggcgcgcccggtgctcaccagcttctaccggagccgccacttcctggagcgcccgcacgacccctacaccgtgtacaccagccccgacgaggccgtcctgtgcttggacgcgtaccagagtatgtacgcgcagctgctctgcggcctcgtggaccgcgccgacgtgctccgcgtcggcgccgtcttcgcgtcgggcttcctccgcgccatccgcttcctggagaagcactggcggcgcctgtgccgcgacatccgcgccggcgcgatcgacgccgagatcaccgaccgctccgtgcgcgccgccgtggagcgggtgctccgcgccgacccggcgctcgccgacgcggtggaggccgagtgcgccaggccgtcgtgggagggcatcatccggagggtgtggcccaacaccaagtacatcgatgtcatcgtcaccggcgccatggcgcagtacatccccacgctcgagttctacggcggcggcctgccgctgacgtgcaccatgtacgcctcctccgagtgctacttcggcatcaacctcaacccgatgtgcaagcccagcgaggtcgcctacaccctcatccccaccatgtgctacttcgagttcctccccgtccgctccgacgacgccgccgccgacgccgagacccaccaccgcgacctcgtggacctcgtcgacgtcaagctcggccacgagtacgagcttgtcgtcaccacctactccgggctgtatcgctatcgc

SEQ ID NO: 24807 - protein, 413 aa, Panicum virgatum
  misc_feature: Ceres CLONE 1860743
  misc_feature (19)..(413): Pfam Name: GH3 Pfam Description: GH3 auxin-responsive promoter
  misc_feature: Useful for making plants with modulated biomass
  misc_feature: Useful for making plants with modulated light quality response
  misc_feature: Useful for making plants with modulated low light sensitivity
MPEAPGAMREAAAPEAHREALEYIERVTAGAGQVQRRVLAEILAQNAPAEYLRRLGVAGDAPGAAEAFLRAAPLVTYEDILQDVLRIANGDTSPILSGKPIREFLTSSGTSGGERKLMPSIADEMDRRSLLYSLLMPVMSQAVPGLDKGKCMYLYFVKAESRTPAGLPARPVLTSFYRSRHFLERPHDPYTVYTSPDEAVLCLDAYQSMYAQLLCGLVDRADVLRVGAVFASGFLRAIRFLEKHWRRLCRDIRAGAIDAEITDRSVRAAVERVLRADPALADAVEAECARPSWEGIIRRVWPNTKYIDVIVTGAMAQYIPTLEFYGGGLPLTCTMYASSECYFGINLNPMCKPSEVAYTLIPTMCYFEFLPVRSDDAAADAETHHRDLVDLVDVKLGHEYELVVTTYSGLYRY

SEQ ID NO: 24808 - DNA, 693 bp, Panicum virgatum
  misc_feature: Ceres CLONE 1860743-R
  misc_feature: Encodes the peptide sequence at SEQ ID NO. 24809
cgcgtcgctggtggagtacacgagctacgcggacgcgcccatcatccctggccactacgtgctcttctgggagctccgcggcggcggcgcgacgccgcccgtgccggcgtcggtgttcgaggactgctgcctcgccgtcgaggaggccctgaacagcgtctaccgccagggccgcgccgccgaccgctccatcgggccgctcgagatccgggtggtctcggagggcacgttcgacaagctcatggactacgcgctcgcccgcggcgcctccatcaaccagtacaaggcgccccggtgcgtgcgcccgggccccctcgtggagctgctcgacgcccgggtgcaggcccgctacctgagccccaagtgccccaagtggagccccggcggcggcaagcaatggagcagcaacgccgccgccgtcacgaaggcggccgaaatcaatgctggaggggcggtcgtcgcctgatgatggatcggagctgctaggatttattagctgggtaagcttggaagtcgttagtgggagaatgtggccgatcgatctgagccgtgcatggcaacgagtgattatagctagctagctaatcatcgagtgcggtagcttcattattgtacgcgtcgtttgtccatggtggccttttgtttctttctcttttctgtggttttgtaataaagctgtagcaacctgtgtcc

SEQ ID NO: 24809 - protein, 154 aa, Panicum virgatum
  misc_feature: Ceres CLONE 1860743-R
  misc_feature: Useful for making plants with modulated biomass
  misc_feature: Useful for making plants with modulated light quality response
  misc_feature: Useful for making plants with modulated low light sensitivity
ASLVEYTSYADAPIIPGHYVLFWELRGGGATPPVPASVFEDCCLAVEEALNSVYRQGRAADRSIGPLEIRVVSEGTFDKLMDYALARGASINQYKAPRCVRPGPLVELLDARVQARYLSPKCPKWSPGGGKQWSSNAAAVTKAAEINAGGAVVA

SEQ ID NO: 24810 - DNA, 1864 bp, Panicum virgatum
  misc_feature: Ceres CLONE 1860771
  misc_feature: Encodes the peptide sequence at SEQ ID NO. 24811
aggtggtagagtagtaaacgcacgcagcagtaggagttggtgggcagcaccgcggcaggccagcccctcgtggtgccctgcatgtttcacagctctccacgcgtttgcttggagcattgaccggggaacgaatccagcttgccggttcttgaccccttctcctctcccatggcctgtccgcctctgcaggagctggcgttctgagcgagcgggtgcgtgtggtggccgtgggcggcggcggggatcttgggcgcgcgcgggatcctgggctctgtctggctctgaaggagccgccgtcccgccctgttcttctatcccttagttttcagatagtgcttcaatccgataccgcttctagcttgcctgaaagatttgtgaactatgaagccacccttggagaggaaccctaccaagaagcgccattcgtggtggtgggacagccacatcagccccaagaactcgaaatggcttgcagaaaatcttgaagaaatggataagcaagtgaaggaaatgctccagctgatcgaggaggacggcgactcctttgcaaagaaagcacagatgtactaccagaggcgtccaatgctcatcactcatgtcgagaatttctacaggatgtaccgcgctctagctgagcgctatgacaatgtcaccggtgaattgcgcaagaatatcccaacaaggctgcagtcgacgggatctttagccagttcagagtgtggttctgagctccagaggtcaccctcaccatctcctgagccactacagaggtcatggacaagagagcagagtcctagagctgcaggctttgatttcttcctgagtaacaagaacaacgattcgccagcatcaaggaaggagcccgaggatctggcagcgcagtcagagtctgatgcgaaatccgaagatggtgaggatgatggcattgcctacactttgcatcaaagagttctggaacttgaggacgagctcaatatgacaaaccagaaactgcgtgatgcaaatgaaaaactcgagattttggaggagaagagcttgatgtgccattgtgattataaagagaatggaaatgttgctgatcaaaaagcaattttgtccagagagcactctaatatgttggaacaaaacaagaagctagaagctgacattatcgagctcaaggaagaaatggattcagcaagaaggcaatttgaagaggaattgtctgaaagggatggagaaattagcaagttaaagcaagaccttgctgatgcttcagagaaattgctacaagagaagtgcactaatggtgcgcgaatatctgagctgcaaaaatcggctgaagacatcaggtccaaactagagagagtttctgaagagaaattactagttgagaagcaagttaaggagctggaggaagcaaatgctcaagctgaaaagtacagtcaagaactgactgaagacgctgaaaggctttcagaggagaagttcaggcatgaagttgagattctcacaatgcagcatagcattgaaaatctgaagtccagaattgagagccttgctcaagagaaatcgttgatgacaacatggttctcagacttggagcaagttgtggggcggggaaggagcattttcgttgggtaaccaagttttatcggaaacatcagtagctagaatttagcaagttagcaacattttattttttccatatatataccatcatgtgaaattaagaagccctaccatacataagtgtactaccgttgtccttgcttgaatttatacctacgacgtgatggatggtggtgatgtactagtgatacttgagatattgcactgaacttactcctcggtaataaaatgcccatagtgcacttgcaggttc

SEQ ID NO: 24811 - protein, 413 aa, Panicum virgatum
  misc_feature: Ceres CLONE 1860771
  misc_feature (15)..(88): Pfam Name: KIP1 Pfam Description: KIP1-like protein
  misc_feature: SWISSPROT Homolog: EC 2.7.11.1 Non-specific serine/threonine protein kinase
MKPPLERNPTKKRHSWWWDSHISPKNSKWLAENLEEMDKQVKEMLQLIEEDGDSFAKKAQMYYQRRPMLITHVENFYRMYRALAERYDNVTGELRKNIPTRLQSTGSLASSECGSELQRSPSPSPEPLQRSWTREQSPRAAGFDFFLSNKNNDSPASRKEPEDLAAQSESDAKSEDGEDDGIAYTLHQRVLELEDELNMTNQKLRDANEKLEILEEKSLMCHCDYKENGNVADQKAILSREHSNMLEQNKKLEADIIELKEEMDSARRQFEEELSERDGEISKLKQDLADASEKLLQEKCTNGARISELQKSAEDIRSKLERVSEEKLLVEKQVKELEEANAQAEKYSQELTEDAERLSEEKFRHEVEILTMQHSIENLKSRIESLAQEKSLMTTWFSDLEQVVGRGRSIFVG

SEQ ID NO: 24812 - DNA, 1861 bp, Panicum virgatum
  misc_feature: Ceres CLONE 1860776
  misc_feature: Encodes the peptide sequence at SEQ ID NO. 24813
aaaaaaacagctgtctcagcagctcacatccacagtccacacaaaacacaatggccaacagcaagctcctcaagactttgtaccagctcgtcgtcaacaacttcctcgccatcgtcgcggtggcgttcgccaccgccgtgctccggagaggatggccattcagcgtcgacggtctcgccgggtggctacacgcgcagcggcctgtacacctcgtcacggcggcgatcctgacggctaacgtggcgaagctctggcgcgcccggcggccgcgggacgtgtacctcgtggagtacgggtgcttccgtcccaggccgtgcttccggaccccgttcgcgacgtgccgggagcacgtgcacctcctgccgtacctgctggccgacaaggagagcctgggcttcgcgatccggctgctggaacgctcggggcttggcgaggagacgtgcgtgccctactcgtaccactacttgcccccggacagcagcctcgataccgcccgggaggagacggagctggtcatcttctcggccatcgacgacgtgttcgccaggagcgccgtcacgcccgcggagatcgacgtgatcatcgtcaactgcagcatcttcacgccgatgcccgtgttcgtggacatggtggtgaacaggtacaagctccgcgccggcgtgcagtgcctgaacctgtccgggatgggctgcggcgcggggctcgtggccatcggcctcgccaggaatctcctgcaggtggcgccgcggggcacgcacgtcctgaccgtgtccacggagatcctctcggcgcagtactacgtcggcagcgagcgcgccatgctgctgcccaactgcctcttccgcatgggcgccgccgccacgatcctgaccaactcccacgagcgcgcgcggttcaagatcgggcgcatcgtccgcaccatgaccgcggcgcgggacgccgactaccgctgcatcttccaggaggaggacgagagcggcctccggggcgtgcgcctctccaaggacctcaccgtcaccgccggcaacgcgctcaggaggaacatcgtggccttcggcccgctcgtcctgccggcctcggagcagctcctcgtcgcgctctcgctcctcaagcggaagctcctcaagcgcagcggccgcaaggtgaggctgtaccgcccggacttccgcacggcgttcgagcacttctgcatccacgccggcgggcgcgcggtgatcgacgaggtgcagcgcggcctcgacctctccgacgaggacgtggaggcgtcgcggatgacgctgcaccggttcgggaacacgtcgagcagcctggtgatgtacgagctggcgtacgccgaggccaagggccggatgaggaagggcgaccgggtgtggatgatctccttcggcgcggggttcgactgcacctgcatggccttggagtgcgtcaagccggcggccgacgcggacgggccatggatcagctgcatccaccgctacccggtgcagctcccagacgtcgccatctgatgatcagagagctgtactggagcttgatgtgccggacgacgcgtgtgcacgcgcacggtgcacagcaactgcgaagagaggtagacatgcacgtacggcacgtttcttaagctcactcgatctccgcagctagtaacctaatcaatatattaaagctggctaaaatgtaagcaccagtgtcaagttgatgtaatgcacatcgatcctatgtaaaaccgtggaagtgtcgcagttgtagctgctggtcgttgtggcaaccgggggggtttgtggttggcggctgcagcccctgtccacgaagtgaacgcgtgccaagcgacacatcggatcacaccggtacaatggagtttcct

SEQ ID NO: 24813 - protein, 485 aa, Panicum virgatum
  misc_feature: Ceres CLONE 1860776
  misc_feature (68)..(357): Pfam Name: FAE1_CUT1_RppA Pfam Description: FAE1/Type III polyketide synthase-like protein
  misc_feature (376)..(458): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
MANSKLLKTLYQLVVNNFLAIVAVAFATAVLRRGWPFSVDGLAGWLHAQRPVHLVTAAILTANVAKLWRARRPRDVYLVEYGCFRPRPCFRTPFATCREHVHLLPYLLADKESLGFAIRLLERSGLGEETCVPYSYHYLPPDSSLDTAREETELVIFSAIDDVFARSAVTPAEIDVIIVNCSIFTPMPVFVDMVVNRYKLRAGVQCLNLSGMGCGAGLVAIGLARNLLQVAPRGTHVLTVSTEILSAQYYVGSERAMLLPNCLFRMGAAATILTNSHERARFKIGRIVRTMTAARDADYRCIFQEEDESGLRGVRLSKDLTVTAGNALRRNIVAFGPLVLPASEQLLVALSLLKRKLLKRSGRKVRLYRPDFRTAFEHFCIHAGGRAVIDEVQRGLDLSDEDVEASRMTLHRFGNTSSSLVMYELAYAEAKGRMRKGDRVWMISFGAGFDCTCMALECVKPAADADGPWISCIHRYPVQLPDVAI

SEQ ID NO: 24814 - DNA, 694 bp, Panicum virgatum
  misc_feature: Ceres CLONE 1860778
  misc_feature: Encodes the peptide sequence at SEQ ID NO. 24815
atggaaaggcgatcgatctaggtcttgagcgccgccgccgcctctctcatggaaaccccaatctcctccgcgcctggagatgcgaattctcctagggctagcttcgccggcggcggccccagcgaaggcgacggatcaacggcgaatggtcggagctactacgacaagttcgggtatccggatgcagcttcccatttcgaggcaaaggatcagtacatgattcatgtgtccccaatactgcagcctgtattggccaaggacagggtcgccaagttcgagaacctctgctgcggctggtcgcactttatgggccgccgcgatttcattttcccagatgtcctcatttccatcatctcccagaacgccgtgcgctgtgccaaggtggcgctgagcggcgatctgtacaacggacgccgagctgaccccaacgcccggcaccgctacgggttcacgcccctccacgcggccgctgagactttcagcgtcgatatggtcaagctcctccttcgccatggcgcgtcggcgaacatccgcacggagggagacaatgttattgaaggtctcctccctcttcatgtcgcagtagagaatgctggcatgcataagttcctggaggaccattgggaagatgggtgccctctcgagaaactcatctctctcctctgtctgcctgagatgaagatgtacttggacc

SEQ ID NO: 24815 - protein, 215 aa, Panicum virgatum
  misc_feature: Ceres CLONE 1860778
  misc_feature (132)..(164): Pfam Name: Ank Pfam Description: Ankyrin repeat
  misc_feature: SWISSPROT Homolog: EC 2.4.2.30 NAD(+) ADP-ribosyltransferase
METPISSAPGDANSPRASFAGGGPSEGDGSTANGRSYYDKFGYPDAASHFEAKDQYMIHVSPILQPVLAKDRVAKFENLCCGWSHFMGRRDFIFPDVLISIISQNAVRCAKVALSGDLYNGRRADPNARHRYGFTPLHAAAETFSVDMVKLLLRHGASANIRTEGDNVIEGLLPLHVAVENAGMHKFLEDHWEDGCPLEKLISLLCLPEMKMYLD

SEQ ID NO: 24816 - DNA, 327 bp, Panicum virgatum
  misc_feature: Ceres CLONE 1860791
  misc_feature: Encodes the peptide sequence at SEQ ID NO. 24817
aggatggccaggtggtggtgctctgcctttctcgctgtcactgccgtggttggtgccggtgtgctcagccttccctacgccatgtctgagcttggctggggtgctggcttaccagtgctagtcagatctgggatcttcacgctgtacacgctttggcagatggtggagatgcgcaaaatggtggcaggccaccggttcgatcggtaccatgagcttggtcagcatgcattctgcgagtagctggggctctggattgttgtgcctctccagctcatcgtcgatgtgggcgtcgacatcgtggacatggtcactggacgccaatccctg

SEQ ID NO: 24817 - protein, 78 aa, Panicum virgatum
  misc_feature: Ceres CLONE 1860791
  misc_feature: Useful for making plants with altered oil content
MARWWCSAFLAVTAVVGAGVLSLPYAMSELGWGAGLPVLVRSGIFTLYTLWQMVEMRKMVAGHRFDRYHELGQHAFCE

SEQ ID NO: 24818 - DNA, 686 bp, Panicum virgatum
  misc_feature: Ceres CLONE 1860793
  misc_feature: Encodes the peptide sequence at SEQ ID NO. 24819
acaatccgtgccgcgcggtctcccatagccgcggctccgccccggcccagctcccgccgcgccgctcgctcccgtcccaggtgcgtgtcgcgcggatccgtgctccttccctgctggatgcgtgctggtggcttgtggcggattcgcgctattggagcggggattgggttcgagagaggtggggacgaggggcgtctagctgggaagaggtgctttagcttgcattttagcggaattcgggcgggattaggtggaaaagccacgggctttcgctgtgatttgggctcgggtatagcgggatttgggcgtggagaggtggttcatgtcaaattttttgcgggctagccttagctgcatccggcggaagcgacataatgtgccaggctcatcatttggttcgtctagactgtcattacttggcatcttgcttgtactattgttggaggaagttttgatgtttcagcgcaattgcatttactgtgattgacctttagtagatgtcgttccgcagcattgtgcgtgatgttagggatggttttgggagcttgtctcgaagagggttcgaggtgaagcttctgggccaccgcagagggaaatctcatggtgctgtccacgagttgcatgatccagccccggtgatccagagcagttgctgggctaatttgccccctgaattgcttcgagat

SEQ ID NO: 24819 - protein, 62 aa, Panicum virgatum
  misc_feature: Ceres CLONE 1860793
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSRRGFEVKLLGHRRGKSHGAVHELHDPAPVIQSSCWANLPPELLR

SEQ ID NO: 24820 - DNA, 1311 bp, Panicum virgatum
  misc_feature: Ceres CLONE 1860806
  misc_feature: Encodes the peptide sequence at SEQ ID NO. 24821
aatcttcacttctcagttctcactagctagtaacgccgtttcgtccgtctgtcgtctccatctccttcctcgcgttctcattgcatttgcacttgtgcgcgaagcttgcattgcacggagatcggcgttggagctgggcgagctcaaaagaaggggagccccaggaatcgagagagcctctctgcgtgtgtcactcactcactgtgctcggcttgctattttgggacagacacaggcgcgcgggagccgggttctcgggccggccgtcgatggcgccgtggagcggcttctggggcggcagggccgtcctcgccggcggcgacgcctaccgcggcggcacgccggtcgtcgtcaggatggacaaccccaactggtccatctccgagatcgacggcgacggcgacgaggagggcgccggcttcttgcccggcgccggcggccggaggcgccggaggaggggcaagaacgccaagcagatcacatgggtgctgctcctcaaggcgcaccgcgccgcgggctgcctggcgtcggtcgcctccgcggccgtcgcgctcgggggtgccgcgcgccgccgcgtcgcggccggccgcacggacgccgacgccgaggacgaggacgaggcgcccgcgccgccgcggcgttcccgccggttctacgccttcatccgggcgttgctcctgctgtccgtgttcctcctcggcgtcgagctcgccgcccacgccaacggccggcgcctcgccgcgcccgccgccgtgtccttcgccgcgctccacgcggcgtgggtgcgcttccgcgccgcctacgtcgccccgccgctccagctcctcgccgacgcctgcgtcgtgctcttcctcgtgcagagcgccgaccgactcgcccagagcctcggctgcttctacatccacctcaagcgcctcaagcccacgcccgtctcgccggcattgcccgacgccgaggaccccgacgccggctactaccccatggtgctcgcccagataccaatgtgcaacgagaaggaggtgtaccaacagtcaattgcggcggtctgcaatttggattggccaagatccaatttcctggtgcaggtactggacgactccgatgacccgatcacacaggcattgatcagagaggaggtggagaagtggcagcaccatggtgcgcgcattgtgtaccgccaccgtgtgctcagggaagggtataaggccggtaacctcaagtcggcgatgagctgcagctatgtcaaggactatgagtatgtggcgatcttcgatgccgatttccagccttaccctgacttcttgaagcgca

SEQ ID NO: 24821 - protein, 347 aa, Panicum virgatum
  misc_feature: Ceres CLONE 1860806
  misc_feature: SWISSPROT Homolog: EC 2.4.1.12 Cellulose synthase (UDP-forming)
  misc_feature: Useful for making plants with altered carbohydrate content
  misc_feature: Useful for making plants with altered cell wall content and/or composition
MAPWSGFWGGRAVLAGGDAYRGGTPVVVRMDNPNWSISEIDGDGDEEGAGFLPGAGGRRRRRRGKNAKQITWVLLLKAHRAAGCLASVASAAVALGGAARRRVAAGRTDADAEDEDEAPAPPRRSRRFYAFIRALLLLSVFLLGVELAAHANGRRLAAPAAVSFAALHAAWVRFRAAYVAPPLQLLADACVVLFLVQSADRLAQSLGCFYIHLKRLKPTPVSPALPDAEDPDAGYYPMVLAQIPMCNEKEVYQQSIAAVCNLDWPRSNFLVQVLDDSDDPITQALIREEVEKWQHHGARIVYRHRVLREGYKAGNLKSAMSCSYVKDYEYVAIFDADFQPYPDFLKR

SEQ ID NO: 24822 - DNA, 667 bp, Panicum virgatum
  misc_feature: Ceres CLONE 1860806-R
  misc_feature: Encodes the peptide sequence at SEQ ID NO. 24823
ctccccctttcgtcatcccctacctcctcttcgagaacaccatgtccgtgaccaagttcaacgccatggtctccggcctgttccagctcggcagcgcctacgagtgggtggtgaccaagaagtccggccggtcctcggagggcgacctcgtcgtgctggcgcccaacaaagagcaccggaagcagcagcgctctgcgacgccggtcgccgccgaagcgaagaaaccgccggctccggtggaggagaagaagaagcagcagaagtacaaccggatatacaagaaggagctggcgctgtcgctgctgctgctgactgccgccgcccggagcctgctgtccaagcaggggatgcacttctacttcctgctgttccagggcgtctcgttcctgatggtcggcctcgacctcatcggcgaggacgtgaaataaaactgtttggtggtgacatggatggatggttggatgtagctgtagctttgttcagggttaggattagtcctctgaattacattctcgtaggatctgtagatatagctctccgtctccgatctcttcttggcttgtaaattctggtagctgctcaggggttagcatcttactcgattcttttgtacgaaggatgaagctgctgatgctcagtttaggttacagcatggaggttgtttgct

SEQ ID NO: 24823 - protein, 141 aa, Panicum virgatum
  misc_feature: Ceres CLONE 1860806-R
  misc_feature: Useful for making plants with altered carbohydrate content
  misc_feature: Useful for making plants with altered cell wall content and/or composition
PPFVIPYLLFENTMSVTKFNAMVSGLFQLGSAYEWVVTKKSGRSSEGDLVVLAPNKEHRKQQRSATPVAAEAKKPPAPVEEKKKQQKYNRIYKKELALSLLLLTAAARSLLSKQGMHFYFLLFQGVSFLMVGLDLIGEDVK

SEQ ID NO: 24824 - DNA, 1431 bp, Panicum virgatum
  misc_feature: Ceres CLONE 1860818
  misc_feature: Encodes the peptide sequence at SEQ ID NO. 24825
gttctttccactcctcgcaatttttttttcttctgtgcgccgcccatcgttcccgacgccgacgccaaccctccctcgccgccggcgacgggagtcgcccttccgtcgagcccctactctcgcgcctgggcccaggggtggagggaaaatccgtgactggcttcctctgctgttggtgagtaaaccctagcttgctttgcttggctgtgttattctattgagtttgtcccgtggcaaggtcgaagtgaacctgttcgcatcgaacccaatccgcccagcctcttcctcgctcacttgccgcccgcgagctcgctggcgcccaagcctcgtcggagcacctggagccgatcaagctctcccgcgccacccccgcgaccaggacgtcggagcagccggaggcgtccaaggtcgcctgccgcctgcgccgctgttcccgctgagctgctccgattcaattaataaagaagggcgaaagactacgctagctcttgctgctgctggaacagcttaccccaggatcatggcgagccttgctgattcttttctagcggatcttgatgaactgtcagacaatgaaggctatcctgaagaagacaatgctgaggcagctggtatggaggatgatggtgatgatgatatgcctgaccttgagtcccttaattacgatgatctggatagtgtctcaaagttgcagaagacacaacgctataatgacataatgcaaaaagttgaagatgcacttcagaaaggcactgacttctccaatcaaggttccatcctggaggaggatccagagtaccagcttatcgttgattgcaatgctttatcagtagatattgagaatgagatcatcataatccataatttcatacgtgacaaatataggttgaagtttcctgaactggaatccctcgttcatcatccgatcgattatgcccgtgttgtcaaaaagattggaaatgagatggatttaacacttgtagatctggaagggcttttaccttctgcaattataatggttgtctccgtgacagcatcaacaacaagtgggaaacctctttctgaggaaaatttggaaaaaaccattgatgcttgtgacagagcccttacgctcgatgctgcaaaaaagaaagtgcttaattttgtagagaacagaatgggttatattgcaccaaacctttctgccattgttggcagtgcggttgcctcaaaactgatgggtactgctggtggtctgggagcacttgcaaaaatgcctgcttgtaatgttcagttacttggtgcaaagaggaaaaatcttgctggattttctactgccacatctcaatttcgagttggctatcttgaacaaactgaggtatttcagagcacacctccagctctgaggactagggcttgcagacttattgctgcgaagtcaactctagcagc

SEQ ID NO: 24825 - protein, 303 aa, Panicum virgatum
  misc_feature: Ceres CLONE 1860818
  misc_feature (187)..(303): Pfam Name: Nop Pfam Description: Putative snoRNA binding domain
  misc_feature (95)..(147): Pfam Name: NOSIC Pfam Description: NOSIC (NUC001) domain
MASLADSFLADLDELSDNEGYPEEDNAEAAGMEDDGDDDMPDLESLNYDDLDSVSKLQKTQRYNDIMQKVEDALQKGTDFSNQGSILEEDPEYQLIVDCNALSVDIENEIIIIHNFIRDKYRLKFPELESLVHHPIDYARVVKKIGNEMDLTLVDLEGLLPSAIIMVVSVTASTTSGKPLSEENLEKTIDACDRALTLDAAKKKVLNFVENRMGYIAPNLSAIVGSAVASKLMGTAGGLGALAKMPACNVQLLGAKRKNLAGFSTATSQFRVGYLEQTEVFQSTPPALRTRACRLIAAKSTLA

SEQ ID NO: 24826 - DNA, 625 bp, Panicum virgatum
  misc_feature: Ceres CLONE 1860818-R
ccagcaaagcttccaaagccacttcctgttccggactctgaacctaaaaagaagagagggggtcgtcggcttcgtaaaatgaaagaaaggtatgcgcaaactgatatgatgaagcttgcaaaccggatgcaatttgggattccagaggagagctcattaggtgatggcttgggggaaggttatggcatgctcggacaggcaggaagtggcaagctgcgtgtgtcagctggacaaagcaaacttgctgctaaagtggccaagaaattcaaggagaagagctatggtagcagtggtgcaacttcaggattgacatctagtttggcatttacaccagttcagggaatagagttgtcaaatccacaggcccaagggaacccgcttggaggtggaactcaaagtacctacttttctgagactggcagattttcgaagatcaggaggacccaatagaagctgatttccccgttgcaaccatctcatctcatctcatcagcactgaagttgttgaaattcttgggatgcattgttgaaaatccaaagatccagcatgtgaatgttcccagtcttgtttttttaactgaagcaaattccagagattttatgaaacacggttctgttttgcttc

SEQ ID NO: 24827 - DNA, 316 bp, Panicum virgatum
  misc_feature: Ceres CLONE 1860838
  misc_feature: Encodes the peptide sequence at SEQ ID NO. 24828
tctcttccagcgccccccactcccctcagcatcccagtacaccgcggcgggtgatggggatcgatgtgaacgtcggcggcggcggcccggaccgcccggcggccggatgtgcatgcgtatatattattggggcgccgccgttctatgtgccggaggtcaagttcaccttgctcttcctctacggctgcttcgtcgacgccgtctcgggccggacgttctataccacggatccgcgctcggtggacgttattgcttttgtttccctccgtgacatgcaagacctcgacttggccgtgacggcggcgagggaggcctt

SEQ ID NO: 24828 - protein, 87 aa, Panicum virgatum
  misc_feature: Ceres CLONE 1860838
  misc_feature: SWISSPROT Homolog: EC 1.2.1.3 Aldehyde dehydrogenase (NAD(+))
  misc_feature: Useful for making plants with altered carbohydrate content
MGIDVNVGGGGPDRPAAGCACVYIIGAPPFYVPEVKFTLLFLYGCFVDAVSGRTFYTTDPRSVDVIAFVSLRDMQDLDLAVTAAREA

SEQ ID NO: 24829 - DNA, 627 bp, Panicum virgatum
  misc_feature: Ceres CLONE 1860845
  misc_feature: Encodes the peptide sequence at SEQ ID NO. 24830
attcccgttcttgcctagaagaaaaatcggcgagggcacccggcaccaccgagatcgagctccagagaggaaggccagccagccaagccaagccatggatgcttcggtcctcaacaacccgcgcctcaaggcgctcatagaggaggagagaacgaaggccttgacaaacgagctcgtggcaaagctgactcatgtttgctgggacaaatgcgttactgggagcatcggaagcagcttcagcaggagtgaggcttcgtgcttgtccaactgcgcaaaacgcttcgcagaagtgaagatgatgaccatgcaacgcttcaccgagcgctagctgaagtcacatcggcgtttctctacagctaaaattcttgtaccctctggaccatccaaacagagtacatgtgttatgctgtagcacgagttctgctatatttttgctggcgcactattgttagtgaaattgatagaaaggcatgcccaatgtgtcatgttctgttagtacttctctatgctttaacctggagtgaagcagaggccaaaaaatgctcctacatgcgttctaaggtgacgtgatgttggattaaaatgatcatgagctgatgtgcaacaaggcctacaaatttaccaccc

SEQ ID NO: 24830 - protein, 77 aa, Panicum virgatum
  misc_feature: Ceres CLONE 1860845
  misc_feature (12)..(77): Pfam Name: zf-Tim10_DDP Pfam Description: Tim10/DDP family zinc finger
MDASVLNNPRLKALIEEERTKALTNELVAKLTHVCWDKCVTGSIGSSFSRSEASCLSNCAKRFAEVKMMTMQRFTER

SEQ ID NO: 24831 - DNA, 626 bp, Panicum virgatum
  misc_feature: Ceres CLONE 1860850
  misc_feature: Encodes the peptide sequence at SEQ ID NO. 24832
gacagccgcagaatcagtgccaccgccaccgccaccagcggacatgggctcctccgcgtccctgcttcgcttcctcccgccgtccgcgcacgcggcgtcctcgacctcgtcccgccggcgccccggccgcgccagggcggtcgtctccgtgccgtcgcccgcgccggcggcgggcgaggtccccgcggagcggctggagccgagggtcgaggaccgggcgggagggttctgggtgctcaaagagaaataccgcacggagctgaacccgcacgagaaggtgaagctggagaaggagaccatggggctgtacatggaggacggcatccaggacctctccaagatccccaagtaggagatcgactccgccaagctcaccaaggacaacgtctacgtccacctcaagtggctcggcctcttccaccgccgccagcatcattaagggcggttcatgatgcggctgaagctgcccaacgaagtgactacgaacgatcacatgctgtacctggctagcgtgatctacgcgtacggctagtacggttgcgcggacgtgacgacccagcataactgtgagatccgcgttgtaacgctctcggacgtgcccgccatcctggagggactccacgccg

SEQ ID NO: 24832 - protein, 102 aa, Panicum virgatum
  misc_feature: Ceres CLONE 1860850
  misc_feature: SWISSPROT Homolog: EC 1.7.7.1 Ferredoxin--nitrite reductase
MGSSASLLRFLPPSAHAASSTSSRRRPGRARAVVSVPSPAPAAGEVPAERLEPRVEDRAGGFWVLKEKYRTELNPHEKVKLEKETMGLYMEDGIQDLSKIPK

SEQ ID NO: 24833 - DNA, 2319 bp, Panicum virgatum
  misc_feature: Ceres CLONE 1860872
  misc_feature: Encodes the peptide sequence at SEQ ID NO. 24834
gccactgccactataaagtggcaggcaatctctgctactgagcacggctccgatccacttcaccgatctgagatccactcctcttcatcttgctgcgtgagcgaccgagctctcgctcgccggaggatccatcgagagggagcggcaatggcggccatgctgctgcacggcaccctggaggcgaccatcttcgaggccaagttcaacatcccgggcagcaagttcctggacgcgctcctcccgcgcgtcgagggcctccccacgggccgcccgcagctctacgccacggtggacctcgccggggcgcgcgtcggccgcacccgcgtcgtcgtcgacggcgacccggggaacccgcgctgggacgagcccttccacatctactgcgcccacgtcaccgccgacgtcatcttctccgtcaaggcgcggctgcccgtcgacgccgcgctcgtcggccgcgcctacgtgcccgtgcaggacctcgcgggacccaaagagggccggctcgtcgaccggtggctggacatcctcggcgaggggcggaggccgctgcccaacgggcccaagctccacgtccaggtgcggttcaccggcgccgccgccgacccccggtggggctccggcgtcggcggcggcgcggtgcagttccccggcgtgccccggaccttcttcaagcagcggcaggggtgccgggtcaccctgtaccaggacgcgcacgtcccggacgcgttccggccgccggcgatcgaggtcgccggcggcgtccgcgcctacgagccgcgccgccggtgctgggaggacctctacgacgccatcagcggcgcgcggcacctcgtgtacgtcaccggctggtcggtgtccccccacatcacgctggcgcgcgacgccggccggccgcaccccggcggcggcgtcaccctcggcgagctcctcaagcgcaaggccggcgagggcgtgcgcgtgctcatgctggtgtgggacgaccccacctccgttctcaacctcggcgtcatccccggccagatgggcaccaacgacgccgacaccttcagctacttccgcggcagccgcgtgcagtgcgtgccgtgcccgcgcagccccgacgacgcagccagcttcgcgcagggcctcaagacgctcgccttcagccaccaccagaagtctgtcgtcgtcgacgtcgccggcgacggcgggcgccgccgcgtcgcctgcttcgtcggcgggctcgacctcaccaacgggcgctacgacacgccagagcactcgctgttccggacgctcaacaccgcgcacagcgacgacttctaccaggggaacatccccggcgccgccatcggctccggcgggccgcgggagccctggcacgacatccactgccggatcgacggccccgccgcctgggacgtgctccacaacttcgagcagcggtggaggaagcagggcggccgggacgacctcgtccacagcctgctgtcgccgtggaagaagaacgaggacgtcctcgtcgacctccggggcatggaggacgccgtcgcgccgcagacatctccggcggcgcccgccggcgacgaggaggcctggaatgtgcaggtcttccggtccatcgacagcagcgcctgcgccgggttccccaagaccccggcggaggcggcggcgtcggggctcgtcagcggcaaggaccacatcatcgagcggagcatccaggacgcgtacatccacgccatccgccgcgccaggcgcttcgtctacatcgagaaccagtactttctcgggagctccttcgggtggaggctgcccgacggcgagacgccggagaacatcggcgcgctgcacctgatcccccgggagctctcgctcaaggtcgtgagcaagatcgaggccggcgagcgcttcgccgtctacgtcgtgctcccgatgtggccggagggggacccctccggctggaccgtgcaggccatcctccactggcagaggaagacgatggagatgatgtacgccgacatcgccgccgcgctcagggccaagagcatcgacgccgaccccaaggattacctctccttcttctgcctgggcaacagggaggccaagctggaggtcccccgcgagtacgagcccaaaggccacccgccacgtggcagcgactacgagcgggcccagaaggcgcggcgcgccatggtctacgtccactccaagctcatgatagtggacgatgagtacatcatcattggatcggccaacatcaaccagcggtcgatggacggagggcgggacacggagatcgccatgggggcgtaccagccgccccacctcaacgccggcgac

SEQ ID NO: 24834 - protein, 723 aa, Panicum virgatum
  misc_feature: Ceres CLONE 1860872
  misc_feature (674)..(701): Pfam Name: PLDc Pfam Description: Phospholipase D Active site motif
  misc_feature (330)..(365): Pfam Name: PLDc Pfam Description: Phospholipase D Active site motif
  misc_feature (10)..(105): Pfam Name: C2 Pfam Description: C2 domain
  misc_feature: SWISSPROT Homolog: EC 3.1.4.4 Phospholipase D
MAAMLLHGTLEATIFEAKFNIPGSKFLDALLPRVEGLPTGRPQLYATVDLAGARVGRTRVVVDGDPGNPRWDEPFHIYCAHVTADVIFSVKARLPVDAALVGRAYVPVQDLAGPKEGRLVDRWLDILGEGRRPLPNGPKLHVQVRFTGAAADPRWGSGVGGGAVQFPGVPRTFFKQRQGCRVTLYQDAHVPDAFRPPAIEVAGGVRAYEPRRRCWEDLYDAISGARHLVYVTGWSVSPHITLARDAGRPHPGGGVTLGELLKRKAGEGVRVLMLVWDDPTSVLNLGVIPGQMGTNDADTFSYFRGSRVQCVPCPRSPDDAASFAQGLKTLAFSHHQKSVVVDVAGDGGRRRVACFVGGLDLTNGRYDTPEHSLFRTLNTAHSDDFYQGNIPGAAIGSGGPREPWHDIHCRIDGPAAWDVLHNFEQRWRKQGGRDDLVHSLLSPWKKNEDVLVDLRGMEDAVAPQTSPAAPAGDEEAWNVQVFRSIDSSACAGFPKTPAEAAASGLVSGKDHIIERSIQDAYIHAIRRARRFVYIENQYFLGSSFGWRLPDGETPENIGALHLIPRELSLKVVSKIEAGERFAVYVVLPMWPEGDPSGWTVQAILHWQRKTMEMMYADIAAALRAKSIDADPKDYLSFFCLGNREAKLEVPREYEPKGHPPRGSDYERAQKARRAMVYVHSKLMIVDDEYIIIGSANINQRSMDGGRDTEIAMGAYQPPHLNAG

SEQ ID NO: 24835 - DNA, 3143 bp, Panicum virgatum
  misc_feature: Ceres CLONE 1860892
  misc_feature: Encodes the peptide sequence at SEQ ID NO. 24836
aacctcaactcgacggcaatggcttgttgattgagaagttgcgccgccgcagccgcttcctcttcttcatcttcttcttcttataaatatatacacatatatataaaagcgagggagggagcgaggagcaggacgacgagggaaggagagaagagactgcaagatttcgcccgcctctcgcagtcgtcccccttgcaagttccaaccccccacagcatctggaggccctcgttagggtttccacccgcacccgcaccggaggtacccctccaatgctgctgtgatggaccatcctttcaacccgccaggtcctgccgtgccccctgcctccaagcccaggcagatggctgcaagtaacaacccttggaggatccttcaaccaccgctgctcaatgcacgcgctggcttgggcgatgcaagcctcttctcaacctcgctgccgcttcttcctcacgagaaattgaactttcctgattctgcacatggtaccccgtcaatggatgacacttctgccaaaatgaaagtgcttgatgatgacccagaagagaaggactacaagtttgattttgatcttcgccagatagatgacttgctgcctgacgaagatgagtttttcgctgggatcacagatgagatcgaaccagttgggaagacaaataacacggaggagttggaagagtttgatgtatttggcagcggagggggcatggagctggacttggatcctctggagagtgtcacggctagttttgcgaattcaagtattgctgatggggctagaggcaatgggatcagcccttatggtgtcccaagcgctgtcgggactgtggctggggagcatccgtatggagaacacccttccagaacattgtttgtaaggaacatcaatagcaatgttgaagactctgaactgcgctctctttttgagcaatatggggatatcagaaccctctacactgcaacaaagcacaggggttttgtaatgatatcttattttgatatccggtcggcacgcaatgcaatgcgtgcgttgcagaacaagcctctgaggaggagaaagctggacatccatttttccatcccaaaggagaatccatctgacaaagatttaaaccaaggaactcttgttatatttaacttggacccgtcagtttctaatgaagaggttcgccagattttcggggtatatggtgaagtaaaagagataagagagacaccaaacaaaaagcatcataagtttatagagttctatgatgtaagagcagcagaggctgctcttcgatcacttaataaaagtgagatagctggaaaaagaatcaagttggaaccaagtcgtcctggtggaacacgtagaaacttgatgcagcagcttggtcatgatttggaccaagaggagcccagaagctatagacatcctcatgttggttcacctattgctaactctcctccaggggtatgggctcactatagtagtccaacagataacaacatgttgcaggctttcaacaggtctccaaccggaaatggaatgagtccaatcggaatgccttcgctaatgtcaaatgctgtgaagattgcacctattgggaaggatagcaatcggtctaaatatgatcaaatattctcaaatggcaaccagtccctgggaactgcatttcagcactcccactcataccaggatcgcaacagtgaacatttgaattctagtcctgggactttatctgggccccaatttctctggggtagtccgaagccctattcagaaacctctcaatcccctgtttggcgtccaccagcaattgggtctgcattgtcatctaatagccgctctcaggggctaggcttcttgcacagcagccgtcaggcttcgttatttgggtcttcagatcagcaccaccaccatcatcatgttggttctgccccttcaggtgctccatttgagagccattttggcttcttacctgaatcgccagagacatcttttatgaagcaagtcaggtttgggaacatgggaaatattggtactggcagaaacggggcaggcctcatgctgaacttggctggccgtgcttctttgagttctgtttcttctctgagtggaagtctgacagataatagttctagtaacttcagaccgatgctgtcaccaagattgggacatgcattctacagtaaccccacataccaaggtcctggctctttcggacttgacagctcaattgatcgtgcccgtaaccgccgagttgacagcagtgcgctccaagccgatagcaagaggcagtaccagcttgatttggagaagattagcaaaggcgatgatactaggacgacattgatgattaaaaacattcccaacaaatatacatctaagatgcttttggctgcgattgatgaacttcacaaagggacttatgacttcttctatctgcctattgattttaagaacaaatgcaatgttggatatgcattcattaacatgatatcaccaacacacattatatcattctatcaggcatttaatgggaagaaatgggagaagttcaacagtgagaaagtagcctccttggcttatgctagaatccaaggacggactgcgctgatatcacattttcagaattcaagcttgatgaatgaggataagaggtgccggcccattctttttcatcccaatggtctggaatctggaaatcaggaagcatttcctatcaatggcatatgcatccacatgcctgtggaagatgggacaggtgattcacttgacgatgaagatgacgtgaagacaggagagagctccatgcatatggccgggagcttgtgatgataaccaaaaaaaatctaactgtctagagtgaaggtatcgacccccaaattgtataaagaaagaggtggattttgtgccgtggtgtggcatgggatatctagtggtttttgtggcaactgatgtcgccccccagaagctgaaagtctggaagcgagcttgaagttggagctgggagcttgctaatgattaggcccgcccgcacccctgtgtacagatagatgtgattggatccatgcttgctcgcttgcttttggttgtcgtgctgtaaggagacatttggacaaactgtacagtgaaaactttgtgttgatcgattctgatt

SEQ ID NO: 24836 - protein, 824 aa, Panicum virgatum
  misc_feature: Ceres CLONE 1860892
  misc_feature (661)..(757): Pfam Name: RRM_2 Pfam Description: RNA recognition motif 2
  misc_feature (176)..(242): Pfam Name: RRM_1 Pfam Description: RNA recognition motif. (a.k.a. RRM, RBD, or RNP domain)
  misc_feature (261)..(327): Pfam Name: RRM_1 Pfam Description: RNA recognition motif. (a.k.a. RRM, RBD, or RNP domain)
MAASNNPWRILQPPLLNARAGLGDASLFSTSLPLLPHEKLNFPDSAHGTPSMDDTSAKMKVLDDDPEEKDYKFDFDLRQIDDLLPDEDEFFAGITDEIEPVGKTNNTEELEEFDVFGSGGGMELDLDPLESVTASFANSSIADGARGNGISPYGVPSAVGTVAGEHPYGEHPSRTLFVRNINSNVEDSELRSLFEQYGDIRTLYTATKHRGFVMISYFDIRSARNAMRALQNKPLRRRKLDIHFSIPKENPSDKDLNQGTLVIFNLDPSVSNEEVRQIFGVYGEVKEIRETPNKKHHKFIEFYDVRAAEAALRSLNKSEIAGKRIKLEPSRPGGTRRNLMQQLGHDLDQEEPRSYRHPHVGSPIANSPPGVWAHYSSPTDNNMLQAFNRSPTGNGMSPIGMPSLMSNAVKIAPIGKDSNRSKYDQIFSNGNQSLGTAFQHSHSYQDRNSEHLNSSPGTLSGPQFLWGSPKPYSETSQSPVWRPPAIGSALSSNSRSQGLGFLHSSRQASLFGSSDQHHHHHHVGSAPSGAPFESHFGFLPESPETSFMKQVRFGNMGNIGTGRNGAGLMLNLAGRASLSSVSSLSGSLTDNSSSNFRPMLSPRLGHAFYSNPTYQGPGSFGLDSSIDRARNRRVDSSALQADSKRQYQLDLEKISKGDDTRTTLMIKNIPNKYTSKMLLAAIDELHKGTYDFFYLPIDFKNKCNVGYAFINMISPTHIISFYQAFNGKKWEKFNSEKVASLAYARIQGRTALISHFQNSSLMNEDKRCRPILFHPNGLESGNQEAFPINGICIHMPVEDGTGDSLDDEDDVKTGESSMHMAGSL

SEQ ID NO: 24837 - DNA, 526 bp, Panicum virgatum
  misc_feature: Ceres CLONE 1860936
  misc_feature: Encodes the peptide sequence at SEQ ID NO. 24838
tgcctcctgctggcgtggtctagccgcctggagcttgcgctccgttcgttgaggctcttgtcaatctagcgatggagccccggcgctccgtgctggtccggggcctcgccggcatgctctcggtcgcgatggcttaccaccccctggatccgaacgggaacgttaccgtccaatgggacatcatgtcgtggacgcccgacggttatgtcgcggtgctgaccatcaacaacttccagatgtgccagcacatcatggctccgggctggacggtgggctggacgtgggcaaagaaggaggtgatctggtccttggtaggcccgcaagtcacggagcaaggcgactgctcccgcttcaagggcaacatccctcactgctgcaaccgcacccccgccgtcctcgacctgctgcccggcgtgcactacaaccagcatatcgccaactgctgccggggccgcgtcatcacctcctacggtcagaagcccggccccgccgtccccgccttccatgtcatcgtcggccaagacgg

SEQ ID NO: 24838 - protein, 151 aa, Panicum virgatum
  misc_feature: Ceres CLONE 1860936
  misc_feature (45)..(146): Pfam Name: Phytochel_synth Pfam Description: Phytochelatin synthetase-like conserved region
  misc_feature: Useful for making plants with altered carbohydrate content
  misc_feature: Useful for making plants with altered cell wall content and/or composition
  misc_feature: Useful for making plants with altered lignin content
  misc_feature: The sequence is a functional homolog of SEQ ID NO 4 in US patent 7109001
MEPRRSVLVRGLAGMLSVAMAYHPLDPNGNVTVQWDIMSWTPDGYVAVLTINNFQMCQHIMAPGWTVGWTWAKKEVIWSLVGPQVTEQGDCSRFKGNIPHCCNRTPAVLDLLPGVHYNQHIANCCRGRVITSYGQKPGPAVPAFHVIVGQD

SEQ ID NO: 24839 - DNA, 640 bp, Panicum virgatum
  misc_feature: Ceres CLONE 1860949
  misc_feature: Encodes the peptide sequence at SEQ ID NO. 24840
agcatccatccgccatggcgatgcacaccatggcaacagctgctgcagctcttgctctctgtctctttgcagccgccgccacatgcgccggtgctcagccaccgccgccgctacaagcctacgacgacatctcctcctgcctcctctccaacggcgtcagcaacttctccctcccgtcgtccccgagctacacgccgctcctcgactcctccatcaggaacctccgcttcgagctccagggcgtcggcaagccggccgccgtcatcctcccgggctccgagcgcgacctccggcgcgccgtcctgtgcgcgcgccgcgccgcgctggcgatccgcgtgcgcagcggcggccacagctacgagggcctctcctacacctcggagaaccgcgtccccttcgccgtgatcgacctcgccagcctgaacagcgtccgcgtcgacccgggctccgccacggtctgggacgaggccggcgcgacgctcggcgagctctaccacgccgtgggccggtccagccggaccctcgcgctcccggccgggtcgtgcgcgacgatgggcgtgggcgggcacgtcgccggcggcgggttcgggctgctgtcaaggaagcacgggctcgccgccgacaacgtcctggacgccgt

SEQ ID NO: 24840 - protein, 208 aa, Panicum virgatum
  misc_feature: Ceres CLONE 1860949
  misc_feature (80)..(208): Pfam Name: FAD_binding_4 Pfam Description: FAD binding domain
  misc_feature: SWISSPROT Homolog: EC 1.21.3.3 Reticuline oxidase
MAMHTMATAAAALALCLFAAAATCAGAQPPPPLQAYDDISSCLLSNGVSNFSLPSSPSYTPLLDSSIRNLRFELQGVGKPAAVILPGSERDLRRAVLCARRAALAIRVRSGGHSYEGLSYTSENRVPFAVIDLASLNSVRVDPGSATVWDEAGATLGELYHAVGRSSRTLALPAGSCATMGVGGHVAGGGFGLLSRKHGLAADNVLDA

SEQ ID NO: 24841 - DNA, 2139 bp, Panicum virgatum
  misc_feature: Ceres CLONE 1860957
  misc_feature: Encodes the peptide sequence at SEQ ID NO. 24842
tcgatctcaaggctcaagcagcatggcgcgcgtccgcgaccgcccaccgccacccacggtggctcctcctctgccgccgccctgccgcttcctcttccttctcgtcctcctggcacgcgcaaccaccgccgcgcagggcgccgacaccagcggctgcggcggcgccgaccgctgcggcgacctcgtcctccccttcccgtttcatctcaactactccgcctgcgggagcgccggcgccaactcctccctcttccgcctctcctgcagcgccaacgccacgctcaccctcccgctcggctccgccgtcttccgcgtcctcgccttcctcccctcggggtcgctcctcctcgactacgcccccaggtcgccggccccgtgcgacgcggcgtacgcgcccttctcgcggccgacctctcccgcggccgcgatcgacgccgcgcccttcctcgccgtcacgccggccaacgtgctccgcctctacgcctgcgaggactcctcgctctgccgcgccggctgcgacgacgtcgcgacgtgcggcggcaagtccgggtgctgctacccgctgtcggacggcagcgtctggaagcccgggaacgggctgggcgtgttcgcggactacgggtgccgggggttctcgagctgggtcaagaaccggtcggcgccggcaggcggggttgtgagggggatcgaggtcgagtgggccgtgccgaggggcagcgccatggcgaagtgcgccgatggcgcggcgctcgtgaatgccacggcgctgcacgacggcgtacggtgcgcgtgcgcggcgggtctcgtcggggacggcttcgtacagggcacaggctgctccaaaggcacctcctgcagcaatggggggcaagcaagtgacggcaggacttgttgccagggacggttttgctccaagaaggcagttgttgttgctggatttttcgtttcgctgttcttcctcgcggcggccgtctcgttctggcttttcctgaggcagccgtccaaggacagccggtgggatctcgaccctgcgtgcatccccaaaatcctccggagcgtgtgcgacgcgaagcagttcacgtacgagcagctggaggaagcaacgaagaggttcgacagcgagaaggccgtggacaccgtcgacggcacggtgcacgccggcgtgctcgacgacggctccctggtcgcggtgcagaggatcggctacgagacgcaggcgaagctgaggctggtgctggaccggatcgagctcctgtccgagatcgcccaccccaacatcgcccgcgtcgtgggcttctgcctcgactccagcaacgctctgctgctggtgcacgagcacttcgccggcggcacgctggaggagcacctgcgccagatgaagggccgcgtcctcagctggtaccaccgggtcaacatcgccatcgagctcgccagcgcgctcacgtacctgcaggcgcacgagaccgccccgaccttcctccacgatctcaagtccagcgagatcttcctcgacgccgacttcacctccaagatcggcggctacaagctcaccaggccggcgacgtactactccgcgtcgtacgagcaggacgtcgtgtgcaacttcggccacctcctgatcgagctcctgacggggctgaggcagcagatcccgttcgactcggtcgcgcccaaggtgagggaggggaggctccacgaactcatcgacccgacgctcctgtccgggaagcagcttccggcgtcgcacgacgaggtgaggaaggtgttcgagctcgccgtccggtgcctgtccagcgccgagaacgggctgtgcatgctcgccgtcgccaaggagctgatgcacattctcagggacaacaacgggagcagcagcaagatcgagatctccctcgaggagacgttctcgagctcgagcctgctgcaggtgatctccatgtcgccggacaccctgcatcaccatcttccgtgaaggcagacgatgatccgttcttgttaatatccagagcaggtctcagtgaggcctctcccctgttgaagcagctctgctcgtctgctgtttcagaatcttgtgcatgcttttcgtgccaatgtttggttggcacagtgtaaccaatccggcgactggcaaatgtttactgc

SEQ ID NO: 24842 - protein, 648 aa, Panicum virgatum
  misc_feature: Ceres CLONE 1860957
  misc_feature (375)..(605): Pfam Name: Pkinase_Tyr Pfam Description: Protein tyrosine kinase
  misc_feature: SWISSPROT Homolog: EC 2.7.11.1 Non-specific serine/threonine protein kinase
MARVRDRPPPPTVAPPLPPPCRFLFLLVLLARATTAAQGADTSGCGGADRCGDLVLPFPFHLNYSACGSAGANSSLFRLSCSANATLTLPLGSAVFRVLAFLPSGSLLLDYAPRSPAPCDAAYAPFSRPTSPAAAIDAAPFLAVTPANVLRLYACEDSSLCRAGCDDVATCGGKSGCCYPLSDGSVWKPGNGLGVFADYGCRGFSSWVKNRSAPAGGVVRGIEVEWAVPRGSAMAKCADGAALVNATALHDGVRCACAAGLVGDGFVQGTGCSKGTSCSNGGQASDGRTCCQGRFCSKKAVVVAGFFVSLFFLAAAVSFWLFLRQPSKDSRWDLDPACIPKILRSVCDAKQFTYEQLEEATKRFDSEKAVDTVDGTVHAGVLDDGSLVAVQRIGYETQAKLRLVLDRIELLSEIAHPNIARVVGFCLDSSNALLLVHEHFAGGTLEEHLRQMKGRVLSWYHRVNIAIELASALTYLQAHETAPTFLHDLKSSEIFLDADFTSKIGGYKLTRPATYYSASYEQDVVCNFGHLLIELLTGLRQQIPFDSVAPKVREGRLHELIDPTLLSGKQLPASHDEVRKVFELAVRCLSSAENGLCMLAVAKELMHILRDNNGSSSKIEISLEETFSSSSLLQVISMSPDTLHHHLP

SEQ ID NO: 24843 - DNA, 699 bp, Panicum virgatum
  misc_feature: Ceres CLONE 1860958
  misc_feature: Encodes the peptide sequence at SEQ ID NO. 24844
atggccagcgcgggactccaccactcccccccatcttcctcgccctcccgaatcttccgccgatcccacgagaggccggcgtccagatcctctcccccgcggttcagatccccggatcgagccggcgcctcgtgaaaatccgcagcggcgacgaggtgctttccgctaaaggatggctcaattatccttcttttcttgctgattgaggctctggttagcttggatcttctgcccgctgtttttgagctggtttctttcttggtgattaagctcaaagtgtttggctagttccttcagacttagctaaagcacactgtttcaagcaataattgagttccttccttgcacgtatgagcatctgacatattatgacagatgaggagcacaggatccatcccggcattgccaatcgctgacctccgagttggtgtttctgttggcaggggttgcttggggctgtggatctgctgaggtggcgacatgggcctggatttgggagctgttctcaaacccggcactttcggggtctcggaccacgacgcgatcgtttcgatcaacatcttcattgcgctgctctgcagctgcattgtaatcgggcacctgctcgaagggaaccgatgggtgaatgagtccatcactgcgcttgttatgggtctgatcaccggaggtgtgattctgctcgctactaatgggacaaat

SEQ ID NO: 24844 - protein, 72 aa, Panicum virgatum
  misc_feature: Ceres CLONE 1860958
  misc_feature: The sequence is a functional homolog of SEQ ID NO 2 in US patent 7250560
  misc_feature: Useful for making plants with modulated water use efficiency
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
MGLDLGAVLKPGTFGVSDHDAIVSINIFIALLCSCIVIGHLLEGNRWVNESITALVMGLITGGVILLATNGT

SEQ ID NO: 24845 - DNA, 679 bp, Panicum virgatum
  misc_feature: Ceres CLONE 1860959
  misc_feature: Encodes the peptide sequence at SEQ ID NO. 24846
gaccagcggttgttgcttcctcgcggaaaacggatagaacagccgccgcccttgctctccgatcgggcggaggattggagcgcccggggttcgatccggcggcgtgctcgtgccttagggatggctggcgcagaccgcggggaggaggccgcgctggagcaggggctcctcgctccggaggaaacgaaccaactaatatacactggagatggatctgtcgacttttctggaaatcctgttgtgaaggaaacaactggtagatggaaggcatgtccattcatattaggtaatgaatgctgtgagcggctggcctattatggcatctctacaaacctcgttacttacttgacaaaaaagctacatgatggcaatgcatctgctgctagcaatgtgactacatggcagggaacttgctatctgactccgcttattggagcaatcctggctgatgcgtactgggggaggtattggacgattgcaacattctccacgatatacttcattgggatggcaatactgactctttcagcatcagttcctatgctcatgcctccatcctgtgaaggatccttttgcccaccagcaagcccttttcagtatactgtattttttcttggtctttatctgattgccctgggtactggtggaattaagccatgtgtctcatcttttggagcgg

SEQ ID NO: 24846 - protein, 186 aa, Panicum virgatum
  misc_feature: Ceres CLONE 1860959
  misc_feature: Useful for making plants with altered carbon content
  misc_feature: Useful for making plants with altered nitrogen content
MAGADRGEEAALEQGLLAPEETNQLIYTGDGSVDFSGNPVVKETTGRWKACPFILGNECCERLAYYGISTNLVTYLTKKLHDGNASAASNVTTWQGTCYLTPLIGAILADAYWGRYWTIATFSTIYFIGMAILTLSASVPMLMPPSCEGSFCPPASPFQYTVFFLGLYLIALGTGGIKPCVSSFGA

SEQ ID NO: 24847 - DNA, 2018 bp, Panicum virgatum
  misc_feature: Ceres CLONE 1860967
  misc_feature: Encodes the peptide sequence at SEQ ID NO. 24848
acgccgccacacccgcattgtattcctcgcgccaccgccacaagactccaagacgaggacgagaggaggtgccggccggcccgctcccggaatctccaaccaccactgcactgcgcacccctaggagtaggtgtttccctttgttgtctccctctcctcggccatattggagggagtccagccactccctagtcagcaaccggcagccgcaaccatgggggcggaggaggcggagcagcccaacggcctcgtcgtggtgccggagccgcgcccgcgcaagggcctggcctcctgggcgctcgacctgctcgagtccgtcgccgtgcgactcggccacgacaaggccaagccgatccactggctatcaggcaactttggccccgtcgtcgacgagactccgccggcccctgacctccccgtccgcggacacctcccggagtgcttgaatggagagtttgtcagggtcgggcctaatcccaagtttgtcccagtcgcagggtatcactggtttgacggagatggaatgattcatgccatgcgtattaaggatggaaaagctacctatgtatcaagatatgtgaagacggctcgcctcaagcaggaagagtattttggcggagcgaagtttatgaagattggagatctaaagggattctttggattgttcatggttcaaatgcaacaacttcgtaaaaaattcaaagtcttggattttacctatggatttgggacagctaatactgcacttatatatcatcatggtaaactcacggccttgtcagaagcagataagccctatgtagttaaggtccttgaagatggagacttgcagactcttggtttgttggattatgacmmaaggctgaaacattctttcactgcccatccaaaagttgatccatttacagatgaaatgttcacctttggatactcacatgagcctccttactgtacataccgtgtaattaccaaagatgggtctatgcttgatcctgtgccaataacaataccagaatctgtaatgatgcatgactttgccatcacagagaattattctattttcatggatctccctttattgttccgaccaaaggaaatggtgaagaatggtgagtttatttacaagtttgatcctacaaagaaagctcgctttggtattctcccacgctatgccaaggatgacaaactcataagatggtttgaactccccaattgcttcatattccacaatgctaatgcttgggaagagggtgatgaagttgttctcgttacctgccgccttgagaatcctgatttggacaaggtgaacgggcatcaaagtgaaaagctcgagaacttcgggaatgagctgtacgagatgagattcaacatgaaaactggagcttcttcacagaagcaactgtcagtttctgctgtagattttcctcgtgttaatgagagctatactggcaggaagcagcgttatgtctactgcactatactggacagcatcgcgaaggtgactggcatcataaaattcgatctgcatgctgaaccggagagtggtaagaaggaacttgaagtaggaggaaatatacagggcatatatgacctgggacccggtagattcggttcagaggcgatttttgttcccaagcagccaggagtatctggagaagaagacgatggctatttgatattctttgtgcacgatgaaaacacagggaaatctgaagtaaatgttatagacgcgaagacaatgtctgctgatccagttgcagtggttgagcttcctaacagggttccatatggattccatgccttcttcgtaaccgaggaacaactggcgcaacaagcagagtagcacctgcagattctgcacgcgccggtagtagacacggtgatacacagctttatcgagtcctgttattgtggcagctcataatagtaatagtacgtacagtatatctatatgtattcttgcaagattacaatgcaaggtggtggtatacatatagtatatgcatacatatgctacc

SEQ ID NO: 24848 - protein, 542 aa, Panicum virgatum
  misc_feature: Ceres CLONE 1860967
  misc_feature (37)..(534): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature (215)..(215): Xaa is any aa, unknown, or other
MGAEEAEQPNGLVVVPEPRPRKGLASWALDLLESVAVRLGHDKAKPIHWLSGNFGPVVDETPPAPDLPVRGHLPECLNGEFVRVGPNPKFVPVAGYHWFDGDGMIHAMRIKDGKATYVSRYVKTARLKQEEYFGGAKFMKIGDLKGFFGLFMVQMQQLRKKFKVLDFTYGFGTANTALIYHHGKLTALSEADKPYVVKVLEDGDLQTLGLLDYDXRLKHSFTAHPKVDPFTDEMFTFGYSHEPPYCTYRVITKDGSMLDPVPITIPESVMMHDFAITENYSIFMDLPLLFRPKEMVKNGEFIYKFDPTKKARFGILPRYAKDDKLIRWFELPNCFIFHNANAWEEGDEVVLVTCRLENPDLDKVNGHQSEKLENFGNELYEMRFNMKTGASSQKQLSVSAVDFPRVNESYTGRKQRYVYCTILDSIAKVTGIIKFDLHAEPESGKKELEVGGNIQGIYDLGPGRFGSEAIFVPKQPGVSGEEDDGYLIFFVHDENTGKSEVNVIDAKTMSADPVAVVELPNRVPYGFHAFFVTEEQLAQQAE

SEQ ID NO: 24849 - DNA, 2550 bp, Panicum virgatum
  misc_feature: Ceres CLONE 1860979
  misc_feature: Encodes the peptide sequence at SEQ ID NO. 24850
atggccggagctccaaattccgccgccgcctcccccttcccctcgccacccttactgcggaccatctccatacacaccccaaacgccgctgccacctcatgatccgccgccacgcggcggccgcgacagcccttcgcgcgtaccttcaccgcgcctgctcctcccgcgccgccgaccccgacgatcagctgcttggccttgtcgaggcccccgagccgcaccacggatcccgcctctcacgcaaggacttcgccttttttcaggaacccacgccacccctccccgccgcagccctcccgcccccggaggccgccctcatctccaaggctatcagagcctacgccaccgacttcgacggcaaagcggagcgattcctgcggcggcaccgggaattcctgaccgacgccgtggtggtcgctgtgctccagtccgtgcgcgacccggagctttgtgtcaggttcttcctttgggccgagcggcaggtggggtacagccacaccagtgcctgctacgacacacttgcggaggtattgagttttgaggaccgtgctaggaccgccgagaggctgctgagggagattggggaggatgaccgcgaggttctcggcagattgctcaatgtgctcatgcgaaaatgctgccgccacggagcatgggccgaggcgctggaggagcttgggaggctgaaggattttgggtacagaccattgggtgcgacctacaacgctctggtgcaagtgcttgcaacagcggggcaggtggacttggggtttagggtgcagaaggagatgtctgaatcgggattctgcatggataagttcacagttgggtgctttgcacaagctttatgcaaagagggtcgatattcagatgcacttgacataatagagagggaggatttcaaactcgacacagtgttgtgcacccagatgatcagtggactgatggaggcctccctttttgatgaggctatttcattcctccacaggatgcggtgcaattcgtgcattcccaatgttgtcacgtacaggacattgctctctggatttttgaaaaagaagcagcttggctggtgcaaaaggataatcaacatgatgatgaaggagggttgcaatccaaacccttccttgtttaattcacttgtgcatagttattgcaatgatggggattacctatatgcatataaacttttaaagaagatggctgcttgtagttgccctcctggctatgttgtatacaatatttttattggaagcatctgtggtggggaggaattaccaaacctcgaattgttggatttggcagagaaagtctatgaggagatgctggcttctagatgcgttcttaataaggttaacactgccaattttgcacgatgcctttgtggtgtggggaagtttgataaggcgtttcaaatcattaaggagatgatgaaaaaaggttttgtacctgatacaagcacatattctaaggtgattacctttttgtgtcaggctatgaaggtagaaaaggctttcgttttgttccaagagatgaagaatgtcggtgttaaccctgatgtttatacgtacacaattttgattgatagcttttgtaaggccggtctcattgaacaagcgcaaagctggtttgatgagatgagcagtttgggttgctccccaaatgtagtaacgtacactgcattgcttcatgcttacctgaaagcgaaacagctatctcaagctagtgacttctttcacagaatggttgatgctgggtgtccccctaatgcaatcacgtacagtgctctaattgatggcctctgtaaggcaggtgaaatccaaaaggcatgtgaagtctatgccaaattgataggaacttctggcagtgtaaaatctgaatttttctttgaaggtgagcacacagacaccattgctccaaatgtagttacatatggagcgctcatagatggtttgtgtaaggcgcacaaagtggttgatgctcatgaattgctagatactatgttatcaactgggcgcaagccaaataacattatatatgacgccttgattgatggcttttgcaaggttgggaagattgataatgctcaggaggtatttctgaggatgtctaagtgtggttatttgcctactgtgcatacatacacctccttaattgatgcgatgtttaaggacaaaaggcttgatctagccatgaaagttctttctcagatgttggagggttcttgcactcctaatgttgtcacttacacagctatgattgatggactttgtagactagttgaaagtgaaaaggccttaaagctgctgtcaatgatggaaaagaagggatgcagcccaaatgttgtaacttacactgctttaatagatggattaggaaaatctggtaaggttgatataggccttcagctttttacacaaatgagcacacatgggtgtgctcctaattatgttacctacagagtactgataaaccattgctgtgctgctggccttttggatgaggcccattcactgctttgtgaaatgaagcagacttactggccgaaat

SEQ ID NO: 24850 - protein, 817 aa, Panicum virgatum
  misc_feature: Ceres CLONE 1860979
  misc_feature (489)..(523): Pfam Name: PPR Pfam Description: PPR repeat
  misc_feature (715)..(749): Pfam Name: PPR Pfam Description: PPR repeat
  misc_feature (524)..(558): Pfam Name: PPR Pfam Description: PPR repeat
  misc_feature (750)..(784): Pfam Name: PPR Pfam Description: PPR repeat
  misc_feature (645)..(679): Pfam Name: PPR Pfam Description: PPR repeat
  misc_feature (610)..(644): Pfam Name: PPR Pfam Description: PPR repeat
  misc_feature (680)..(714): Pfam Name: PPR Pfam Description: PPR repeat
  misc_feature (454)..(488): Pfam Name: PPR Pfam Description: PPR repeat
  misc_feature (273)..(307): Pfam Name: PPR Pfam Description: PPR repeat
  misc_feature (308)..(342): Pfam Name: PPR Pfam Description: PPR repeat
  misc_feature (206)..(240): Pfam Name: PPR Pfam Description: PPR repeat
  misc_feature (559)..(593): Pfam Name: PPR Pfam Description: PPR repeat
  misc_feature (419)..(453): Pfam Name: PPR Pfam Description: PPR repeat
  misc_feature (343)..(377): Pfam Name: PPR Pfam Description: PPR repeat
MIRRHAAAATALRAYLHRACSSRAADPDDQLLGLVEAPEPHHGSRLSRKDFAFFQEPTPPLPAAALPPPEAALISKAIRAYATDFDGKAERFLRRHREFLTDAVVVAVLQSVRDPELCVRFFLWAERQVGYSHTSACYDTLAEVLSFEDRARTAERLLREIGEDDREVLGRLLNVLMRKCCRHGAWAEALEELGRLKDFGYRPLGATYNALVQVLATAGQVDLGFRVQKEMSESGFCMDKFTVGCFAQALCKEGRYSDALDIIEREDFKLDTVLCTQMISGLMEASLFDEAISFLHRMRCNSCIPNVVTYRTLLSGFLKKKQLGWCKRIINMMMKEGCNPNPSLFNSLVHSYCNDGDYLYAYKLLKKMAACSCPPGYVVYNIFIGSICGGEELPNLELLDLAEKVYEEMLASRCVLNKVNTANFARCLCGVGKFDKAFQIIKEMMKKGFVPDTSTYSKVITFLCQAMKVEKAFVLFQEMKNVGVNPDVYTYTILIDSFCKAGLIEQAQSWFDEMSSLGCSPNVVTYTALLHAYLKAKQLSQASDFFHRMVDAGCPPNAITYSALIDGLCKAGEIQKACEVYAKLIGTSGSVKSEFFFEGEHTDTIAPNVVTYGALIDGLCKAHKVVDAHELLDTMLSTGRKPNNIIYDALIDGFCKVGKIDNAQEVFLRMSKCGYLPTVHTYTSLIDAMFKDKRLDLAMKVLSQMLEGSCTPNVVTYTAMIDGLCRLVESEKALKLLSMMEKKGCSPNVVTYTALIDGLGKSGKVDIGLQLFTQMSTHGCAPNYVTYRVLINHCCAAGLLDEAHSLLCEMKQTYWPK

SEQ ID NO: 24851 - DNA, 758 bp, Panicum virgatum
  misc_feature: Ceres CLONE 1860979-R
  misc_feature: Encodes the peptide sequence at SEQ ID NO. 24852
agactggtgaaagccttggagttgcataaagagatgattgaagtcgctccatcacaaaacataaccagccatggtacatacgcttcattaatccaggcactttgtttggcatctcatcctgaagaagcatttgaattatatagtgaaatgacgagaaaaggtgttgtgccagagctaagtgtctttgtttgcctcataaaggggctattcaaagtgaacaagtggaatgaagccttgcagttgtgttacagcatatgtcatgagggtgtaaactggcagggcaataactcttttgatggagggtaaagctgtgttgtctcacactcttattccaagtggcatcattgtccttaagagactattttcaataaggtggttttgatcctatgatttagtacaactttgggcagtattctaaaaagatacctgaacgatgcatcttccaaacattccgctgtggagtcatcaattctgaagattgcagttggatacttggatgtggtgactcaacggaaaaggagccgaggatgaaaaagctcatgtgcaaacagcacagatgctggattgactaaaaactgtttgttggcatgtatgaccttcagaaggatactataaagacttcataaacactgtacatactgaacctgcactcatgtaagaagaacttcgctccgtaactgcagcgaatctacagggctgtttgctgcttatcatcatatctgtgctctcatacaatgcagattatcatattccttgtc

SEQ ID NO: 24852 - protein, 101 aa, Panicum virgatum
  misc_feature: Ceres CLONE 1860979-R
  misc_feature (25)..(59): Pfam Name: PPR Pfam Description: PPR repeat
RLVKALELHKEMIEVAPSQNITSHGTYASLIQALCLASHPEEAFELYSEMTRKGVVPELSVFVCLIKGLFKVNKWNEALQLCYSICHEGVNWQGNNSFDGG

SEQ ID NO: 24853 - DNA, 713 bp, Panicum virgatum
  misc_feature: Ceres CLONE 1860984
  misc_feature: Encodes the peptide sequence at SEQ ID NO. 24854
acccaatgcggcgtcctgctggcgtggtctagccgcgtggtgcttgcgctctgttcgttgaggctcgcgtcgatctagcgatggagccccggtgctccgtgctggtcctggccctcgccgccatgctctccgtcgcagtggcttacgaccccctggacccgaacgggaacattaccatcaaatgggacatcatgtcgtggacgcccgacggctatgtcgcggtggtgacgatcaacaacttccagatgtaccggcagatcatggctccggggtggacggtgggctggacgtgggcgaagaaggaggtgatctggtccatggtgggcgcgcaggccacggagcagggcgactgctcccgcttcaagggcaacatcccgcactgctgcaagcgcacccccgccgtcgtcgacctgctgcccggcgtgccctacaaccagcagatcgccaactgctgccggggcggcgtcatcagcgcctacggccaggaccccggcgccgccgtcgccgcgttccaggtcagcgtcggccaagccggcaccaccaaccgcaccgtcaaggtgcccaagaacttcacgctgctcggccccggccccgggtacacctgcggccccgccaagatcgtcccctccaccgtcttcctcacgcccgaccgccgccgcaagacccaggctctcatgacgtggaacgtgacgtgcacctactcgcagcacctg

SEQ ID NO: 24854 - protein, 210 aa, Panicum virgatum
  misc_feature: Ceres CLONE 1860984
  misc_feature (45)..(209): Pfam Name: Phytochel_synth Pfam Description: Phytochelatin synthetase-like conserved region
  misc_feature: Useful for making plants with altered carbohydrate content
  misc_feature: Useful for making plants with altered cell wall content and/or composition
  misc_feature: The sequence is a functional homolog of SEQ ID NO 4 in US patent 7109001
  misc_feature: Useful for making plants with altered lignin content
MEPRCSVLVLALAAMLSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKIVPSTVFLTPDRRRKTQALMTWNVTCTYSQH

SEQ ID NO: 24855 - DNA, 2063 bp, Panicum virgatum
  misc_feature: Ceres CLONE 1860994
  misc_feature: Encodes the peptide sequence at SEQ ID NO. 24856
acagcagcagctggcagccgtgcccccaccaccagcaagcccctcaccgaacccctccccgtttcgcctcctccgcccaaatccccaaatcgccgcctccgatccgccgccgtcctcgatccgccggagctgttgacccgcccagaatggcctccgggccggcctcgccgtccggcaagccctactcccgcaaatcccacggcagctccaaggcccccagcgtcccctccttcgacgcccacagcaacggcccgctcctccccagcgtcaccttctcgctgccctccacgcccgcctcccgccgggagctccgccgccgcctctctgccgaactcgcccaggtgcgcgccgcctccaagcgactcaactccctcccggctccggccccctcctccgcgctctccgccaccgacccctccacgccgctccccccgcagccgccggcgtccaagcacaagtccaagaagggcgggggagccccgcacccgcagccgcacctctcggcggaggcgcggcgcaagctctacgctcccgtgttcaagagctgctccgcgctgctcaccaggctgatgaagcacaagcacagctgggtgttcaacaagccggttgatgcgagcgcgcttggcctgcacgactaccataccatcatcaccaagcccatggacctcggcacagtcaaatcaaagctagcggccgggcaatacaagtcgccacgggaattcgccggggatgtgcgtcttacgttccagaacgccatgacgtacaaccccaaggggcaggacgtgcacttcatggccgagcagctactgaacatgtttgaagagaagtggtcggagattgaagctgaggttgcgcaactatcaccccagcctcctacaccgtcgtcggctgcacccaggaagccaaaggagatagacaattctagggtgttagagaggtcggattcgaccgtccatgctgctggggtggaggctacaccgaagccgcacactggcagacccccagttttaaagaagcccaaggccagggagccaaataagagggatatgaccttctgggagaagcagcggcttggcaataacctccaggatttgccaccggagaagctagacaatgttgttcagatcataaagaagaggaacctgtcactcagccagcatgatgatgagattgaggttgatattgatagctttgatgttgaaacattatgggagcttgacagatttgtgacaaactataagaagagtataactaagaataagcggaaggctgagcttttcgcagtaaggccagatgaggctgaggccgagcctgagcttgagcctgagcctgagcctgagcctgatcaagagctggagaagatagagcacgcgaggcaggatgaggcagatcaggatcagattcctgcagtacaagaaccgattccagaaccagaagcagttgatgctgaaccacctaaggaaaatgcagcagatgacaatgagagatatgtgggtgaatcatcaccaggtcatttggaagatccaaagggagagactgctggtagatcaagtagttctggaagctctagcagtgactctggctcgtcctctagtgatacggacacagatagttcatcagcagatggctctgatgctgcacagtcacccagaacgtagcgtctataggccagatgttaatgtgagattggaaaggccataactccttagttcaccaaagattctagcgtgaaattgtcggcgagattgttgtaaattttgcttatttaggaaccctaaccaatgccatcagccatgatgttgttttggtctctcagtggatgcctggaatggctcatgcccgattcatctgtaccactatttgcagtcgtgtacttattgtagagtgctgtgtttacctagtcgtcgagctggaaagtacctcacattggataggaagaaacctgcaaactgggggcaagtaaaacaagcggtgaggtgaagaccgggaacctggaagcctcgccctgttgtaagattgtacaattgttatagttgtgtattttctgttggtgtttttgcatt

SEQ ID NO: 24856 - protein, 503 aa, Panicum virgatum
  misc_feature: Ceres CLONE 1860994
  misc_feature (130)..(219): Pfam Name: Bromodomain Pfam Description: Bromodomain
  misc_feature: SWISSPROT Homolog: EC 2.3.1.48 Histone acetyltransferase
MASGPASPSGKPYSRKSHGSSKAPSVPSFDAHSNGPLLPSVTFSLPSTPASRRELRRRLSAELAQVRAASKRLNSLPAPAPSSALSATDPSTPLPPQPPASKHKSKKGGGAPHPQPHLSAEARRKLYAPVFKSCSALLTRLMKHKHSWVFNKPVDASALGLHDYHTIITKPMDLGTVKSKLAAGQYKSPREFAGDVRLTFQNAMTYNPKGQDVHFMAEQLLNMFEEKWSEIEAEVAQLSPQPPTPSSAAPRKPKEIDNSRVLERSDSTVHAAGVEATPKPHTGRPPVLKKPKAREPNKRDMTFWEKQRLGNNLQDLPPEKLDNVVQIIKKRNLSLSQHDDEIEVDIDSFDVETLWELDRFVTNYKKSITKNKRKAELFAVRPDEAEAEPELEPEPEPEPDQELEKIEHARQDEADQDQIPAVQEPIPEPEAVDAEPPKENAADDNERYVGESSPGHLEDPKGETAGRSSSSGSSSSDSGSSSSDTDTDSSSADGSDAAQSPRT

SEQ ID NO: 24857 - DNA, 704 bp, Panicum virgatum
  misc_feature: Ceres CLONE 1861009
  misc_feature: Encodes the peptide sequence at SEQ ID NO. 24858
aatacgactccccctccgccgccgccgccgtctccgtctccgccgccggccgccatcccactgccttctcctccgtcctccgtttcctgactcagccgccgccctaagtttggctttttggcaaggcgcgacctccctccctccgtttgctgactcgcctacactacaaagtggatttctgagttgttggatgcaacagaggcgctctccaaggcaagcgtaacatgtgcccaaccatctattcattaactcaagacctgcctcggatcaatcccgccactttcgtctacctcttcgagtccggctgatgggaggtgcccgtcagcaaccgggcgtggacggaccttccctcagagatgccagactgcttgggaacggcgccgtgggtgtggctggaggctatgggctccagcagggggaggacgacttgaggagcagtgacccggatgtcctgctcagcgggccaacagctggtccgcagcagggtgacatggaaaaccaccagcaggtctgctgggagcgcatcctccagaagaagactatcaaagtcttgctcgtggagagtgatgattcaactaggcaggtggtcagtgccctgctacgtcgctgcatgtatgaagttatcccagccaaaaacggccagcaagcatggagttatcttgaagatatgcaaaacagcatagatcttgttttggctgaagttt

SEQ ID NO: 24858 - protein, 132 aa, Panicum virgatum
  misc_feature: Ceres CLONE 1861009
  misc_feature: SWISSPROT Homolog: EC 3.1.4.17 3',5'-cyclic-nucleotide phosphodiesterase
MGGARQQPGVDGPSLRDARLLGNGAVGVAGGYGLQQGEDDLRSSDPDVLLSGPTAGPQQGDMENHQQVCWERILQKKTIKVLLVESDDSTRQVVSALLRRCMYEVIPAKNGQQAWSYLEDMQNSIDLVLAEV

SEQ ID NO: 24859 - DNA, 722 bp, Panicum virgatum
  misc_feature: Ceres CLONE 1861022
  misc_feature: Encodes the peptide sequence at SEQ ID NO. 24860
aggagacacagcgcccgccacacgcacgcatcgcctctcctccactacccaaattcttgacattctgttcgcaatggcgctcgccacgaacgccgccgctgcggcagccgccatgtccggcgcggccgcgccgcagccccgtccacgcgcgccggcgttcctcccgctgaggcgccgctgcgccgtccgcgccgtgcacgccgcggagccgtccaaaggccacggcgtcccggcggccgcgaagacctcgtcgccgacggtcgcgcccgagaaggaggcggccccagtcgcggccccggccccggccccggcctcgaaggcgctcctgaagtgggcggtggacagctggatggcgaagaaggcgctgcagcagccggagtacccgaacccggcggagctcgaggccgtgctcaagacgatcgaggccttcccgccgatcgtgttcgctggggaggcgcgccacctggaggagcgcctcgccgacgccgccatgggccgcgccttcctcctccagggcggcgactgcgccgagagcttcaaagagttcaacagcaacaacatccgggacaccttccgcgtcctcctccagatgtccgtcgtcctcatgttcggcgcccaaatgcccgtcatcaaggttggtaggatggccggacagttcgccaagccgaggtcggagccgttcgaggtcagggatggagtgaagctgcccagctaccgcggcg

SEQ ID NO: 24860 - protein, 216 aa, Panicum virgatum
  misc_feature: Ceres CLONE 1861022
  misc_feature (86)..(216): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
MALATNAAAAAAAMSGAAAPQPRPRAPAFLPLRRRCAVRAVHAAEPSKGHGVPAAAKTSSPTVAPEKEAAPVAAPAPAPASKALLKWAVDSWMAKKALQQPEYPNPAELEAVLKTIEAFPPIVFAGEARHLEERLADAAMGRAFLLQGGDCAESFKEFNSNNIRDTFRVLLQMSVVLMFGAQMPVIKVGRMAGQFAKPRSEPFEVRDGVKLPSYRG

SEQ ID NO: 24861 - DNA, 539 bp, Panicum virgatum
  misc_feature: Ceres CLONE 1861025
  misc_feature: Encodes the peptide sequence at SEQ ID NO. 24862
tcccgacaagcggaaagaagaggcgagggaggtagaaagggggaggaaagaggaggcggggagcgagaggggtccgagcgagagcagccagaggggggagaggcggagaggagggggaggaagggggaagccaatctttgaggggcgtcgagagatccctgtggtggaggaggagaagctctcgccgagtctttgggggccgctctctagctctgcgaccgcttatgtgagttgattcatagctgagttggggttggtgtcgcctgtcttcttgagcgatgggctcctcctgtgttgctccggctggggacgagaaccgcccccgcaccagcattggtgttgataacttcctggatcgcctcaaccacctaaagattagagattataaggaagttgcagcaaccttcatttatgggaaaggtacagagactgggcacataattgtgactactactggtggaaagaatggtcaacctacgcagacagtgagctacatggctgaacgcattgttggtcaaggttcttttgggattgtcttc

SEQ ID NO: 24862 - protein, 86 aa, Panicum virgatum
  misc_feature: Ceres CLONE 1861025
  misc_feature: SWISSPROT Homolog: EC 2.7.11.1 Non-specific serine/threonine protein kinase
MGSSCVAPAGDENRPRTSIGVDNFLDRLNHLKIRDYKEVAATFIYGKGTETGHIIVTTTGGKNGQPTQTVSYMAERIVGQGSFGIV

SEQ ID NO: 24863 - DNA, 509 bp, Panicum virgatum
  misc_feature: Ceres CLONE 1861039
  misc_feature: Encodes the peptide sequence at SEQ ID NO. 24864
gtttgctcgcttctctctctcctgtcctcctcttgctcgagccgcggggcgatcgcttccagccggagagaggggagaggcgcgggccgcaacaccctagagtagcgagggagggtggtcttcccggaaggaggaggacgggaacgggaagagggagatgcaaggcgccagccacatgctcctggaggagccggtccgcctcgcctccgtgctcccccccgtcaagtccaaggtcttcccgtccctccccatgattgttgggacgctcgggcccaactcccactcggtcgaggttatacacgaatgcctcgctgctggaatgtcggttgccctgttcgatttctcatggatggatgctgactatcaccctcagacccttaacagtctgatgaaagcaccgcagaatgtaaagaagtcgtgccctgtaatgcttgatacactgggtccacaacttcacgttcacaattccactggtgggcctattgcgttgacagctgggaaccctgtta

SEQ ID NO: 24864 - protein, 117 aa, Panicum virgatum
  misc_feature: Ceres CLONE 1861039
  misc_feature: SWISSPROT Homolog: EC 2.7.1.40 Pyruvate kinase
MQGASHMLLEEPVRLASVLPPVKSKVFPSLPMIVGTLGPNSHSVEVIHECLAAGMSVALFDFSWMDADYHPQTLNSLMKAPQNVKKSCPVMLDTLGPQLHVHNSTGGPIALTAGNPV

SEQ ID NO: 24865 - DNA, 347 bp, Panicum virgatum
  misc_feature: Ceres CLONE 1861050
  misc_feature: Encodes the peptide sequence at SEQ ID NO. 24866
atcctacacacctccacacaccacgagcgaagagacgcggccttggcgtatggctccgacgcccgcctgcccgctcctccgggtctccgccgctgctcccgtttccgccgtcttcaccgccgtttcctaccctcgggtccccggtttcctggcttccctgcgttctgcttccgttcgccaccacctcaccactgcatggtcccctaaggccgaggccgcggcgtctgtcgaagtccaggatgagtgcgtggatgaaatggacgcggtgaacattgctatcgacatctcccatctaattgggaaaacacctacggtgtatctcaataatgttgttgaccgttgtgttg

SEQ ID NO: 24866 - protein, 99 aa, Panicum virgatum
  misc_feature: Ceres CLONE 1861050
  misc_feature: SWISSPROT Homolog: EC 2.5.1.47 Cysteine synthase
MAPTPACPLLRVSAAAPVSAVFTAVSYPRVPGFLASLRSASVRHHLTTAWSPKAEAAASVEVQDECVDEMDAVNIAIDISHLIGKTPTVYLNNVVDRCV

SEQ ID NO: 24867 - DNA, 1459 bp, Panicum virgatum
  misc_feature: Ceres CLONE 1861052
  misc_feature: Encodes the peptide sequence at SEQ ID NO. 24868
cccgcctccgctcctccgcccccaccactcacctccctgcgcggcgcgggccagagccctcgcggcctcccccaggacccaggtcccccacccacccgccccatcccgtcccgcggcgaccgggacccccactcctgtcgtgccctcaccgcgggtacccgcaccgcgcggcggcccccctcgcccccctcttcaaaatctctcccgcgtgctcgggcctcgccgaccactccgctccgcaccgcaccgcattgggtttggactttggaccccggccgagcggcgggcgtgccggctgatctctcgcgcggcgcggcgatgtggcgttcggcggcgcggcggtcgtcgcagatacggcggctcctgtcgtcgtccgcgcccccggcggggcccctcgccaccgtgccggcgccctgcatcgtgcagaagcgcgggaacgacatcctcaacgacccgtggtacaacaaggacacggcgttccccttgacggagcgcgaccgcctcggcctccgcggcctgctcccgccgcgggtcatgtccttcgaacagcagtacgagcggttcataaactcgtaccggtcgctggagaagaacacccggggcgagccggactccatcgtcgcgctggccaagtggaggatcctcaacaggctgcacgaccggaacgagacactgtacttcagggtgctgatcgacaacatcaaggattttgcgccggtaatatacactcccactgtcggcttggtctgcgaaaactacagtggtctcttcagacggcctcgtgggatgtatttcaccgcgaaggataagggggagatgatgtcgatgatttacaactggccacaagagaaggttgacatgatagttgtgactgatgggagtcgcattctaggcttaggtgaccttggtgttcaggggataggcatacctattggtaaactggatctttatgttgcagctgctggtattaacccacaaaagattcttccagtaattcttgatgtggggacaaataatgaaaaacttctggatgacaatctatatctaggactgaggcaaccccgattggaaggagaagaatacatggccgttgtagatgaattcatggaggctgtccacgcacggtggcctaaagcagttgtgcagtttgaagacttccaaatgaaatgggcctttgagactcttcagaggtatcggaaccgattttgcatgttcaatgatgacgttcagggtacagccggcgttgctctagctggcctacttggtgctgttagggcacaaggtcgacctctacatgattttacaaagcaaaagatagtcgtcgcgggagctggaagtgctgggataggtgtgctaagcatggctaaacaggaaatgttgaggatgcttgggaaaactggggaaggagaaggaaataatcaattctgggttctggacaaagatggccttatcacgaaag

SEQ ID NO: 24868 - protein, 380 aa, Panicum virgatum
  misc_feature: Ceres CLONE 1861052
  misc_feature (113)..(301): Pfam Name: malic Pfam Description: Malic enzyme, N-terminal domain
  misc_feature: SWISSPROT Homolog: EC 1.1.1.39 Malate dehydrogenase (decarboxylating)
MWRSAARRSSQIRRLLSSSAPPAGPLATVPAPCIVQKRGNDILNDPWYNKDTAFPLTERDRLGLRGLLPPRVMSFEQQYERFINSYRSLEKNTRGEPDSIVALAKWRILNRLHDRNETLYFRVLIDNIKDFAPVIYTPTVGLVCENYSGLFRRPRGMYFTAKDKGEMMSMIYNWPQEKVDMIVVTDGSRILGLGDLGVQGIGIPIGKLDLYVAAAGINPQKILPVILDVGTNNEKLLDDNLYLGLRQPRLEGEEYMAVVDEFMEAVHARWPKAVVQFEDFQMKWAFETLQRYRNRFCMFNDDVQGTAGVALAGLLGAVRAQGRPLHDFTKQKIVVAGAGSAGIGVLSMAKQEMLRMLGKTGEGEGNNQFWVLDKDGLITK

SEQ ID NO: 24869 - DNA, 741 bp, Panicum virgatum
  misc_feature: Ceres CLONE 1861052-R
  misc_feature: Encodes the peptide sequence at SEQ ID NO. 24870
tgaatgtaaacctgatgatgtattcaagcatgtgggagagaatgcgatatttgctagtgaagccccatttcagtaacgtttctttaggaaatggtaagacaggctatgctaatcaagcaaacaacatgtatctatttcctgggattggtttaggagctctcctttcaggtgctcggcatatttcagatgacatgcttcaagcaggagctgagtgcctcgcatcatatatcacagatgatgaaattcaaaaaggaatcctcttccctgaagtctccagtataaggcacatcaccgcacgtgtcggcgcagcagttgtccgtgccgccgtcgctgaagacctggctgaggggtaccgcactgtgggtcctaaggagcttggaagcatgtcagagtcgcaaacggtggactacgtcgctcggaatatgtggtaccctatttacagcccccttgtgaacaacaaataaatcggcaaaatctcacggctgcaccgaagcagatgcccctgacattccacccgaaggaatataccagacttaggcatttgttttggctacttgttacaactaaagcattgctcaattttgagatccgttgatcttcatactgccacagtaagtgtatttatcatgattattgtaataagcatcagacactggagcttctctagttctttccatccagaaaaaaatgtcacgaaatcagaggcaaaatgaatttttatctccgagatgtttgcaaccc

SEQ ID NO: 24870 - protein, 153 aa, Panicum virgatum
  misc_feature: Ceres CLONE 1861052-R
  misc_feature (1)..(109): Pfam Name: Malic_M Pfam Description: Malic enzyme, NAD binding domain
  misc_feature: SWISSPROT Homolog: EC 1.1.1.39 Malate dehydrogenase (decarboxylating)
NVNLMMYSSMWERMRYLLVKPHFSNVSLGNGKTGYANQANNMYLFPGIGLGALLSGARHISDDMLQAGAECLASYITDDEIQKGILFPEVSSIRHITARVGAAVVRAAVAEDLAEGYRTVGPKELGSMSESQTVDYVARNMWYPIYSPLVNNK

SEQ ID NO: 24871 - DNA, 2047 bp, Panicum virgatum
  misc_feature: Ceres CLONE 1861060
  misc_feature: Encodes the peptide sequence at SEQ ID NO. 24872
atatctcccaccatagctctcccctctgcggttctactccccttccccctgaaagcttctccatttcctcttggttcgtgcactgcgcgcctgcgcgcgcggtgatagaggaagcaatgggggccaacgccgcggcggcgggcctgccgacgctactggccgcggcgctcctgctcagcagcgccttcttcccgtccgcgtccgccgcgtcctccttccccgcaaggattgcgggcaggattgtgtccaccacggcgtcggcggtggccaggcagctctggtcgctcaaatcggctgccaccaagacggataatcgccgcggtctctcgcgggtcggtgccgattattcttcgcttgcttgttcggttttcttgactcggttcgccgtctcgggctttcggtggtgtcggcagcggcggggacggcggcggcggcggcggggcggtccatggtgcggtacgagggagggtacgaggtggacacggtgttcgacggcagcaagctggggatcgagccgcacgccgtcgaggtcacccctgccggcgacctgctcgtgctcgactccatcaacagcaacatttacagggtccagctgccgctgtcgccatatagcaggccaaagcttcttgctggttctccagaaggtttatctggtcatgtggatggaaggctgcgacaagcgaggatgaaccatcctaaggggttcactgtggacgataggggcaacatttatgttgcagatgctttgaacatggcaataagaaagatcagtgatacatgggttacaaccattgctggagggaaatcaattagaggacacatagatgggcctagtgatgatgcaaaattctcaactgattttgagattcggtacatcagtagcagctgctccctcacggtcattgatagaggaaaccaagcaattcgtgagattccactccatgatgatgactgtgtatatcagtatgaagctggttttcctctaggaatttcactgctttttgctgctggtttctttggctatatgcttgcattgctccagcgacgggttttggggatggcatcaacagcagatgaacctcaaattcctccaagacccagcattgcaagtatccctccatatcagaagcctttaaatccttatgttcgtcccccacaaatcccaagggaagatgaagctacaaaacaggaaactgaagagggtttcttcacctcagtcggcaaactcattggaggagcaaaatcatccatggcagagatatttggttccagaaagaagcgcttgaacaaccagtaccgtcaccagcagcgaagagctaacccatggccagtgcaagatagagctagcccatggccagtgcaagatagctatgctatcccacatgacgagacgcctccaccactggacaccagagcaccaacccctcagaagaactatgcgttcatgccaaaggagcatgagaagatccaccatgcccgacatgggcacccttatttcaacggctgggacgaccaccaccaccatcctcagcagcggcagccagagcagcaactgtatcaccagcggcaacacctgcagcagcacaggcagttctccacaggcccacagacgttttatgagcagagctgcgaggcaaagaatgagattgtctttggtgcggtccaggaggtggacagcaaacggcgcatggtggagatcaaggccgtgaactatggagacaccttctatgagcagtacgggatgcggtaccgcaacaactacatcggctacaacagcaacacctattgaacagccagtctattttcttattgtttaccctcctttttttgtttgagttagttacctgattagattaactgcttgccttcttattggcaaacctccacatttcctgtaacaaaaaatagaaagtggagggagtagaagctatctcctgttttgacttgtacaatggacaaaactgggggttttggaagtacaacctggttatatctttccttagacttcctgacgtatgaattttacagagatatttcagagtttgat

SEQ ID NO: 24872 - protein, 446 aa, Panicum virgatum
  misc_feature: Ceres CLONE 1861060
  misc_feature (80)..(107): Pfam Name: NHL Pfam Description: NHL repeat
MVRYEGGYEVDTVFDGSKLGIEPHAVEVTPAGDLLVLDSINSNIYRVQLPLSPYSRPKLLAGSPEGLSGHVDGRLRQARMNHPKGFTVDDRGNIYVADALNMAIRKISDTWVTTIAGGKSIRGHIDGPSDDAKFSTDFEIRYISSSCSLTVIDRGNQAIREIPLHDDDCVYQYEAGFPLGISLLFAAGFFGYMLALLQRRVLGMASTADEPQIPPRPSIASIPPYQKPLNPYVRPPQIPREDEATKQETEEGFFTSVGKLIGGAKSSMAEIFGSRKKRLNNQYRHQQRRANPWPVQDRASPWPVQDSYAIPHDETPPPLDTRAPTPQKNYAFMPKEHEKIHHARHGHPYFNGWDDHHHHPQQRQPEQQLYHQRQHLQQHRQFSTGPQTFYEQSCEAKNEIVFGAVQEVDSKRRMVEIKAVNYGDTFYEQYGMRYRNNYIGYNSNTY

SEQ ID NO: 24873 - DNA, 1774 bp, Panicum virgatum
  misc_feature: Ceres CLONE 1861068
  misc_feature: Encodes the peptide sequence at SEQ ID NO. 24874
cgaccccaggtcagacgggatcacccgctgagtttaagcatataaataagcggaggagaagaaacttacaaggattcccctagtaacggcgagcgaaccgggagcagcccagcttgactccggacccagcgccgccaaaccctaggagcccgtgccgccgccgacgaggaggatggcggacaaggagaacgcgccggcggcggcggccgcggggccccggctcacccgatccgccgccaagcgcgcggccgaggccgccgccggcgcccccgccaagcgcaagcgggtggcgctcggggagctcccggcgctcgccgccaacgccgccaccgtccaccgcaccccgctggcccgcccggtcaagcccgcgaggggcgccgccaaggccgccaggcccggcaagccggtccccagacccgcagccgcccccgcggctgcggccgacgccgaagccgagcgctgcggatcctcctcgccgcggcgcgccgcgggggccgccgaccccgacctcgactcctccgcgtccaactcccctccgcgcgcggccgccgccgcggaccccgaccgcgactcctccgcctcctcctcccccccgccgcgcgctgccggggcgggggctctcggcaacccgcagctctgcgggtcctacgcctccgacatctacacctaccaccgcgctctggaggtggagccgcggcggcggccgagatccgactacattgaggccgtgcagtcggacgtcacggccaacatgcggaccatcctcgtcgactggctcgtcgaggtcgccgaggagtacaagctcgtcgccgacacgctctacctcgccatctcctacgtcgaccgcttcctctccgccaacgcgctcagccgtgacaagctgcaactccttggcgtcgctgccatgctcatcgccgcgaagtacgaagagatcagcccccctcatgcggaggacttctgctacatcactgacaatacctacactaagcaggagcttcttaagacagagagtgacatactcaagctgctccagtttgagttgggcaatcctacaattaagaccttcctgaggcggttcacaagatcggcccatgaagacaaaaagcgctccatcttattaatggagttcttggggagctaccttgctgagctgagtctgctggactatggctgtctccggttcttgccatcagtagttgctgcttcagtgatgtttgttgctaggctgaccattgatccagatgtcaatccttggaacaagaagttgcagaaggtgacaggctacaaggtttctgaactcaaggattgcattgtagccatacatgacttgcagctcaacaagaagtgttcatcagtgatggcaattcgggacaagtacaagcaacacaagttcaaatttgtatcgaccctgcttcctcctgttgtgatccctactccatactttgaagacttagcggagtagctggtcatggacccacaccactgtaaggctaacaatctgagctcttcttgagctcttagggataggggagaactactactattgatgtgctgcttctcagtgaagtagatactgattgctgaaagccatttatgtgctcgtggttctttaggagttgctagtagtgagacaaggcattcttctgttttgtgaattgtattttttgtatcatatcttaggacatgttgccttggtctgttggccacaaacttgtaatgtttgatatgttggctcattccttctgaatctcattgatttcaataacaaattctg

SEQ ID NO: 24874 - protein, 429 aa, Panicum virgatum
  misc_feature: Ceres CLONE 1861068
  misc_feature (162)..(291): Pfam Name: Cyclin_N Pfam Description: Cyclin, N-terminal domain
  misc_feature (293)..(420): Pfam Name: Cyclin_C Pfam Description: Cyclin, C-terminal domain
  misc_feature: Useful for making plants with modulated nitrogen use efficiency
  misc_feature: Useful for making plants with modulated oxidative stress sensitivity
MADKENAPAAAAAGPRLTRSAAKRAAEAAAGAPAKRKRVALGELPALAANAATVHRTPLARPVKPARGAAKAARPGKPVPRPAAAPAAAADAEAERCGSSSPRRAAGAADPDLDSSASNSPPRAAAAADPDRDSSASSSPPPRAAGAGALGNPQLCGSYASDIYTYHRALEVEPRRRPRSDYIEAVQSDVTANMRTILVDWLVEVAEEYKLVADTLYLAISYVDRFLSANALSRDKLQLLGVAAMLIAAKYEEISPPHAEDFCYITDNTYTKQELLKTESDILKLLQFELGNPTIKTFLRRFTRSAHEDKKRSILLMEFLGSYLAELSLLDYGCLRFLPSVVAASVMFVARLTIDPDVNPWNKKLQKVTGYKVSELKDCIVAIHDLQLNKKCSSVMAIRDKYKQHKFKFVSTLLPPVVIPTPYFEDLAE

SEQ ID NO: 24875 - DNA, 803 bp, Panicum virgatum
  misc_feature: Ceres CLONE 1861086-R
  misc_feature: Encodes the peptide sequence at SEQ ID NO. 24876
gcatgctagggattacaatgcaaactggatgactgcagttgagatgcttgatgatgaagcctatatcggggcggaaaatagttataacctattcactgtacgcaagaacagtgatgcagccacagatgacgaaagggccaggctggaggttgttggggagtaccatctcggagagtttgtgaataggttccgccatggttcactcgtaatgcgccttccggactcagagatagggcagattcccacagtcatctttggcacaataaatggggtaattggcatcatcgcctccctcccacatgaccagtacatgtttctagagaagctccagtccactcttgtgaagttcataaagggtgtcggaaacctgagccatgagcaatggcgttcgttccataatgataagaagacagccgaggctcggaacttccttgatggcgacctgattgagtcattccttgaccttagcaggagtaagatggaggaggtgtccaaggctatgggtgttcctgtggaggagctgtccaagagagtggaagagttgactaggctgcactagatgaataagttagctgtttgctgtaacatgtaaatcctttgtaacttgtattttgtactgtcgcagtggcatgtagttttcagtgcagggagtttcctcggcgatgctgttgccgccggttgcacaagtgttcacccggttgtagtttcctttgctttgttggatggctacttttcatctgacagtttggtgagattgtttttcgtaaaccctcaaatcaaaaaaatagtagtgaaacttgtgt

SEQ ID NO: 24876 - protein, 185 aa, Panicum virgatum
  misc_feature: Ceres CLONE 1861086-R
  misc_feature (1)..(124): Pfam Name: CPSF_A Pfam Description: CPSF A subunit region
HARDYNANWMTAVEMLDDEAYIGAENSYNLFTVRKNSDAATDDERARLEVVGEYHLGEFVNRFRHGSLVMRLPDSEIGQIPTVIFGTINGVIGIIASLPHDQYMFLEKLQSTLVKFIKGVGNLSHEQWRSFHNDKKTAEARNFLDGDLIESFLDLSRSKMEEVSKAMGVPVEELSKRVEELTRLH

SEQ ID NO: 24877 - DNA, 2407 bp, Panicum virgatum
  misc_feature: Ceres CLONE 1861086
atctctcgctcgtccctctctctggctcggaccagcaccatcacctccttccccaaccttccagaccccactgcccccggcggcggcggcaccggtggcggcggcggagatgagcgtgtggaactacgtagtcacggcgcacaagccgaccagcgtcagtcactcctgcgtcggcaacttcaccagccccaaccagctcaacctcatcatcgcgaaatgtacccgcattgagatccatttgcttactcctcagggccttcagcctatgcttgatgtccctatatacggaaggatcgcgacgattgagcttttccgccctcataatgagactcaagattttcttttcattgctacggagaggtacaaattctgtgttctgcaatgggacgcagaaaaatcagagctcctcaccagagccatgggtgatgtttctgatcgcattggccgtcctactgataatggacagattggaattatcgaccctgactgcagacttattggtcttcacctctatgacggcttatttaaggttataccatttgacaacaaaggacagctgaaggaagctttcaatatcagacttgaagaacttcaagtactggacatcaagtttctgcatggttgtgttaaacctactattgttgtcctctaccaggataataaagacgcgaggcatgttaagacatatgaagttgcactgaaggacaaagattttgttgagggtccttggtcccaaaataatttagacaatggtgctggtttgttaatacctgtaccagctccacttggtggcgtgataattattggcgaggagacaatagtttactgcaatgccaatgctacatttaaagctataccaataaaacaatctatcataagagcttatggacgggttgacccagatggttctcgatatttactcggtgataatgcaggaactctgcatttacttgtccttacccatgaacgagaaagggttactggtttgaaagtagaatacttgggagagacttcaatcgcatcatcaatttcatatctcgataatggtgttgtttatgttggttcacgatttggcgattcacagctggtaaaactgaacctccaagctgatgcaagtggttcatttgttgaagttctggaacgttatgtgaatcttggacctattgtggacttctgcgtggttgaccttgataggcagggtcagggtcaggtggtcacttgttctggggcatttaaagatggttcccttcgcgtggttcggagcggtatagggattaatgagcaggcttcagtagaactccaaggtatcaagggattatggtcattgaaatcttctttcaatgatccttatgacatgtacctagtcgtgagctttataagtgagacacggttcttggcgatgaacatggaagatgaactagaagaaactgagatagaggggtttgatgcgcaaacacagaccctgttttgtcaaaatgcgatccatgatcttctcatacaggttactgctaattctgttcggttagtcagttgcacctctcgggagctagtggatcaatggaatgcacctgcaggattttcagtcaatgttgcttcagctaatgctagtcaggttctgctggcaacaggtggtggccatcttgtttacctagaaattagggatgctaagcttgttgaagtgaagcatgcacagttagagcatgagatttcttgtctcgatttgaacccaattggggagaatccacagtatagttccctagctgctgttgggatgtggacagatataagtgttagaatattttcacttccagatcttgaattaataaggaaggaaaatttgggtggagaaattgttcctcggtctgttctgctgtgcaccttggagggggtttcgtatttgctttgtgctcttggagatggtaacctgttcagttttctgctgaatgcaagtacaggtgaactcaatgatagaaagaaggtttcccttgggacccaaccaatcagccttcgtacattctcatcaaagggtaccacccacgtgtttgcttcatcagataggccaactgtcatctatagcagcaataagaaacttctctatagcaatgttaatttgaaagaagttaatcatatgtgccctttcaatacagccgcttttccagacagccttgcaattgctaaagaaggtgaactctcaattggaacaattgatgatatccaaaaacttcacatccgtacaatcccccttaatgaacaagcacggcgcatttgccaccaggagcaatcaaggacactagcattttgcagtttcaagtacaaccagactagtatggaggaaagtgagactcattacatccgtctgttagatcatcagacttttgagttcctgtctacatatcctctagatcat

SEQ ID NO: 24878 - DNA, 629 bp, Panicum virgatum
  misc_feature: Ceres CLONE 1861087
  misc_feature: Encodes the peptide sequence at SEQ ID NO. 24879
agtccgcccgccgcgccggctactctaatactcgccacccaagccgcccgccgtctcgccctcccgccgcctccctcatcctcccctcgacctcgtctgctcctatggcgactgtgccagtcaaccctaaacctttcttgaacaacctaacagggaagcctgtaattgtcaaacttaagtggggtatggagtacaaaggttatcttgtttctgtggactcctacatgaatcttcagcttgctaacacagaggagtacattgatgggcaattctctgggaacctgggagagattttgatcaggtgcaacaatgttctgtacctccgaggtgttccagaagatgctgagatagaggatgcggagtgagaagactttgaaccatgtttagattgattgatgtaatatgattctgacatgtgtttggggtgctggggacaacctattctgccgaatccttgctttgaactttatgattgacgaagcgtgtcctgctttcagttaggctatactgtcattcttctgaacgtttgaagtttgaactgagagctatgactagacatgatgctcaaacttctttcagttatgagtatgactagacattctgctgaataacaaaaagacactaaccac

SEQ ID NO: 24879 - protein, 86 aa, Panicum virgatum
  misc_feature: Ceres CLONE 1861087
  misc_feature (10)..(75): Pfam Name: LSM Pfam Description: LSM domain
MATVPVNPKPFLNNLTGKPVIVKLKWGMEYKGYLVSVDSYMNLQLANTEEYIDGQFSGNLGEILIRCNNVLYLRGVPEDAEIEDAE

SEQ ID NO: 24880 - DNA, 697 bp, Panicum virgatum
  misc_feature: Ceres CLONE 1861094
  misc_feature: Encodes the peptide sequence at SEQ ID NO. 24881
acagaaaaaacgccacgagtccaaaacacatttgctcgggagaaatattaccagctgcgaatttttttttctctcaaagccccagagagcttccatggcttccgccgccacctccatctcgtcgcaccccgccgccctccgcgatgtcaaagccgcgaggattggagccgtgaggcagcatgtggccgtggctccggcggcgcggggccagcgcgctcgggcggtgcgcccgctgcgcgcggtggagcaggggaggcagccggtgacggcctccgcggcctcggcggcgccggcggcgcccgtggccgacgaggtggcggcccccgcggcggtggactacgaggccctggcgcgcgagctggagggcgcgtcgccgctggaggtcatggatcgggcgctggccatgttcggatccgagatcgccatcgccttcagtggcgcggaggacgtggcgctgatcgagtacgcgaagctgacggggcgccccttccgggtgttcagcctggacacggggcggctgaacccggagacgtaccagttcttcgacaaggtggagaagcattacggcatccgcatcgagtacatgttcccggacgccggcgaggtgcaggagctggtgcggaccaagggcctcttctccttctacgaggacggccaccaggagtgctgccgggtgcgcaaggtgcggccgctgcgc

SEQ ID NO: 24881 - protein, 200 aa, Panicum virgatum
  misc_feature: Ceres CLONE 1861094
  misc_feature (108)..(200): Pfam Name: PAPS_reduct Pfam Description: Phosphoadenosine phosphosulfate reductase family
  misc_feature: SWISSPROT Homolog: EC 1.8.4.9 Adenylyl-sulfate reductase (glutathione)
  misc_feature: Useful for making plants with modulated nitrogen use efficiency
MASAATSISSHPAALRDVKAARIGAVRQHVAVAPAARGQRARAVRPLRAVEQGRQPVTASAASAAPAAPVADEVAAPAAVDYEALARELEGASPLEVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPL

SEQ ID NO: 24882 - DNA, 2503 bp, Panicum virgatum
  misc_feature: Ceres CLONE 1861103
  misc_feature: Encodes the peptide sequence at SEQ ID NO. 24883
ctgttgctcgtccgctccttcgccgccgcacccgccgccagcctccccttcccccgaagaacggcggccgggcgctgtcccctggcccctgacgcgtcggttaccattggattggtgtgggggcggcgatccgtccggacctagggttgctgagacccgggagaccccatagggtacgatctaggcgcatccgcctccgcgtgggtgaggcggaggagggaggatgtcgtcgctcagccgggagctggtcttcctcatcctgcagttcctcgatgaagagaagttcaaagagactgtccacaagctcgagcaggagtccgggttctacttcaacatgaagtactttgaggacgaggtgatcaatgggaattgggacgaggtggagcgctaccttggtggcttcaccaaggttgatgacaaccgctactcgatgaagatattctttgagatccgcaagcagaagtatctcgaggctcttgataagcatgatcggtccaaggctgttgaaatcttggtcaaagacttgaaggtctttgcatccttcaatgaggagctttttaaggagatcacacagctcctgaccttggagaactttagggaaaatgagcagctctccaagtatggtgatacaaaatctgcgagagcgataatgcttgttgagctgaagaagctgattgaagctaatcccttatttcgcgacaagctacagtttcccaacctgaagaattctaggttgcggacacttatcaaccagagcttgaactggcagcatcagctttgcaaaaatcctaggcctaatcctgatatcaagactctttttgttgatcattcgtgtggacaaccaaacggtgcacgtgctccatcgccagctaacaacccgttacttggttctatacccaaaccaggaggtttccctccattgggtgctcatggaccctttcaaactgcaccaacagtcccacctctggctgggtggatgtcaaacccaccagcagtaacacatcctgctgtgtctggtggtgctattggatttggtactcctacgaatccagccgctttattgaagcatcctaggacgcccacaacagctaatcctagtatggattatccatcaggagattctgatcacatctccaagagatctagaccagttggcattgctgaggagcaggtgaatcttccagtgaacatgttgcctgtgacttatccacagagccataattaccaacaagatgatttccataaaacggttgcacggaccttgacccaaggatcagctcctatgagcatggatttccatccacttcagcaaactcttcttcttgttggtaccaatgttggtgacataggattgtgggatgttggtacaaaagatagacttgttgtaaaaaacttcaaggtttgggagcttggaaagtgttcgatggctctccaggcatcgctcgtcaaggatccttctgtgtcagttaatcgcataatatggagtcctgatggaaccttgtttggtgttgcttattcaaggcatattgtacagatttattcctatcatggtggcgatgatattaggcaacacttggagattgatgcacatgttggtggtgtaaatgacattgcatttgctcatccaaataagcagctatgtataattacatgtggagatgataagacaattaaggtatgggaggccactagtggagcaaagcaatttacctttgaaggacatgaagctcctgtttattcagtttgtccgcattacaaggaaaatattcagttcatcttctcaactgctttagatggaaagatcaaggcttggctatatgataatttgggatctagagttgactatgatgcaccaggtcactggtgcactacaatggcatatagcgcggatggttcaagattgttttcgtgtggaactagcaaggatggtgaatcacatctagtcgaatggaatgaaagtgaaggagcggtgaagagaacataccagggattccgcaagcgatccatgggtgtcgtgcaattcgataccacccgcaacaggtttttggctgctggagatgaattcttgattaagatatgggacatggacaacacaggtcttctgactactattgatgctgatggtggtttacctgcaagcccacggatacgcttcaacaaggaggggactctgttggctgtttctactcttgacagtggtatcaagatattagcaaacgctgatggacttaggttattgcgcacgttagaaaatcgttcttttgacgcttctcgtaatgcagctgagactgtaacaaagcctctaataaatccattgactgctgcggcaaatgcggctgcagcaagtagctcaggaactcctgctccagcagctataactgcaatgaatggtgatagcagaagtttggttgatgtaaaacctagaatagctgatgagtcattggacaagtcaaaggtatggaaacttatggagattactgagtcaactcagtgcagatctatt

SEQ ID NO: 24883 - protein, 759 aa, Panicum virgatum
  misc_feature: Ceres CLONE 1861103
  misc_feature (447)..(487): Pfam Name: WD40 Pfam Description: WD domain, G-beta repeat
  misc_feature (491)..(531): Pfam Name: WD40 Pfam Description: WD domain, G-beta repeat
  misc_feature: SWISSPROT Homolog: EC 2.7.11.7 [Myosin heavy-chain] kinase
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSIPKPGGFPPLGAHGPFQTAPTVPPLAGWMSNPPAVTHPAVSGGAIGFGTPTNPAALLKHPRTPTTANPSMDYPSGDSDHISKRSRPVGIAEEQVNLPVNMLPVTYPQSHNYQQDDFHKTVARTLTQGSAPMSMDFHPLQQTLLLVGTNVGDIGLWDVGTKDRLVVKNFKVWELGKCSMALQASLVKDPSVSVNRIIWSPDGTLFGVAYSRHIVQIYSYHGGDDIRQHLEIDAHVGGVNDIAFAHPNKQLCIITCGDDKTIKVWEATSGAKQFTFEGHEAPVYSVCPHYKENIQFIFSTALDGKIKAWLYDNLGSRVDYDAPGHWCTTMAYSADGSRLFSCGTSKDGESHLVEWNESEGAVKRTYQGFRKRSMGVVQFDTTRNRFLAAGDEFLIKIWDMDNTGLLTTIDADGGLPASPRIRFNKEGTLLAVSTLDSGIKILANADGLRLLRTLENRSFDASRNAAETVTKPLINPLTAAANAAAASSSGTPAPAAITAMNGDSRSLVDVKPRIADESLDKSKVWKLMEITESTQCRS

SEQ ID NO: 24884 - DNA, 745 bp, Panicum virgatum
  misc_feature: Ceres CLONE 1861103-R
gagcaaaagaacagatttttgcagataccatcaggtcgcccatccaacatcctagacactcgtgttcagttccaccaagatcaaatgcacttccttgttgtgcatgaaacccagattgccatctatgatactacaaagctagaaccggttaaacagtggcctgttcgagagaattcacctccaataacacatgcgacattctcgtgtgatagtcaattgatctatgcaagctttatggatgctactgttggtatatttaatgcatcaagtttgagactccaatgtcgaattcttccagcttcatatcttcctccaaacatcagttcaagtgttcatcctgttgtggttgcggcacacccttcggaagcaagccagtttgctctaggattgacagatggtggtgtttatgtattggaaccgttggaatcagagagaaaatggggaaatcctccaccagcggagaatgggtccacgagcaacttgtccacaccacctaatggagcttcaagttcagatcaaccagaaagataataagaagttgaactagtagagtttttgtggcatgagtcactaaccaaggtaacctttggattttagaagtgtggttaataaactgcaaccatttagttggaaatgtgattgtaggaatagttatgcaccaattttgttagcaaatttcctttattgtccaacaatgtttccttgatgtttggtgaataccaaaggaaaacgatcgcgaatgcag

SEQ ID NO: 24885 - DNA, 2144 bp, Panicum virgatum
  misc_feature: Ceres CLONE 1861105
  misc_feature: Encodes the peptide sequence at SEQ ID NO. 24886
gttggcaccatcagcaccataattgtgtgaggtggatatattgtgtgccttgctctgaacctagccaaacacttgggactctccggtctccaccaagaacaaatttctggtgaaaatgttgccccacactacgtattaagctccatccatatatagcatcatcgcatcaggcaacactggcaggagagaaatcatgaatcctgcataaaacctccaacattccagttgccagctctaaaaccaacaccatcagctggaagcccacacaaaccataaagaatgcatccatccagttcaattctacgtattctgcaacgtgtagaatcatatgtagccacaaatctctcatcatcgcatttggaggcagcaaggatcattgaggagaaatttctgaagctccttggatttctgtccacgaagctttctaccatgtccagatgtgtgacacaattcatcacacactctttctggcgtctggttttccaaagcaatccttttgtagttcaactcatttacttcgtggcaatctcctttgctggttttcttgctctgaagagtctcaacccgcatgggaagccagttccaagggattttgacctgatgttcacctctgtgtccgcagcgactgtctcaagcatgtcgacaattgagatggaggacttatctgaccagcagctctgggttctgatccttctgatgctattaggaggggaagtgttcacctcaatgctagggcttcatttgaacaatgcaaaggccaacaaagaagtgctttcccaaagaagcttgagttcaatcaggagggaaatcgagatcagcatttctgccaacaacatagatcagattgatatggaatgtggccaatcagaagctgttatatcacacaaccaggtacagcaaaccaaaagcacaagacatagttctcgcactatcttggcccacatagtgacaggttattttttagctagtgttgtgtgcagctctgtagtcattattatttacttttggcttaactcagatgcaaggcaagtcctacacagtaaagatatcaaaatatgcacctttgccatcttcacagcagtgtcctcatttgcaaactgcgggttcactccactaaacagtaacatgcaagctttcacaaacaactccgttcttttgcttctagtgatcccccaaattctagcaggcaatactttattttcaccactcctaaggttaagtgtgtgggccttagggaaactcagcggagaacaagagtacactcgcatccttcagcatcctgaggagactggatacaagcatttgcccacacagcggaactctgtttacatctttctcacagtaacagggctgattttgttgcaagttatatctcttttctcttttgagcggggttcaaaggcctttggaagaatgaactggtttcagaaattggtaggctcattgtttcagagtgtcagtacaagacaagccggggaagctgtccttgacatctcaaccttctcatcaccaactttgttgctatttgcaatagtcatgtaccttccttccaatatatcatttctcccaatcaatagtgataaacagcccttggcagataaaaaaccgagtcgaagagcaatgtggaaggatttcagcattaccagccctgcatgcctcgcattattcacatttttggcatgtataactgaaaggaagtcaatgtctgccgatccactaaatttcaatgtcttcagcatgatgtttgaagtgatcagcgcgtttggcaatgtagggtactcgctaggctacagttgtgagaagatgatgaaacctgatgccacatgcaaagctgcttcgtatgggtttgtcggctggtggaccgacgaaggaaagctgataattatcctggtgatgttcgtcgggaagctcaagaagttcatcatcaaagaggaaaaagattgactgtgcacgcacaacaccacatcagagggtggagactgcccgattacaagaatcatgaggtagtggatcggctaaatccagagccttgccatcttgtgcatcgcatggagaaagattgcctgagcagcaattccatcagtacaaaaatgcaagagattcatcagatattcagatgaatgaatgaagaaatcacatgtgtc

SEQ ID NO: 24886 - protein, 554 aa, Panicum virgatum
  misc_feature: Ceres CLONE 1861105
  misc_feature (192)..(552): Pfam Name: TrkH Pfam Description: Cation transport protein
  misc_feature: SWISSPROT Homolog: EC 3.6.3.14 H(+)-transporting two-sector ATPase
MHPSSSILRILQRVESYVATNLSSSHLEAARIIEEKFLKLLGFLSTKLSTMSRCVTQFITHSFWRLVFQSNPFVVQLIYFVAISFAGFLALKSLNPHGKPVPRDFDLMFTSVSAATVSSMSTIEMEDLSDQQLWVLILLMLLGGEVFTSMLGLHLNNAKANKEVLSQRSLSSIRREIEISISANNIDQIDMECGQSEAVISHNQVQQTKSTRHSSRTILAHIVTGYFLASVVCSSVVIIIYFWLNSDARQVLHSKDIKICTFAIFTAVSSFANCGFTPLNSNMQAFTNNSVLLLLVIPQILAGNTLFSPLLRLSVWALGKLSGEQEYTRILQHPEETGYKHLPTQRNSVYIFLTVTGLILLQVISLFSFERGSKAFGRMNWFQKLVGSLFQSVSTRQAGEAVLDISTFSSPTLLLFAIVMYLPSNISFLPINSDKQPLADKKPSRRAMWKDFSITSPACLALFTFLACITERKSMSADPLNFNVFSMMFEVISAFGNVGYSLGYSCEKMMKPDATCKAASYGFVGWWTDEGKLIIILVMFVGKLKKFIIKEEKD

SEQ ID NO: 24887 - DNA, 2603 bp, Panicum virgatum
  misc_feature: Ceres CLONE 1861116
  misc_feature: Encodes the peptide sequence at SEQ ID NO. 24888
aagaacagcaaccgcgaggacccttctccccatcctctccaaagaatctcccctacacaaacacaacaagcaagggggagggagagagggaggagagaggcggcggccggcggggagctggcaggcctgcagcgcgcgcgcgcgcgggggcagctagctccatccgccggcaaacggcgcccgtgatcgagccgtaggcgcggtaaaaggcgcgcctttttctgccttggggggtcgcgcggcgcgagccgatggggttcgagggggcggccggcgggatgggcggaggggtccgggcgctgatgcgccggaagcaggtggactccgagcgggcgcgccccgccggcagcagcaaccagctccgcaaggagctctccgtcgcccagctcatcaccatcggtgttggttcaacgattggagctggggtgtatgttcttgttgggacagttgctcgggagcattctgggccagcattgactctttcatttctgatagccggaatagccgctgcactatcagcgttctgttatgcagagcttgcaagccgctgcccatctgcaggaagtgcctaccattattcatacatctgcgttggtgaaggagttgcatggttgattggttgggctctgatacttgaatatacaattggtgggtcagctgtcgcccgtggcatatctcccaatttagccctatttttcggaggagctgatggtctgccatggatcttagctcgacacgagatcccatggcttgatgttgttgttgatccttgtgctgccttccttgttttccttgtcactggtctgctatgtgtggggatcaaagagagttcatttgtgcaaggagttgtgacagtcctgaattgctttgtgatgctatttgttattattgctggtagttacatcggctttcaaacaggatgggttggctacaaggttgccggcggatttttcccttttggggcaaatggaatgcttgctgggtcagcaactgtcttctttgcctacataggctttgattcagttgccagcactgctgaggaggtgaaaaatccgcaacgagatctgccattgggaatcgcaacagcattgtcgatatgctgttccttgtacatgttggtttcagttgttattgttggtcttgtaccatactttgctatggacccagatacccctatttcatctgcctttgcaaaacatgggatgcactgggcaatgtatctggtaacaactggtgctgttcttgctctttgttcaacattgatgggatctatattgccacagccaagaatattgatggccatggcacgagatggcctgttaccatcattcttctctgatgtccacaagacgacacaagttccagtcaaaagcacaatcgtcactggcatctgcgcagcttctctcgctttcttcatggatgtctctcaactggctggcatggtcagtgttggcacgctcctagccttcactacagttgctgtgtccatcttgattctcaggtatgttcctccggatgaggtacccctgccatcttccctgcaagcatcattccgtctgagccacgaaaacgatgaggaaaagctgagggatactcttggatatgaggatcatgaagaaggggcatctgagattagtgatgttgtagtagaatcaattaaggacccccttattgagaagcagctatatgcaagcaagttggatgagacaaagcggcgcaagactgctgcttgcagcattgcatctgtctgcataggggttctggttctcacaacttcagcctctgcgacattcttgcccttcctggtgcgatgctttgtttgtgcttttggtggcctgctcctcctaactggtctgggcatgctctgctggattgaccaagatgacgggaggcattcctttggtcattctggaggattcatctgcccattcgttccattgctgccagtgatgtgtatcctgataaacacatacttattgataaatctgggtggtggcacatggatgcgagtgggggtgtggctggtgatgggggtgtttgtgtacattttctatgggcgcacccacagctcattgacggatgtcgtgtacgtccctgttgctgatgcgaatgagaaatacgggtcatcatctgcatcagggtttgtggcctaaggggagatggaaggagacattgttgaagcctatctttaggtattacatgctccagggtactttttgcagaaccttgaggaatcagactggagcagatcccagcttgagcaaaatgcattgcaggcgggtttgaagaattcaatttatatgtcaatttttttaaatgtgcatgtgtaaattgtaatgcacgtctatgcttgtgtgcctctgttggaggaatgtaaatattacatagataataggtgtgattgttatgatggtttttggcaaaagggtgttgctataggaatttgtacggttagtaaaaatatgttccgaattcaaaggtggagttataatctccaacacaaatagggctgatgtaaggtttataatgtgctgaaagccccgaacacgttttataccataatggacaataccaagtggtcttgtaggaggcaactccactag

SEQ ID NO: 24888 - protein, 633 aa, Panicum virgatum
  misc_feature: Ceres CLONE 1861116
  misc_feature (45)..(496): Pfam Name: AA_permease Pfam Description: Amino acid permease
MGFEGAAGGMGGGVRALMRRKQVDSERARPAGSSNQLRKELSVAQLITIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGADGLPWILARHEIPWLDVVVDPCAAFLVFLVTGLLCVGIKESSFVQGVVTVLNCFVMLFVIIAGSYIGFQTGWVGYKVAGGFFPFGANGMLAGSATVFFAYIGFDSVASTAEEVKNPQRDLPLGIATALSICCSLYMLVSVVIVGLVPYFAMDPDTPISSAFAKHGMHWAMYLVTTGAVLALCSTLMGSILPQPRILMAMARDGLLPSFFSDVHKTTQVPVKSTIVTGICAASLAFFMDVSQLAGMVSVGTLLAFTTVAVSILILRYVPPDEVPLPSSLQASFRLSHENDEEKLRDTLGYEDHEEGASEISDVVVESIKDPLIEKQLYASKLDETKRRKTAACSIASVCIGVLVLTTSASATFLPFLVRCFVCAFGGLLLLTGLGMLCWIDQDDGRHSFGHSGGFICPFVPLLPVMCILINTYLLINLGGGTWMRVGVWLVMGVFVYIFYGRTHSSLTDVVYVPVADANEKYGSSSASGFVA

SEQ ID NO: 24889 - DNA, 547 bp, Panicum virgatum
  misc_feature: Ceres CLONE 1861127
  misc_feature: Encodes the peptide sequence at SEQ ID NO. 24890
aaaaaaattgtaatctaccgtacaaagctcaaagtgtacatccatacatgtgaatacttgcgtcccatcccattatcccatatagagcgtacaggggacatcactgacgagcaagatcgctgcacgctgcgttggagcgagatgattgccacgggcagctcggcgaagaaggcggcggcggcggccggggcggtgggcggcaaggcggcgcgggcctgcgacgggtgcctgcgccggcgggcgaggtggtactgcgcggcggacgacgcgttcctgtgcaaggggtgcgacacgtccgtgcactccgcgaacccgctcgcgcggcgccacgagcggctgcgcctgcgcccgacgtcgccgctgcgcgcgccgccgcccgcgggggaggcgaagcgcgagccccgggacgaggtggtgcccgcgtggttcaagcgcaaggcgcgcacgccgcggggcgggcacgccaggagcctcgggcaggtgctgtcgcggcggctcgtcgtgccggaggcggcgggcggggactcgcccgacgggcggaacgggg

SEQ ID NO: 24890 - protein, 135 aa, Panicum virgatum
  misc_feature: Ceres CLONE 1861127
  misc_feature (21)..(68): Pfam Name: zf-B_box Pfam Description: B-box zinc finger
  misc_feature: The sequence is a functional homolog of SEQ ID NO 172 in the 10/225,068 US patent application
  misc_feature: The sequence is a functional homolog of SEQ ID NO 250 in the 10/374,780 US patent application
  misc_feature: The sequence is a functional homolog of SEQ ID NO 274 in the 10/225,066 US patent application
  misc_feature: The sequence is a functional homolog of SEQ ID NO 530 in the 11/435,388 US patent application
  misc_feature: The sequence is a functional homolog of SEQ ID NO 794 in the 10/412,699 US patent application
  misc_feature: The sequence is a functional homolog of SEQ ID NO 1522 in the 10/374,780 US patent application
  misc_feature: The sequence is a functional homolog of SEQ ID NO 1593 in the 10/412,699 US patent application
  misc_feature: Useful for making plants with altered alkaloid content
  misc_feature: Useful for making plants with altered lignin content
MIATGSSAKKAAAAAGAVGGKAARACDGCLRRRARWYCAADDAFLCKGCDTSVHSANPLARRHERLRLRPTSPLRAPPPAGEAKREPRDEVVPAWFKRKARTPRGGHARSLGQVLSRRLVVPEAAGGDSPDGRNG

SEQ ID NO: 24891 - DNA, 2036 bp, Panicum virgatum
  misc_feature: Ceres CLONE 1861143
  misc_feature: Encodes the peptide sequence at SEQ ID NO. 24892
tattactcgaagagttggcggtggctttggggggaaagctgttagatcattgcctgtggcgactgcttgtgcacttgcagcatttaagttgcgccgtcctgttcgaatgtatctggaccgcaaaaccgacatgattgtgagtggaggtcggcatcccatgaaaatatgctattcagtgggattcaagtcagatggaaagatcactgctttgcatatagctttgttcataaatgcaggaatgacaaaagatgttagcccggccattcctcacaatttcatcgaggcactgaagaaatataattggggtgccttttcttatgaagcaaaggtctgtaaaacaaacaccacaacgaagtctgcgatgcgggggcctggggaagtacaaggctcttatgtttctgaagctataattgagcatgttgcttctgcactctccactgatgctaatttggttaggcatagaaatcttcacacagttgagagcctttctttgtttcacaatgagtgcagtgaagatggcatgggttatacgcttccatctatatgtggtcaattgactgcatcagaaaactaccagcaccgtcttgaaatagtccagtctttcaacaaaaataacagatggaaaaagcgaggcctctcttttgtgccaattgtacacaaagtattatctcgaccgacacctggaaaagtgtctatccttaatgatgggtctattgttgttgaagttggaggcattgagttaggccaggggctttggacaaaagtgaagcagatggcagcatttggtcttggacaattgtggactgatggaactcaagagttgtcagacagaataagagttattcaagcggatacattgagtaatgtacagggagggtggaccacagggagtacaacatcagaatctagctgtgaagcagttcatcttgcctgcaatatcttggttgacaggctgaaatcagtcaaggagcaatttcaagaaaagcaaagcagcctttcattggatgaacttatttccaaggcaaaaatagttggtgtggacttatcagcacgagaatactacattccagggccttctggttcttatctaaactatggagctgctgctagtgaggttgagattgatcttctcactggggccaccactattttgcgaagtgatcttatatacgactgtggccagagcttaaaccctgccgtggacttggggcaggttgaaggggcatttgttcaaggaattggctatttcatgagcgagggatatgtcaccaactcagatggattggttatctcagacgggacatggacatacaagatcccaactgtggacaccatcccaaaacagttcaatgttaagctgcttaatagtggattccacaagaatcgggtgctctcttcaaaarcatctgggggagccaccttttgcttcttgccactttcggtgcactgtgcgacaagagaagcaattagagcagcaaggaagcaaccccacttctctgattctggaccttcttcacaatcccattttgatctggaggttcctgccatcatgcccgtggtgaaggagctctgcagcttggacaatgtggagaggtacttggagagcttgctgatctccaaatgaagaaccaatccaagtcagcacctgttttcaccaactttccttagctgtgtaaaaccactgtagttacgttattgcacggttcgtcatgttccaaagttcaaagagaagataggttcatagctgtagatagcagggatcgtcagaagttgcaaatttcggttatctgaatatagcagttgtgttgagtgatcaatgcagcatagatgctattatagttcacacaggagtcagggatatcatagaagataacagaggacgacatacttgcagcgatggaactgagactgttttctatgtctttttggcttccgaatgtgcatcgttgaaatagagtataggaccataccacaagaggatcagttttgagtcattatataaaaagaacatccgtgtgtttcttttattcacatag

SEQ ID NO: 24892 - protein, 540 aa, Panicum virgatum
  misc_feature: Ceres CLONE 1861143
  misc_feature (1)..(446): Pfam Name: Ald_Xan_dh_C2 Pfam Description: Aldehyde oxidase and xanthine dehydrogenase, molybdopterin binding domain
  misc_feature: SWISSPROT Homolog: EC 1.2.3.14 Abscisic-aldehyde oxidase
  misc_feature (468)..(468): Xaa is any aa, unknown, or other
ITRRVGGGFGGKAVRSLPVATACALAAFKLRRPVRMYLDRKTDMIVSGGRHPMKICYSVGFKSDGKITALHIALFINAGMTKDVSPAIPHNFIEALKKYNWGAFSYEAKVCKTNTTTKSAMRGPGEVQGSYVSEAIIEHVASALSTDANLVRHRNLHTVESLSLFHNECSEDGMGYTLPSICGQLTASENYQHRLEIVQSFNKNNRWKKRGLSFVPIVHKVLSRPTPGKVSILNDGSIVVEVGGIELGQGLWTKVKQMAAFGLGQLWTDGTQELSDRIRVIQADTLSNVQGGWTTGSTTSESSCEAVHLACNILVDRLKSVKEQFQEKQSSLSLDELISKAKIVGVDLSAREYYIPGPSGSYLNYGAAASEVEIDLLTGATTILRSDLIYDCGQSLNPAVDLGQVEGAFVQGIGYFMSEGYVTNSDGLVISDGTWTYKIPTVDTIPKQFNVKLLNSGFHKNRVLSSKXSGGATFCFLPLSVHCATREAIRAARKQPHFSDSGPSSQSHFDLEVPAIMPVVKELCSLDNVERYLESLLISK

SEQ ID NO: 24893 - DNA, 628 bp, Panicum virgatum
  misc_feature: Ceres CLONE 1861145
  misc_feature: Encodes the peptide sequence at SEQ ID NO. 24894
ctagccattcccgtcctctcccgcgccgccgccgccgcttttgccctcctcgcggtccggccgtccgtcgaggtaaggtcagcatggtgagggtcagtgtgctcaacgatgcactgaagtccatgtacaatgctgagaagagggggaaaagacaggtcatgatcaggccgtcatccaaggttatcatcaagttcttgttggtcatgcagcgtcatagctacattggtgagttcgaatatgtggatgaccaccgtgctggaaagattgtggtggaactgaatggaagactaaacaaatgtagacagcaaccaccaggggagagaaggggaagggcggcgagggaggcctccgtctcgtgtcccttcctcctcctccttctcctccccttctctctccgattctccatccatccattcccctcgcacggtcgcattgttcttgatccgatccggttccggcctcgccgaagaacagggttagaaggaagagaaaaagaaaggctagggatccatgggatgcttttcatgctgctccgtggcggacgatgacggtggcaggaggaagaaagacgatgactatatccctctccctgctcaagtcagtaacaatggacctagccggcccccag

SEQ ID NO: 24894 - protein, 154 aa, Panicum virgatum
  misc_feature: Ceres CLONE 1861145
  misc_feature (5)..(90): Pfam Name: Ribosomal_S8 Pfam Description: Ribosomal protein S8
MVRVSVLNDALKSMYNAEKRGKRQVMIRPSSKVIIKFLLVMQRHSYIGEFEYVDDHRAGKIVVELNGRLNKCRQQPPGERRGRAAREASVSCPFLLLLLLPFSLRFSIHPFPSHGRIVLDPIRFRPRRRTGLEGREKERLGIHGMLFMLLRGGR

SEQ ID NO: 24895 - DNA, 719 bp, Panicum virgatum
  misc_feature: Ceres CLONE 1861151
  misc_feature: Encodes the peptide sequence at SEQ ID NO. 24896
ccctcttctttaccgctgccgaccactgccgccaccaccagcaccgccccacctcgcgcttgcagctgccacgggtgctaggtagcccgccggagccgccgccgccgcgcccatggcctccgtggcggccacctccacgctggccccggccctcgccgcccggcggcgccgggcgcggccagggatggcgctgctaccgccgcgccggggcgcggtcgtgcggtgctcgctcgaaagcaacgtctccgacatgggcgtcaacgctccaaaaggattgttcccacctgaaccggagcactacagggggcccaagctcaaggtggccatcataggggcaggcctcgcaggcatgtccactgccgtcgagcttttggaccagggccatgaggttaacttgtacgagtcccgaccatttattggtggcaaggttggctcatttgtcgataggcaaggaaaccatatcgagatggggctgcacgtgttcttcgggtgttacagcaatctgttccgcctcttgaagaaggttggtgctgataataatctgctggtgaaggaacacacacatacttttgtaaacaaagggggcgcggttggtggtatgttcagcgttcatatactcatcaatcttgttgtggaacagtgctcttatgttgcaatgttttactattcttaattgtttgggaattgttctatgtctatagtgcaattacttctagtgt

SEQ ID NO: 24896 - protein, 186 aa, Panicum virgatum
  misc_feature: Ceres CLONE 1861151
  misc_feature: SWISSPROT Homolog: EC 1.14.99.30 Carotene 7,8-desaturase
  misc_feature: Useful for making plants with modulated biomass
  misc_feature: Useful for making plants with modulated flowering time
MASVAATSTLAPALAARRRRARPGMALLPPRRGAVVRCSLESNVSDMGVNAPKGLFPPEPEHYRGPKLKVAIIGAGLAGMSTAVELLDQGHEVNLYESRPFIGGKVGSFVDRQGNHIEMGLHVFFGCYSNLFRLLKKVGADNNLLVKEHTHTFVNKGGAVGGMFSVHILINLVVEQCSYVAMFYYS

SEQ ID NO: 24897 - DNA, 3037 bp, Panicum virgatum
  misc_feature: Ceres CLONE 1861152
  misc_feature: Encodes the peptide sequence at SEQ ID NO. 24898
ctccccatctccgcctcgccgctacctttcccttccctcccacctcgcgctcctccaccttcctgcccctcctccgccgcggctcggcaagcaacagctccccaccgacccgccgccgccgccgccgccacgcctcccaccaccatggcgtcgggcggccgcgctctcgccccgaggccatgactcggcgccgcccgtggccgtggctctccgtctcctccctctccctgcgacgacaacccctcccgttcctccccctcctccttgggcggcggtagatggcggcggcgatggtggtgggcggggccggcaaggaccgctcctcgcctggcggcggcggggcgccgcaggtggacacgggcaagtacgtgcgctacacccccgagcaggtcgaggcgctcgagcgggtctacagcgagtgccccaagcccagctcgctgcgccggcagcagctcatcagggagtgccccatactcagcaacatcgagcccaagcagatcaaggtctggttccagaaccgcagatgccgcgagaagcagcggaaggaggcctcgcggctgcagactgtgaaccggaagttgactgctatgaacaagctgttgatggaggagaatgacaggctgcagaagcaggtgtcccgtcttgtttacgagaatgggtacatgaagcagcagctccataatccttctgttgcgactacagacacgagctgtgagtctgtggtcacaagtggtcagcaccaccagcagcaaaacgcagcagctccgcgtcctcaaagggatgcgaataacccagctggtctactcgctattgctgaggagaccttggcagagttcctgtcgaaggccacggggactgctgtcgattgggtgcaaatggttgggatgaagcctggtccggattccattggaatcatcgctgtttcgcacaattgtagtggcgtagcagcccgagcttgcggcctagtgagccttgagcccacaaaggtcgcggagatccttaaggatcgcccctcttggtaccgcgactgccggtgtgtggatatcctccatgttatccctacgggtaacggtggaactatcgagcttatctacatgcagacttatgcaccgacaactttggcggcaccgcgcgacttttggactctccgttacactagtggtcttgaagatggcagtcttgtgatctgtgagaggtcattgacacaatcgactggaggcccatcaggacccaacactccgaattttgtcagagccgaagtgcttcctagtggctatttaattcgaccgtgtgagggaggtggctccatgattcacattgtggatcatgttgacttagatgcttggagcgtgcctgaggtccttcggccactttatgaatctccaaagattctcgcccagaagacaactattgctgcactgcgtcacattaggcaaattgcacatgaatcaagtggggaaatgccttatggaggtggccgccagccagcagttctgagaacattcagtcagaggctcagcaggggattcaatgatgctgtcaatgggtttccagatgatggttggtcactgatgagcagtgacggttctgaggatgttaccattgctatcaattcctctccaaacaaacttgttggatctcatgtcaactcctcccagctgttttcggcaattggaggtggcatcttatgtgcaaaggcatcaatgctgctacagaacgtgccacctgctctactagtgcgatttctgagggagcatcgctctgaatgggctgatcctggcgttgatgcttattctgctgctgctttgagggctagtccatatgcagttcctggcctgcgagctagcggttttatgggcagtcaggttatactgccactagcacacaccttagaacatgaagagttcctggaggtcattaggcttgagggacacagcctatgccatgatgaagttgttctatcaagagatatgtatcttctgcagttgtgcagcggtgtggatgaaaatgcagctggtgcatgtgcccagcttgtctttgcacccattgatgaatcttttgctgatgatgcaccacttctaccctcaggcttccgtgtcataccactggatgccaagatggatccaccgtctggcacacgaacacttgacctagcatctactcttgaggttggatccggtgggactactcgtgcttccagtgacgcatccagcacctgcaacacaagatcagtcctgaccatcgctttccagttctcatatgagaaccatcttcgagaaagcgtcgcggcaatggccaggcaatatgtcaggactgtggtggcatcagtccagagggtggccatggcaatagctccctctcgtcttggtggacagcttgaaatgaagcaaactcctggatctcctgaggcgcacacgcttgcaaggtggatcggcaggagctacaggttccacactggagctgaactacttcgtgctgacacccaatgcacggatgcttccttgaaagcactctggcaacactcggactctatcatgtgctgttccctgaaggctgctcctgtgtttaccttcgccaaccaagccggccttgacatgctggagacgaccctgattgctctccaggacatctcactggagaagatcctggacgatgacggccggaaggcactttgcaccgaataccccaagattatgcaacagggcttcgcatacctccctggcggtgtctgcgtgtcgagcatgggtcggcctgtgtagcaagcggtggcgtggaaggtcctgagcgacgacgacaccccgcactgccttgccttcatgttcgtgaactggtccttcgtgtgagaaaaaccctagtcgagtctgccatttctcaagaacttgtctgtatccatgtaccgtcgcttttgcctgtgtcatgagtcatgacaaactatgaaacgcatctcccaagttcatcctgtggacacaaactgcttgtagctgtccgtctttgctttgcttgcttgtgctatctatgatggatcgttgtttgtttc

SEQ ID NO: 24898 - protein, 826 aa, Panicum virgatum
  misc_feature: Ceres CLONE 1861152
  misc_feature (177)..(387): Pfam Name: START Pfam Description: START domain
  misc_feature (709)..(826): Pfam Name: MEKHLA Pfam Description: MEKHLA domain
  misc_feature (29)..(87): Pfam Name: Homeobox Pfam Description: Homeobox domain
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
MAAAMVVGGAGKDRSSPGGGGAPQVDTGKYVRYTPEQVEALERVYSECPKPSSLRRQQLIRECPILSNIEPKQIKVWFQNRRCREKQRKEASRLQTVNRKLTAMNKLLMEENDRLQKQVSRLVYENGYMKQQLHNPSVATTDTSCESVVTSGQHHQQQNAAAPRPQRDANNPAGLLAIAEETLAEFLSKATGTAVDWVQMVGMKPGPDSIGIIAVSHNCSGVAARACGLVSLEPTKVAEILKDRPSWYRDCRCVDILHVIPTGNGGTIELIYMQTYAPTTLAAPRDFWTLRYTSGLEDGSLVICERSLTQSTGGPSGPNTPNFVRAEVLPSGYLIRPCEGGGSMIHIVDHVDLDAWSVPEVLRPLYESPKILAQKTTIAALRHIRQIAHESSGEMPYGGGRQPAVLRTFSQRLSRGFNDAVNGFPDDGWSLMSSDGSEDVTIAINSSPNKLVGSHVNSSQLFSAIGGGILCAKASMLLQNVPPALLVRFLREHRSEWADPGVDAYSAAALRASPYAVPGLRASGFMGSQVILPLAHTLEHEEFLEVIRLEGHSLCHDEVVLSRDMYLLQLCSGVDENAAGACAQLVFAPIDESFADDAPLLPSGFRVIPLDAKMDPPSGTRTLDLASTLEVGSGGTTRASSDASSTCNTRSVLTIAFQFSYENHLRESVAAMARQYVRTVVASVQRVAMAIAPSRLGGQLEMKQTPGSPEAHTLARWIGRSYRFHTGAELLRADTQCTDASLKALWQHSDSIMCCSLKAAPVFTFANQAGLDMLETTLIALQDISLEKILDDDGRKALCTEYPKIMQQGFAYLPGGVCVSSMGRPV

SEQ ID NO: 24899 - DNA, 709 bp, Panicum virgatum
  misc_feature: Ceres CLONE 1861169
  misc_feature: Encodes the peptide sequence at SEQ ID NO. 24900
gtggcgctcctcccggtcccggccgcctcctctcctctcttccctcgtctcgcggtcgcgcccagagccgagaggaggaacaggcagggagattccacgcgcccggcagttacgataccgcgccgcagattccctcgtcgctgctcccccaagccctcccgcaccagcagcgccgccgccctccgccgccggctctccagtccagtccaggataggaggcctctgactctctgagctgcacaccatctgagcgacgccatgggagaggtcgcagacatgtacacccaagacgggaccgtcgacatgaagggcaacccggccgtgaagaagggcaccggcaactggcgcgcctgcccttacatcctcgcgaacgagtgctgcgagaggctggcgtactacggcatgagcaccaacctggtgaactacatgaagacccgcctcggccaggggaactccgtcgccgccaacaacgtcaccaactggagcggaacgtgctacatcacgccactcatcggcgcattcttggctgacgcctacatggggagatactggaccatcgccagcttcatgatcatctacatcattgggctggtgccgtcgtgcgacggcagcgggacgtgccacccgacggagtcgcagtcggcggcggtgttcgtggcgctgtacctgatcgcgctggggacgggcggcatcaagccctgcgtgtcgt

SEQ ID NO: 24900 - protein, 150 aa, Panicum virgatum
  misc_feature: Ceres CLONE 1861169
  misc_feature: Useful for making plants with altered carbon content
  misc_feature: Useful for making plants with altered nitrogen content
MGEVADMYTQDGTVDMKGNPAVKKGTGNWRACPYILANECCERLAYYGMSTNLVNYMKTRLGQGNSVAANNVTNWSGTCYITPLIGAFLADAYMGRYWTIASFMIIYIIGLVPSCDGSGTCHPTESQSAAVFVALYLIALGTGGIKPCVS

SEQ ID NO: 24901 - DNA, 716 bp, Panicum virgatum
  misc_feature: Ceres CLONE 1861170
  misc_feature: Encodes the peptide sequence at SEQ ID NO. 24902
aaaaagccacaccaggggagcttgcattgggagcaactccaatggaagaccaccaccactacctctaccttggattagctctcgtctcgctgctcgtcatcatgctgggcaagcgccgccggcgctccgccatggcgaacgggcacggcctgcggctgccacccgggccatggcagctgccaatcatcggcagcctgcaccacatgatcggcaagctcccgcaccacgccatacgtgacctcgcgcggcgccacgggccgctcatgctgctccggatcggcgaggtgcccacgctggtggtgtcgtcccgggaggcggcgcgggaggtgatgaagacgcacgacacggtgttcgcgacacggccgctgagccccagctttcgcgcgctcaccaacggcggccggggaatcatcatggcgccctacggggcacactggcggcagctccgccggatcaccgtcaccaagctcttcagcgcgcggcgcgtcctctccttccgcgccgtccgcgaggaggaggccgccaccatgctgcgcgcgtgcgccgccgcggcggcggggtctcgcgccgtggacatgcgcgagcggctgtccgcgctcatcacggacaccacgatgcgcgccgcgatgggcgaccggttcaaggaccgcgaggtcttcctgcgtgcgctcgaccgcgtcattgtgctcgctgccgggttcaacatgggcgacctg

SEQ ID NO: 24902 - protein, 224 aa, Panicum virgatum
  misc_feature: Ceres CLONE 1861170
  misc_feature: SWISSPROT Homolog: EC 1.14.13.68 4-hydroxyphenylacetaldehyde oxime monooxygenase
MEDHHHYLYLGLALVSLLVIMLGKRRRRSAMANGHGLRLPPGPWQLPIIGSLHHMIGKLPHHAIRDLARRHGPLMLLRIGEVPTLVVSSREAAREVMKTHDTVFATRPLSPSFRALTNGGRGIIMAPYGAHWRQLRRITVTKLFSARRVLSFRAVREEEAATMLRACAAAAAGSRAVDMRERLSALITDTTMRAAMGDRFKDREVFLRALDRVIVLAAGFNMGD

SEQ ID NO: 24903 - DNA, 1398 bp, Panicum virgatum
  misc_feature: Ceres CLONE 1861174
  misc_feature: Encodes the peptide sequence at SEQ ID NO. 24904
gatccataccgctcgctccacccgccacacccagtcacccaccgctcgtcgcgacgtcggcgccgcgtccactttccccaactcccactccacccaccaccgcccttgcccaaataatccgctccgccgcgatgctctccatctcctgcctcgccaagctcctcgccgtcctgctccggggcatcctcctccacctccacgccccgccggccatcccctcctccgcgcgctacttcttctccacctagcgcacccggctggccgcgccgcactcgcttcctccgatgcggggggctctccagagatctggcagcaacagcctggcctccctgctccgcgccgaccccgccgcggacgatgcggtggtcgccgacccccggaagcgtggcgagcgcgatggccgccgccgcgggagcgggagcaccagggggaggaggaggaggagaaggagctgcctcaggctgcccctcggcgcagccggcgcgtgccgcgtctgcgactgcgacgagatggactccgctgcgcccgcggcggccccgcgccggcgcggccccgcgggaaacgatgccgaaggcgaggaagacgaggaccgcgcgctgcagtgcttctcgtggaagaagggcggcgccgccgccgccagtgccgtgccgtacacgcaccggccgtcgggagctggcgccgatgcggcggctctggtcgtgaaggaggcggcgtccctggcggtgctcccggacgacgtgatggagatggtgctgggccggctgccgctggcctcgctcctggccgcgcggtgcgtgtgcaagcgctggagggacctcaccgtcgccccgcagttcctgcggatgcgccgcgaggagcaggggagcccggacccgcgccgggcgccgtggctgttcctattcggggtcgacggcgacgtcgggtggggcgccgcgcctgccccggccgtgcacgcgctcgacgtggccgcgcaccggtggcgccgcgtcggggcgggcgggctcaaggggaggtttctgttctccgtcgccggcgtcgggggcgacctctacgtcgtcggcggccggtccggtggctcggacgccggaggcaaggtgaagacccacaagggggtcctggtgttcagccctctcaccggctcgtggcggaaggcggcgcccatgcagaccgcgcggtcgcggccggtgctgggggtgttcgagatgtccgccatctgcagcattctccacgctcgcgccgagaaccatgcccggtggggcaggtccaagttgggaggcgcatccgccgtgtacgaggacccgcaccggctctccctgaggcgcctccggctcaaggacatgctgaacgaggacgccgactccacggagctcgcttggtctcgcgacgcatccgccggac

SEQ ID NO: 24904 - protein, 371 aa, Panicum virgatum
  misc_feature: Ceres CLONE 1861174
  misc_feature (143)..(190): Pfam Name: F-box Pfam Description: F-box domain
  misc_feature (242)..(294): Pfam Name: Kelch_1 Pfam Description: Kelch motif
MRGALQRSGSNSLASLLRADPAADDAVVADPRKRGERDGRRRGSGSTRGRRRRRRSCLRLPLGAAGACRVCDCDEMDSAAPAAAPRRRGPAGNDAEGEEDEDRALQCFSWKKGGAAAASAVPYTHRPSGAGADAAALVVKEAASLAVLPDDVMEMVLGRLPLASLLAARCVCKRWRDLTVAPQFLRMRREEQGSPDPRRAPWLFLFGVDGDVGWGAAPAPAVHALDVAAHRWRRVGAGGLKGRFLFSVAGVGGDLYVVGGRSGGSDAGGKVKTHKGVLVFSPLTGSWRKAAPMQTARSRPVLGVFEMSAICSILHARAENHARWGRSKLGGASAVYEDPHRLSLRRLRLKDMLNEDADSTELAWSRDASAG

SEQ ID NO: 24905 - DNA, 626 bp, Panicum virgatum
  misc_feature: Ceres CLONE 1861174-R
agtccgacacgctcgtcggctaccatctggacatgggctcctgggtcgtcgtccagacgtcccgcccgccgccgcggctccgcgactacgccccgacgctagcgtgctgcgcgtcgcggctcttcatgctctgcgtgtcgtggtacgacgaccgccgcgggccggtggaccggcgggagaaggtggtgcggaagctgttcgagctcgacctggcctcgctgcagtgggccgaggcggcggcacacccggacgcgcccatggaccccaacgcggcgttcgccgtcggccgggacaggatctacgccgtggagatgttcaggatcttcggcaaggtcctggatttcgtgacggcctgccgggtttcggacacggagcagaagtggagccggatcggccgggaaaacgcggcgacggaggccgacgccatgtcctgcaggctgaaatccatggccgtgctgcacctgtaattgcactgcatacgtctgattgttctttgtagcatagtctgtttgcacagatttgcatgtcttacagaaccatgttgcatcgcttgtagacgtcatagtggcaattcatactcatgttttccccactcaatttatacagtagatgacaagatttttttc

SEQ ID NO: 24906 - DNA, 1392 bp, Panicum virgatum
  misc_feature: Ceres CLONE 1861196
  misc_feature: Encodes the peptide sequence at SEQ ID NO. 24907
aggaccgccggaggaaaacttcggaggcgcccaacttccgagatacccactagctcccggcctcccaccgcgttcttttccccctttggctggtgctagaaagatgcgatttttttggctttggggccacttgttcttctgattcttacgccgcggacacccgcttggcttctcgtctggtgtctgttttctcgtgtttgaggtgatactggtctcgattccaaaatctgcaagcatcttctgcgtatgggcctggtagccgccctgtaggagacatgtatggacgaacttggggacgatccctagtctatctgtcaagcagccaaagtggtattggtgtgagccaaggctaaatagatacagcagttgatgaggagcttgttggattctgcaagggcttgctaaacttttgtccttcttcttgcgatctagaggcctgatatttttccatcagctgagccgtatttgcctaagtgcacagatagaggggtttattggattaagcaagaacaaggcctcccaattttgggattcgtaacaataccataagagtgaacaagtaaggaaccatttgatcctggggggacatggagaagcaatctagcacgcgacatggcccgctagaaaaactgaagagcttccgggggatagagaagcagagaagctttaagttcttgtccatggagaagcagcagagcttcaaaaggaacaaggacagccctgggaagcggggtgacaccgcactccaccttgcggcgagggctggcagtgttgcccatgtccagaagatccttgcggagtgcgacccagaactagtggtggagttagctgcccgccagaatcaggacggtgagactgcgctgtatgtgtctgctgaaaaggggcatgtcgaggttgtgggtgagattttgaaggcttctgatgttcaatcagcagggctcaaggccagcaacagcttcgatgcattccatattgcagcaaagcagggccatctggatgtcttgaaggagctgctgcaagcctttccctcattagctatgacaacaaattctgtaaatgccactgctttggacacagctgcaactcagggccacattgatattgttaaccttctgctagaaacagatgcaagccttgctaggattgcaagaaataatgggaaaacagttttgcattcagcagcaagaatgggccatgtggaggtggtcaccgcactgttgaataaggatccagggattagtttcagaacagataaaaaggggcagacagcgctacacatggcttcaaaaggccaaaatgccgaaattctgctcgagttgttgaagcctgatgtctcagttatccatgtggaagacagcaaggggaacagaccattgcatgttgcaactcgga

SEQ ID NO: 24907 - protein, 268 aa, Panicum virgatum
  misc_feature: Ceres CLONE 1861196
  misc_feature (190)..(222): Pfam Name: Ank Pfam Description: Ankyrin repeat
  misc_feature: SWISSPROT Homolog: EC 2.7.11.1 Non-specific serine/threonine protein kinase
MEKQSSTRHGPLEKLKSFRGIEKQRSFKFLSMEKQQSFKRNKDSPGKRGDTALHLAARAGSVAHVQKILAECDPELVVELAARQNQDGETALYVSAEKGHVEVVGEILKASDVQSAGLKASNSFDAFHIAAKQGHLDVLKELLQAFPSLAMTTNSVNATALDTAATQGHIDIVNLLLETDASLARIARNNGKTVLHSAARMGHVEVVTALLNKDPGISFRTDKKGQTALHMASKGQNAEILLELLKPDVSVIHVEDSKGNRPLHVATR

SEQ ID NO: 24908 - DNA, 710 bp, Panicum virgatum
  misc_feature: Ceres CLONE 1861239
  misc_feature: Encodes the peptide sequence at SEQ ID NO. 24909
aacgccaaggaagggaaaaatcagaaacttttttttttcgagatatttcggaagaggagggagtgcctgcctcgcaggctcgcagctcattcgccgagcgcacgagatcctctagagttttgcgcgttttgctgccaaatttcgtgggtgatttgcgcgtatggggggtcatgtcgcggtggatgttggggagctcgtggcgtcccgacccggcgaggcagcggggttggtgcccggcggcaaggaggaagccgaggcgctgattgggatggtggagtgccgcatttgccaggaggaggacctggccaagaacctcgagagcccctgcgcttgcaacggtagcctcaagtatgcccacagggaatgtgtgcaacgttggtgcaatgagaaaggagacataacctgtgaaatctgccatcagtcgtacaagcatggctacactgctccaccccaggtgcatcatgacgaaactaccatagagataagtggtggagattggaccatctctggcaaccgtttggatctacatgatcctagaatcttggcaatggctgctgctcaacaccgattgcttgaagatgagtatgatgagtatactgcaacaaacaacaacactactgcgttttgccgttctatatttctgattgtaagttttgttgtttctaagctagaaagatgtactctttttacctctattattttgaagtcat

SEQ ID NO: 24909 - protein, 183 aa, Panicum virgatum
  misc_feature: Ceres CLONE 1861239
  misc_feature (40)..(85): Pfam Name: zf-C3HC4 Pfam Description: Zinc finger, C3HC4 type (RING finger)
  misc_feature: Useful for making plants with altered lignin content
MGGHVAVDVGELVASRPGEAAGLVPGGKEEAEALIGMVECRICQEEDLAKNLESPCACNGSLKYAHRECVQRWCNEKGDITCEICHQSYKHGYTAPPQVHHDETTIEISGGDWTISGNRLDLHDPRILAMAAAQHRLLEDEYDEYTATNNNTTAFCRSIFLIVSFVVSKLERCTLFTSIILKS

SEQ ID NO: 24910 - DNA, 693 bp, Panicum virgatum
  misc_feature: Ceres CLONE 1861250
  misc_feature: Encodes the peptide sequence at SEQ ID NO. 24911
acaacccgcaccagcaccacggcggagttccaggggaaggtggggttcctggggctcgggatcatgggcgcgcccatggcgtccaacctcatcagggcgggctgcgacgttacgttgtggaacaggaccaagagcaagtgtgatcccctcctcagcctcggtgccaagtatgtacaatgtattcagcatagaacgcagcttcatccgattgttccttactgcattcaactacctagtactactactagtctacgacctactacaacgaatgcaatttctgaaattgttcaaaccttgttccctgataactgaaactggacctgtgcaaacggccgattggacagccacattcagagatcgagttctctcgttcccatttctccaatagcgttcagcattgttctttattcccgtttggaaaaatagattctgctacgcaaaattttgcactcaaaagtactactccctattcaaggaaccaagtaagacctttacagctacgatgaatttgctgtcagtggtactaggctaccaggcagcgtcatgttgctatccatgttgaccaacgacgagagcagtactctatttgaacgaaagatgcgcgcaacactttgcttgatttatgaggatgctgtcgtgctgcggcctgcagaatacagacgccactgctctctgttcatgtaaactcacatg

SEQ ID NO: 24911 - protein, 103 aa, Panicum virgatum
  misc_feature: Ceres CLONE 1861250
  misc_feature (11)..(98): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
TTRTSTTAEFQGKVGFLGLGIMGAPMASNLIRAGCDVTLWNRTKSKCDPLLSLGAKYVQCIQHRTQLHPIVPYCIQLPSTTTSLRPTTTNAISEIVQTLFPDN

SEQ ID NO: 24912 - DNA, 749 bp, Panicum virgatum
  misc_feature: Ceres CLONE 1861258
  misc_feature: Encodes the peptide sequence at SEQ ID NO. 24913
acacaagaacacgagcttgatctcacactagctagccactcgagagcgaccgagcgagcgagggggggggcgggagagagaggcagagctcgctcgtcacgggctagcctagctagacgacacagccagcggcgcgcgccagcagggagagacgacatgccggaggcgccgggcgccatgcgagaggcggcggcggcggcggcgcccgaggcgcaccgcgaggcgctcgagtacatcgagcgcgtgacggcgggcgcgggccaggtgcagcgccgcgtgctggcggagatcctggcgcagaacgcgccggccgagtacctgcgctgcctgggcgtctcgggggacgcgccgggcgccgccgaggcgttcctccgcgccgcgccgctcgtcacctacgaggacatcctccaggacgtcttgcgcatcgccaacggcgacacctcgcccatcctctccggcaagcccatccgggagttcctcaccagctccggcacgtcgggaggggagcggaagctgatgccgtcgatcgccgacgagatggaccggcgctcgctgctctacagtctgctgatgccggtcatgagccaggccgtgccggggctggacaagggcaagtgcatgtacctctacttcgtcaaggcggagtcgcgcacgccggccggcctcccggcgcgcccggtgctcaccagcttctaccggagtcgccacttcctggagcgcccgcacgacccctacaccgtgtacaccac

SEQ ID NO: 24913 - protein, 197 aa, Panicum virgatum
  misc_feature: Ceres CLONE 1861258
  misc_feature (22)..(197): Pfam Name: GH3 Pfam Description: GH3 auxin-responsive promoter
MPEAPGAMREAAAAAAPEAHREALEYIERVTAGAGQVQRRVLAEILAQNAPAEYLRCLGVSGDAPGAAEAFLRAAPLVTYEDILQDVLRIANGDTSPILSGKPIREFLTSSGTSGGERKLMPSIADEMDRRSLLYSLLMPVMSQAVPGLDKGKCMYLYFVKAESRTPAGLPARPVLTSFYRSRHFLERPHDPYTVYT

SEQ ID NO: 24914 - DNA, 705 bp, Panicum virgatum
  misc_feature: Ceres CLONE 1861287
  misc_feature: Encodes the peptide sequence at SEQ ID NO. 24915
gacttccagtcgttagcactgagttcagcgccagggtcgcttgaccctggcgttgatgtaaaagcgctgccaaggccattggatggtgatgaggagccagttaagcttttggaggcatacccattgaattgccacccgaggtacttccggctaacaacccatgcgattccggcatctcagtcattggtctccaggtggcatttgccccttggggctgtggtacaccctcttgcagaatcacctaatggggaggaagtgccagttatcaattttgggtcagcaggtgtcatccgttgtcgaagatgcaggacatatataaatccttatgcaacatttgcagatgctggaaggaaatggcgctgcaatctttgcaccttgctcaatgatgttcctggagagtacttttgtgctctggatgctagtggcagaaggtatgatactgatcaaagacctgaactctctaagggaacagtagagtttgttgctccgacagaatatatggtgcggccaccaatgccaccttcctatttctttcttattgatgtgtcagtatctgcagttcgaagtggattgcttgaggttgttgcaaagacaatcaaatcatgccttgatgaacttccaggctttccgcgaacacagataggattcttaaccttcgacagcaccttgcattttcataacttcaagtcttctttgtcacagcct

SEQ ID NO: 24915 - protein, 234 aa, Panicum virgatum
  misc_feature: Ceres CLONE 1861287
  misc_feature (95)..(134): Pfam Name: zf-Sec23_Sec24 Pfam Description: Sec23/Sec24 zinc finger
DFQSLALSSAPGSLDPGVDVKALPRPLDGDEEPVKLLEAYPLNCHPRYFRLTTHAIPASQSLVSRWHLPLGAVVHPLAESPNGEEVPVINFGSAGVIRCRRCRTYINPYATFADAGRKWRCNLCTLLNDVPGEYFCALDASGRRYDTDQRPELSKGTVEFVAPTEYMVRPPMPPSYFFLIDVSVSAVRSGLLEVVAKTIKSCLDELPGFPRTQIGFLTFDSTLHFHNFKSSLSQ

SEQ ID NO: 24916 - DNA, 737 bp, Panicum virgatum
  misc_feature: Ceres CLONE 1861287-R
  misc_feature: Encodes the peptide sequence at SEQ ID NO. 24917
tagggtacttcattgacaaaggtgtatccgctgctgctaaagtggttaggaaggcctatccacaagagaacgttggggtattcgttcaacgaggtcgcggtggacctctctctgtagttgagtacagtgaaatggatgcagctatgactactgaaattaatcaatcaacagggcgcctccgttattgttggagcaatatctgcctgcatatgttcactttggactttttgaaccaagtggcaaacagtcttgaaaaggacagtgtatatcatctagctgagaagaagattccttccatccatgggtatacaacaggcctgaagcttgaacagtttatattcgatgctttcacttactccccatctacagcactttttgaggtcatgcgggaagaggaattcgcaccagtaaagaatgccaacggcgcaacatatgacactcctgatagcgcaaaactcatgctgctccgtctccatagcagatgggttgtcgctgctggcggcttcttgacgcattctgtgcccttgtatatgacaggcgttgaagtttctccactttcctcctacgctggagagaacctggaagctatatgccgtgggcgaacattccatgcgccgagcgagatatcattttagatagggctgttcatgacggcaagagctgtgtaactgcaaaacgaatgtaagggattgattgcaggatgtgcatgtttcatttctaggcatgtggatgatccg

SEQ ID NO: 24917 - protein, 210 aa, Panicum virgatum
  misc_feature: Ceres CLONE 1861287-R
  misc_feature: SWISSPROT Homolog: EC 2.7.7.23 UDP-N-acetylglucosamine diphosphorylase
GYFIDKGVSAAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 24918 - DNA, 697 bp, Panicum virgatum
  misc_feature: Ceres CLONE 1861292
  misc_feature: Encodes the peptide sequence at SEQ ID NO. 24919
aaaaaaaattgtaatctaccgtacaaagctcaaagtgtacatccatacatgtgaatactcgcgtcccatcccatatagagcgtacaagggacatcactgacgagcaagatcgctgcacgctgcgttggagcgagatgatagccacgggcagctcggcgaagaaggcggcggcggcggcggccggggcggtgggcggcaaggcggcgcgggcctgcgacgggtgcctgcgccggcgggcgaggtggtactgcgcggcggacgacgcgttcctgtgcaaggggtgcgacacgtccgtgcactccgcgaacccgctcgcgcggcgccacgagcggctgcgcctgcgcccgacgtcgccgctgcgcgcgccgccgcccgcgggggaggcgaagcgcgagccccgggacgaggtggtgcccgcgtggttcaagcgcaaggcgcgcacgccgcggggcgggcacgccaagagcctcgggcaggtgctgtcgcggcggctcgtcgtgccggaggcggcgggcggggactcgcccgacgggcggaacggggaagaaggggaggtggaggaggaggaggagcagctgctctaccgcgtgcccgtctttgaccccgcccttgccgagctctgctcgccgccgcctcttgaggacgcagcggccgtcgcgtcgtcgtgcaacgaggacggcgccgtcgaggaacccgc

SEQ ID NO: 24919 - protein, 187 aa, Panicum virgatum
  misc_feature: Ceres CLONE 1861292
  misc_feature (22)..(69): Pfam Name: zf-B_box Pfam Description: B-box zinc finger
  misc_feature: Useful for making plants with altered alkaloid content
  misc_feature: Useful for making plants with altered lignin content
MIATGSSAKKAAAAAAGAVGGKAARACDGCLRRRARWYCAADDAFLCKGCDTSVHSANPLARRHERLRLRPTSPLRAPPPAGEAKREPRDEVVPAWFKRKARTPRGGHAKSLGQVLSRRLVVPEAAGGDSPDGRNGEEGEVEEEEEQLLYRVPVFDPALAELCSPPPLEDAAAVASSCNEDGAVEEP

SEQ ID NO: 24920 - DNA, 1281 bp, Panicum virgatum
  misc_feature: Ceres CLONE 1861293
  misc_feature: Encodes the peptide sequence at SEQ ID NO. 24921
atcccatcccaactcattaagcaaagcttcttcctctgtcgcggcgctccagctctgctctcccacactccacgagaccactttcccctcttccccttcagcgccgggcggaaaaccccccaacccccgaaagagaagctcccggctcccagtcgaacttaccctgccttccggcgtcctgcccacgccggcgcggcttttatttccacccaagattattattagcctccagctcaataagcccaattcatccagctccgtctcgatggaggccgatggcgccgctgccatcaacgacgcggtggaggaggtgcgccgcagaagcctccgcgagaggggctggaccatcaagcaggcgacggaggacatgcgcagcggggagtgggagcggcgtcgcaggctctaccgcacgctgcaggccaacgctgggctcgctgaggttgacccatgggatctcccgccgcgattcgccatgccgaaggagccggggagctcgagcctgcggacacaatctggatactggaaagagaaagaagatgagttcaaagcaatccgctcggatgtagggggaggagaaggctcgtcgtcggcttccagtagctcgccgtcctaccaagggcttaggaggaccctggagttttacgagcacaacggcaccaagacggactgggtcatgcacgagtacaacgtgctcaatggcgacaggaggatgtggtctttcgtaaggtattcaacaaaaaacacacagatcggagccccccttatttcaaggatgttgacatagccctggaagtttaccatgaatgcctcgccaagcacgccgaccaacaacgatcaccgcgtgcgcttgatgctatgattggtaggatgttgtcagtgtcctttgaatggatggaggagcatatgagtggttgtgaagaagcaggatctgagtgtggggagtttccaaccccgtctgctgatccagatggagaatcatcagacgatgtttggcagcacttcaccagaataaacaccaaacatcccgatgagatgtacgcagtgtgccaccactgtgacagggtgctcaaggctccttccaagaatggcacatctcatctcagaaggcaccgtaagactaagacatgtacatgcaacaacaatccatcatccactgccgaagacctagagatcttgcgtaagctctgcgcaaaccgcgatctctacaagcaggggaagatggagcgatgtgttgaatctgtagtggaacggtgcgatgttcccaccgcaggctactacacg

SEQ ID NO: 24921 - protein, 141 aa, Panicum virgatum
  misc_feature: Ceres CLONE 1861293
  misc_feature (43)..(92): Pfam Name: zf-BED Pfam Description: BED zinc finger
MIGRMLSVSFEWMEEHMSGCEEAGSECGEFPTPSADPDGESSDDVWQHFTRINTKHPDEMYAVCHHCDRVLKAPSKNGTSHLRRHRKTKTCTCNNNPSSTAEDLEILRKLCANRDLYKQGKMERCVESVVERCDVPTAGYY

SEQ ID NO: 24922 - DNA, 808 bp, Panicum virgatum
  misc_feature: Ceres CLONE 1861293-R
agaaaaccagctcacttaaacaatggcactggaaggacccattcgcctgagccttttgacggttcaaatgcgtatgatggtgatgaagaaggtagccccggcactccaaatcagaggactgttgagcacttcagaggtccagctggtaatgacgggggatggcttgcacgaatggctgctcttcttgtaggggaggatccaacgcagtgctatgctctaatatgtggcaactgccatatgcataatggtcttgcaaggaaagaggactttgggttcatcacatactactgtcctcactgcaatgccctcaacagttcccggcaaaacgaggaccatgacttggtacctaattctggcaaggagagtcctagttctcaatccgacataatcattggcccagctggtgcaagccttgcaagttcgggtgctgtaagccctgttgcaagcagcctaccaaccgttgaagaactctctgcagaagattctggggagaaggcgagcagtgaccaacctgccagttgaacttttcgtttcctgtagatttgcgtgtgaaatattgcatcggatttgtgtcgggttatccaaatttttgtaactaccatgtagcatatagagtaccatacttcgtgcataattggtgtgtagcaactggtagctcttggtggtttcatcgtggtttactaagcccctagggtgccaggacgacgcccacttgctgacatcttgtcgcagcagatgggcctgaatgatgataggatgttcatttctttcacccatttgtttattgagtgtatagtatttgaaaggc

SEQ ID NO: 24923 - DNA, 715 bp, Panicum virgatum
  misc_feature: Ceres CLONE 1861308
  misc_feature: Encodes the peptide sequence at SEQ ID NO. 24924
cctctgcctgccttgctcttgctggcacatcacgttggcgagcaggcgaatcaatcgccggtaaccccgttccgcctcccctccgacgtggtcctcccagagggggcgaacgaggggaagatccgcggcacggtggtgctggcaccgtcgtcttcgtcgccaactcgtgggtctacccgcaccacctctacgcccaggaccgcatcttcttcgccaacgacacctatctgccaagcaaaatgcctgcagcattggtgccttatcggcaagatgaactcaagattctccgaggtgatgataatgctggaccatacaaggagcatgaccgtgtctaccgttatgaccactacaacgaccttggtgagccggacaaaggtgaagaccatgtacggccgatccttggtggcagccaagaacatccatatccccgtcgctgcagaactggcagggaccgagcgaaaacagacccaaattcagagagcaggctttttctgctcaacctgaacatctatgtcccgcgtgatgaacgctttggacatctcaagttctcagacttccttgggtactcactgaaggcagtcattgaggctgttcttccaacaatagggactttcattgatgatacgccaaaggagtttgattcattcgaagacatcctaggactctatgaacttggtccagaagcacccaaccatccagtagtagcagagatcag

SEQ ID NO: 24924 - protein, 237 aa, Panicum virgatum
  misc_feature: Ceres CLONE 1861308
  misc_feature: SWISSPROT Homolog: EC 1.13.11.12 Lipoxygenase
  misc_feature: Useful for making plants with altered lignin content
SACLALAGTSRWRAGESIAGNPVPPPLRRGPPRGGERGEDPRHGGAGTVVFVANSWVYPHHLYAQDRIFFANDTYLPSKMPAALVPYRQDELKILRGDDNAGPYKEHDRVYRYDHYNDLGEPDKGEDHVRPILGGSQEHPYPRRCRTGRDRAKTDPNSESRLFLLNLNIYVPRDERFGHLKFSDFLGYSLKAVIEAVLPTIGTFIDDTPKEFDSFEDILGLYELGPEAPNHPVVAEI

SEQ ID NO: 24925 - DNA, 1754 bp, Panicum virgatum
  misc_feature: Ceres CLONE 1861313
  misc_feature: Encodes the peptide sequence at SEQ ID NO. 24926
aaaatcaccagcagagcagcgtcttctccccccgacggacgacggctcgactccggtagtctctagagccttccggaagccgcgcctccacctcccttcgccgttccccgtgcggcggcgcgggatcctcggcgcccccccgggctgctcggataacctaacccgtacggattgggctgcgatttttgagcaagaggcgtcgccgatatggcgagatcaaatgggacttcgggaacttctgctgcaagttttggcggtctgtacaataagaagtattcaagctacttaaattatgaaccaatgcctgatgccgcgtcggaaaaggagcagggaaatgaatatttcaaacagaagaagtttgctgaagcaattgagtgctactccagaagtattgggttgtctcctacagcagttgcttatgcaaatagagctatggcatatcttaaactaagaagattcaaggaggcagaggacgattgcactgaagctctgaatctggatgatcgatatattaaagcatactcacggcgaattacagcacggaaagaacttgggaagcttaaggaagcaatggatgatgctgaatttgccatcagtcttgagccaaacaatccagagctaaggaagcagtattctgacataaaagctttgcacatggagaaattggctaaaacaacccaggtgccagctaagcatgcagtttctggatttgataaacctgctgataaaaaggaaatcacttctcatccgccgactatctcccagaaggacagtttcatggaagttgattcacctattagagctgcagtggatatcagagagagtgctggtggcaggtctaaaggagggtctggagtaatcatcaatgagaatggcatgcagcagtcttgggatgccaatcagaagcctgggccagaagcttcaattcaagagcttgcatcgcgagctgcttcacggtatatggtcagcactgtaaaaagcgtcaagataccgaagacagcttatgactttgaggtttcttggagagctctttctgatgacactgctcagcaaatacagttgttaaaggtttatttccatctctttcttttttatcgcaccgttgcttatcaaatcttgctgtctaatttcctaccaatgttttgcaagcagtcaattccacctgcaagcctaccagagattttcaagaacgcactttctgctccttttctcattgacatagtgaagtgttcagcctcaatttttcgggatgatgcagcgttagctgttagcattttggagaatttggcaaaagttccacgctttgacttgataatcatgtgcctttcatccatgcacaaatctgaactgaggaagatatgggatcaagtattctttgctgaaaaagcatcagctgatcaggtggaagctcttaggcagctgcgaggcaaatatattcagggagggtggcaggataacatgttcacttcaagctaatgatgatgcaaagacaaaacattagaaaccttgtacacccttctcttgagtgcccgtcaaatgttagcagcaaatggttgtgaaattctcgtctactggatgcacgctctccggttgcagtgaatggtcgaatcatttagtttaggacatgtgcttgcagcaagtagttctttgtaggctgagatggaacgaatgtatgtaagctcatgttgcttccgaaccacttacgtactatctgattatatatcgccataaaaactttactgatcggatagatt

SEQ ID NO: 24926 - protein, 422 aa, Panicum virgatum
  misc_feature: Ceres CLONE 1861313
  misc_feature (35)..(68): Pfam Name: TPR_1 Pfam Description: Tetratricopeptide repeat
  misc_feature (69)..(101): Pfam Name: TPR_1 Pfam Description: Tetratricopeptide repeat
  misc_feature (102)..(135): Pfam Name: TPR_1 Pfam Description: Tetratricopeptide repeat
  misc_feature: SWISSPROT Homolog: EC 3.1.3.16 Phosphoprotein phosphatase
MARSNGTSGTSAASFGGLYNKKYSSYLNYEPMPDAASEKEQGNEYFKQKKFAEAIECYSRSIGLSPTAVAYANRAMAYLKLRRFKEAEDDCTEALNLDDRYIKAYSRRITARKELGKLKEAMDDAEFAISLEPNNPELRKQYSDIKALHMEKLAKTTQVPAKHAVSGFDKPADKKEITSHPPTISQKDSFMEVDSPIRAAVDIRESAGGRSKGGSGVIINENGMQQSWDANQKPGPEASIQELASRAASRYMVSTVKSVKIPKTAYDFEVSWRALSDDTAQQIQLLKVYFHLFLFYRTVAYQILLSNFLPMFCKQSIPPASLPEIFKNALSAPFLIDIVKCSASIFRDDAALAVSILENLAKVPRFDLIIMCLSSMHKSELRKIWDQVFFAEKASADQVEALRQLRGKYIQGGWQDNMFTSS

SEQ ID NO: 24927 - DNA, 1405 bp, Panicum virgatum
  misc_feature: Ceres CLONE 1861314
  misc_feature: Encodes the peptide sequence at SEQ ID NO. 24928
atcgctccacaatcatgcatccagatgaacgcccaaacgccatgaatccccacccaaatttggcttcccaagcacgcctacctctctggctcctcctccagcgacctccagccacccccagcagctagctgcctcctctctcgctgctcatcacatagtgccaccaccaacaagccctccctccacaagaaaaatcccaaatcccagtgttatcatcctgtcttgctgcctccctcgtgccccctgagctccgagctcccggagccccgagagaaaaagaaaggcgagaaagcttcgagctttgcctcccccgtcccccccaacccctgcaaccccgctgctagctaaaatgtcatgttgccatccacccgattgctagcgcttctagtttagtcccccactccgctccgctccgctcctcctggttatgggctccggcgaggtggatggacgcgcattgctggagccggagcagcagtagcggcggccaagcaggcgggggatctggatccgaggcaccaccaccggggtactgctcacggcggcgacggaggcggcggcggaggaggaggaggaggagcgcaggcgcagcaggaagcagatgaacagcagcagcagcagcacaaccaccatcaacacctgctccagctccaccaacaagtgcaggaccaagcagacccgccgccggcccccgtcttccagctccagcacctgcaggcggcggcggcggcagccgtgaggcagcggggcctgcccgccgagtatgcccttctcgcgcccatgggcgacgccggccagtcccaccaccaccaccacgccttccagccgcagctcctctccttcgggggcggcggcggcggccagcaacacgtgcaccagttcgcggcgcaggcgcaggcgcccgcggcggcatcccactcgcggtcgcggggaggagcaaccgcgggcggcgagatcgtggcggcgacgtccgcatcgcactcgcgcgtgagaggcggcggcgccggcggcggcggggagatcgtggcggtccagggagggcacattgtgcgctccacggggcgcaaggaccggcacagcaaggtctgcacggcgcgcgggccgcgcgaccgccgcgttcgcctgtcggcgcacacggccatccagttctacgacgtgcaggaccgcctgggctacgaccgccccagcaaggccgtcgactggctcatcaagaacgccaaggacgccatcgacaagctcgaggtgctgcccgcgtggcagcccacggccaatgccgccgcgccgccgtcgtcctccacccaccccgactccgccgagaactccgacgaccaggcgcaggccatcaccgtcgcgcacacgtccttcgacttccccggcgccggtggcgccagcggtggcgccagcg

SEQ ID NO: 24928 - protein, 208 aa, Panicum virgatum
  misc_feature: Ceres CLONE 1861314
  misc_feature (79)..(201): Pfam Name: TCP Pfam Description: TCP family transcription factor
MGDAGQSHHHHHAFQPQLLSFGGGGGGQQHVHQFAAQAQAPAAASHSRSRGGATAGGEIVAATSASHSRVRGGGAGGGGEIVAVQGGHIVRSTGRKDRHSKVCTARGPRDRRVRLSAHTAIQFYDVQDRLGYDRPSKAVDWLIKNAKDAIDKLEVLPAWQPTANAAAPPSSSTHPDSAENSDDQAQAITVAHTSFDFPGAGGASGGAS

SEQ ID NO: 24929 - DNA, 770 bp, Panicum virgatum
  misc_feature: Ceres CLONE 1861314-R
gaccctttcagtccagtaaccaccagccctccgagcgaggatggccggagaccgtcgaagccgacaacccgatgcagcagcagcagcaccaaggcgggctcaaccccgccgtgttcgcgcccggcatcggcttctccggtttccgcatccccaccaggatacagggcgacgaggagcacaacggcggcggcaatggcgacaagccgccgccgtcggtgtcctcggcttctcaccactgacagcagcagtggagcacagatcgattactccaccaccaaccaccatgagcattcagcgctacgccatgtcgtaccagtaacaccatcctcagcccctccacttgcacccttgtagttgatttgcagctgcttcctatgagaatggatggttgcaacaaggaggagcaaagttgggagctgccactcttttggttggtcggtcggtcggttttctagatctctatctgcagattgtgtcactggtttttgcttcaaagaactcactcggagcttcttcttaattagaattaggcctctgagagtgcagcacattggctagatcgatggcttatttgttgcaccacagtaggtttagttgatgttatttctaattgctctagttcaagctttgtttgctttcactttgttcttgttgttggtgactcgtcgtgatggttaatgcgcttcctcctgtggttcaggagctactagtgctagcagatgttgttgttaaccagatatgtggatggggacaggagtctttctttcttt

SEQ ID NO: 24930 - DNA, 1337 bp, Panicum virgatum
  misc_feature: Ceres CLONE 1861345
  misc_feature: Encodes the peptide sequence at SEQ ID NO. 24931
aaaacgccacctccgtccccgtccccatccccgaccagagagcaagcgccgtaaccggctaaccgccgccgcgccaccacaccctccgcccgctcccgcgcgcgcacaagcgtttcggacaagctgagcgcggcgggggcgccatgcacagcaccggccgggcgccgacgccggcggcggcggggacatcgtcgagatgtcctcggccgccgcgccgccgccgcaggaggcgcgggaccgggaccgggagcgggtgatcccgcacagcggcccgctgagcaagaagtccgggccgcgcaagagcgcgcgcttcgccgagtccgtctcggcgccgctctccgctccgccgccgcgcgcgtccccctcctccgccgccggcgacgacgacgactacgtcgagatcaccctcgacgtgcgcgacgactcggtggcggtgcacagcgtcaagccggcccaccacggcggcgccggcgccggcgccgccgccgccgacgacccagacgtgacgctgctggcgcgcacgctcgagagccggcggtcctcgtcctacggccactccgccatccgcagcgcctcgtcgcggatcaagcaggtgtcgcaggagctccgccgcctcgcctccctcaaccgccgcaacatctccggcgacagcatcagcaaggcggagctgctcgagttctgggaccaaatctccgacaccagcttcgacggccgcctccagaccttcttcgacatggtggacaaggacgcggacggcaggatcaccgaggaggaggtgaaggagatcatcacgctgagcgcgtcggcgaacaagctgtccaagatccaggagcaatcggaggagtacgcccggctgatcatggaggagctggacccgggcaacctgggctacatcgacctctacaacctggagatgctgctgctgcaggcgcccagccagtcggtgcgcatcggcaccaccaacagccgcaacctgagccagatgctgagccagagcctccgccccacgccggagcccaacccgctccgccgctggtgccgccgcgccggctacttcctcgaggacaactggcgccgcgtgtgggtgctcctcctctggttcgccgtctgcgcggggctcttcgcctggaagttcgtccagtaccgccgccgctacgtgttcgaggtgatgggctactgcgtgtgcgtcgccaagggcggcgccgagacgctcaagttcaacatggcgctcatcctgctccccgtctgccggaacaccatcacctggatccgcaaccgcaccgccgccgcccgcgccgtgcccttcgacgacaacctcaacttccccaaggtggtcg

SEQ ID NO: 24931 - protein, 380 aa, Panicum virgatum
  misc_feature: Ceres CLONE 1861345
  misc_feature (173)..(201): Pfam Name: efhand Pfam Description: EF hand
  misc_feature (113)..(172): Pfam Name: NADPH_Ox Pfam Description: Respiratory burst NADPH oxidase
  misc_feature: SWISSPROT Homolog: EC 1.6.3.1 NAD(P)H oxidase
MSSAAAPPPQEARDRDRERVIPHSGPLSKKSGPRKSARFAESVSAPLSAPPPRASPSSAAGDDDDYVEITLDVRDDSVAVHSVKPAHHGGAGAGAAAADDPDVTLLARTLESRRSSSYGHSAIRSASSRIKQVSQELRRLASLNRRNISGDSISKAELLEFWDQISDTSFDGRLQTFFDMVDKDADGRITEEEVKEIITLSASANKLSKIQEQSEEYARLIMEELDPGNLGYIDLYNLEMLLLQAPSQSVRIGTTNSRNLSQMLSQSLRPTPEPNPLRRWCRRAGYFLEDNWRRVWVLLLWFAVCAGLFAWKFVQYRRRYVFEVMGYCVCVAKGGAETLKFNMALILLPVCRNTITWIRNRTAAARAVPFDDNLNFPKVV

SEQ ID NO: 24932 - DNA, 1637 bp, Panicum virgatum
  misc_feature: Ceres CLONE 1861348
  misc_feature: Encodes the peptide sequence at SEQ ID NO. 24933
aagcttctacttccttcccgttcaacccacagggcttctacctccagggccgccgcttccttccctaatcggctaatccccttcctttccttcttcgtctctcctcgtctcctctgctatgagcttcaatcgacagggctccctgctggctccaatcaacatgctcttgtccctctcccatgggcaaccatagcatttcttcctccctccccccaaaatcctctcttttttcgcagttcttcatctgtcctcttcacggtctgctgaattaggtgaagctctcccatttttgaacgatttctcactgatggggtgcttcgccttcaggagcggcaagggcaggtccaagagccagccggccgccggcgccaagacggcgccggccaagtcgcccccggcgtccgactcctccggtggcggcgggcagaggagcaaggcctcgtccgcgtcggcgtccacgcccaccaggagcatccaggagctgtccgaggagcggggcgcgcagcggctgcgggtgttcgacctcgacgagctccagagcgccaccaacggcttcagccgcgcgctcaaggtcggcgagggcggcttcggctccgtctaccgcgctttcttccgctccgccggcggcggccgcgtcgtcctcgccgtcaagcgcctcaaccagcgcagccttcagggtcacaagcagtggctggctgaagtccaattcctgggtgttcttgagcacccgaatctcgtaaagctgatcggctactgcgcagtggattcagaagcaggcaagcacaggctgctggtctacgagttcatgcccaacaagaccttggatgaccacctgttcaaccgagctcatcctcccctttcatggagattgaggctccagatcatgataggcgctgcaaggggcctggattatctccatgaaggagtgccggaagttcaggtgatctacagggattttaaagcatccaacattcttctcgacaccgaattcaagccaaaactatcggattttggcctggcaagggaagggccgaccgaagggaaaacgcacgtctccacggcggtggttgggacgcacgggtacgcggcgccggactacatcgagacggggcacctgacgacgaagagcgacgtgtggagcttcggcgtggtgctgtacgagatcctgacggggcggcggtcgctggagcggagccgcccggcggaggagcagaagctgctggcgtgggtgcggcggcacccgccggacggcggcgggttccgggccatcatggacccgcggctgggcgggcggtacccgctggccgccgcgcgcgaggtggccaggctcgccgaccggtgcctcggcaagaaccccaaggagcggccggcgatgagggacgtcgtcgaggagctcgagcgggtgctgcagatggagcccccgccgccgcccgccgacaagaaaggaggcgatggcaggccaccgccgtcggccaagaggtgacgacggcgttgggggactgaaagaccggcgccggaatattacggtgtgcgtagggcgttttccaaattcaagtttgtgtgtgtatagaagattaccttattatatagaggccataagcgcaccaaaatagaagaagttcaggtttgaaacagac

SEQ ID NO: 24933 - protein, 391 aa, Panicum virgatum
  misc_feature: Ceres CLONE 1861348
  misc_feature (83)..(363): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated heat sensitivity
MGCFAFRSGKGRSKSQPAAGAKTAPAKSPPASDSSGGGGQRSKASSASASTPTRSIQELSEERGAQRLRVFDLDELQSATNGFSRALKVGEGGFGSVYRAFFRSAGGGRVVLAVKRLNQRSLQGHKQWLAEVQFLGVLEHPNLVKLIGYCAVDSEAGKHRLLVYEFMPNKTLDDHLFNRAHPPLSWRLRLQIMIGAARGLDYLHEGVPEVQVIYRDFKASNILLDTEFKPKLSDFGLAREGPTEGKTHVSTAVVGTHGYAAPDYIETGHLTTKSDVWSFGVVLYEILTGRRSLERSRPAEEQKLLAWVRRHPPDGGGFRAIMDPRLGGRYPLAAAREVARLADRCLGKNPKERPAMRDVVEELERVLQMEPPPPPADKKGGDGRPPPSAKR

SEQ ID NO: 24934 - DNA, 1251 bp, Panicum virgatum
  misc_feature: Ceres CLONE 1861350
  misc_feature: Encodes the peptide sequence at SEQ ID NO. 24935
aaaaccagggagcgcaaccagaccaccaccacctcgagcttcccctcccccctcgtctgctacaaccgcttcgtttcctcctccactttccccccaaattgagctccgattcggcttctccatcccgaatcgcgcactagttccacccgaaaatcgccgccggactggacccgcggatggagtgaccagttagggttccgaagccggcaatggaggcgcagtggctcgccgagtacccgcaccagggcgccgacaagcggccgcataagcggccccggctcgcttgggatgtcacgcccacggtattccagccccccaaggcaattccgatgctatattgtgggcaggaactaatcaatggtaattttgcgactgcttttgtgccgccgccaccaatttattacaccggacttccacggaatctttcacctctttggaggccagatgacaaggatgggcactatgttttcgcagttggggagaatctcacaccaagatataggatacttagcaagatgggtgaagggacatttggacaagttttgaagtgctgggacttggaaagccaagaagcagtggctatcaagattgtgcgctccctccagaaataccgagaggctgctatgatagaaattgacgtgcttcagagacttggmsmgcatgattttactggcagccgttgtgtgcaaatacggaattggtttgactatcgtaatcatatatgtatagtatttgaaaagcttgggccaagcttatatgactttctgcgaaagaatagctaccgttcatttccgattgaccttgttcgtgaatttgccagacaaatattagagtctgttgcatttatgcatgacttgcgacttattcacacggacctgaaaccagagaacattcttcttgtttcagcggagtctattagggtgcctgattataaggtttttatacgaccacccaaggatggttctttcttcaagaatcttccaaaatctagtgcaatccagctgattgattttgggagtacggcatttgagcaccaagaccacaattatgtggtgtcgacaagacattaccgtgcacccgaagttatccttggtcttgggtggaactatccatgcgacttgtggagcgtgggttgtattttagttgagctctgttcgggcgaagctctctttcaaactcatgaaaatttggagcatttggctatgatggagagggtcttaagacccttgccaaagcatatgattgtcagaa

SEQ ID NO: 24935 - protein, 347 aa, Panicum virgatum
  misc_feature: Ceres CLONE 1861350
  misc_feature (97)..(344): Pfam Name: Pkinase Pfam Description: Protein kinase domain
  misc_feature: SWISSPROT Homolog: EC 2.7.12.1 Dual-specificity kinase
  misc_feature (150)..(150): Xaa is any aa, unknown, or other
MEAQWLAEYPHQGADKRPHKRPRLAWDVTPTVFQPPKAIPMLYCGQELINGNFATAFVPPPPIYYTGLPRNLSPLWRPDDKDGHYVFAVGENLTPRYRILSKMGEGTFGQVLKCWDLESQEAVAIKIVRSLQKYREAAMIEIDVLQRLGXHDFTGSRCVQIRNWFDYRNHICIVFEKLGPSLYDFLRKNSYRSFPIDLVREFARQILESVAFMHDLRLIHTDLKPENILLVSAESIRVPDYKVFIRPPKDGSFFKNLPKSSAIQLIDFGSTAFEHQDHNYVVSTRHYRAPEVILGLGWNYPCDLWSVGCILVELCSGEALFQTHENLEHLAMMERVLRPLPKHMIVR

SEQ ID NO: 24936 - DNA, 505 bp, Panicum virgatum
  misc_feature: Ceres CLONE 1861350-R
gtgtgaagtttgggcgtggtgctgtacgagatcttgacggggcggcggtcgctggagcggagccgcccggcggaggagcagaagctgctggcgtgggtgcggcggcacccgccggacggcggcgggttccgggccatcatggacccgcggctgggcgggcggtacccgctggccgccgcgcgcgaggtggccaggctcgccgaccggtgcctcggcaagaaccccaaggagcggccggcgatgagggacgtcgtcgaggagctcgagcgggtgctgcagatggagcccccgccgccgcccgccgacaagaaaggaggcgatggcaggccaccgccgtcggccaagaggtgacgacggcgttgggggactgaaagaccggcgccggaatattacggtgtgcgtagggcgttttccaaattcaagtttgtgtgtgtatagaagattaccttattatatagaggccataagcgcaccaaaatagaagaagttcaggtttgaaacagac

SEQ ID NO: 24937 - DNA, 492 bp, Panicum virgatum
  misc_feature: Ceres CLONE 1861378-R
  misc_feature: Encodes the peptide sequence at SEQ ID NO. 24938
taggcgacaagcgcgggctataccgcatcatggacaggaagcttggaggccagtatccaaaaaagggtgcaaacgccattgcaagcattgccttgcaatgcatctgtggtgatgccaagatgcggcctcggatgtctcaggtgttggaagagctggagcagctgcaagatgccaaatatggttcagcgtcaccactggttgacattcggaaggcctcacacgccataccaagatcgcccagatcaccaatgagagtccaaccttcgccgcggcgctcacttggagcagcagcagcatccccattgccaggatatcgcactgcacaagtgcactaggacgagacttagaagatgtggcggacctgtaggttgtatatttgttggttcagcaatgagcagcgttgtaagttttgcttctactgatgttttggcgatcatgtgtgacacgggaacaccactatgtcaatctatgataagttgccttgcctggttc

SEQ ID NO: 24938 - protein, 110 aa, Panicum virgatum
  misc_feature: Ceres CLONE 1861378-R
  misc_feature: SWISSPROT Homolog: EC 2.7.11.1 Non-specific serine/threonine protein kinase
GDKRGLYRIMDRKLGGQYPKKGANAIASIALQCICGDAKMRPRMSQVLEELEQLQDAKYGSASPLVDIRKASHAIPRSPRSPMRVQPSPRRSLGAAAASPLPGYRTAQVH

SEQ ID NO: 24939 - DNA, 991 bp, Panicum virgatum
  misc_feature: Ceres CLONE 1861378
accgctcccgttcgcagcttccacacctcaccacctgagctcggtcggtggcgggctgcccgccgcttccttccgtctgccgctttgctttctccacccccaccgcacgcagctcgcctccgtccaggcagagacccgggtcaagcgatccggtcgcatctccacgcgcacctcggcttccccgtgcgtgcggttcttggtggcgagggtgtgcgtggcggcggcctcgagttgactgctcgaggtgtgagctccgacacctgcggcggcgcgctcgtttcttcgctgcgtgcgcggccgccgttcttgcagcagggtttcgccccgttcaggagtgggtgagtcggtgggcggggttcgatctgaacaaggcttggggttcttgctaggggcgcccggttggtcagctcgcagaagaagctaagctggttgggcgtggaggctctgattgacttttgaggtaccgggggtagacaggttgcctcttgctcgctggtttcttggctctgcagctacggagcttgctgattttcctccagaatttgtggcggaactccctcctgaccttgcgaagattggacctttggggctgcttgctcactggttgccttgctggagaatcttgggagcctctggtcctctttgattccttgcattactggtcatcttgggctccgagcgaactaagggagggcatcttttcccgctcagctcgttcatgtaaacggaggattgagctgatctagctgaagatcttgaggcgaccgaattcttgattgcctgcacagtgcatgaatagtgggtgaattggtaccgaaggagggaaacatggggaattgcatggacaccacggcgcgggtggatcacagcatgaacaatgctgcctacccatcaaaagtgaccagcaagaccagtttatcatctgtcccttccaccattaagaacaactcaacccgcttcactttgactctttcctccatgaaagagcgaa

SEQ ID NO: 24940 - DNA, 662 bp, Panicum virgatum
  misc_feature: Ceres CLONE 1861379
  misc_feature: Encodes the peptide sequence at SEQ ID NO. 24941
acacattcacaccccaaagcagcgcagccgcctcattcctcctctccatcctcctctctctctctctcgcgcgccgctcttcccgttccgttccaggagagcagtgaggcgggtagtagtggtcggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtacaacttccggaccagcaccgccgtccccaagctcggggggatctcatgggcgaccaaggacaaggtgcagcaagccaactacttcggctccctcactcaggcctccaccatcagggttggcagctacaacggggaggagatctacgcgccgttcaagagcctcctgcccatggtaaaccctgatgacattgtgttcggaggctgggacatcagcaacatgaacctggccgatgccatgacaagggccaaggtgctggacattgacctgcagaagcagctcaggccctacatggagtccatggtgccactccccggcatctatgatccggacttcatcgcagcaaaccagggttctcgtgccaacaatgtc

SEQ ID NO: 24941 - protein, 173 aa, Panicum virgatum
  misc_feature: Ceres CLONE 1861379
  misc_feature (62)..(173): Pfam Name: NAD_binding_5 Pfam Description: Myo-inositol-1-phosphate synthase
  misc_feature: SWISSPROT Homolog: EC 5.5.1.4 Inositol-3-phosphate synthase
MFIESFRVESPNVRYGPSEIESEYRYDTTELVHEGKDGASRWVVRPKSVKYNFRTSTAVPKLGGISWATKDKVQQANYFGSLTQASTIRVGSYNGEEIYAPFKSLLPMVNPDDIVFGGWDISNMNLADAMTRAKVLDIDLQKQLRPYMESMVPLPGIYDPDFIAANQGSRANN

SEQ ID NO: 24942 - DNA, 369 bp, Panicum virgatum
  misc_feature: Ceres CLONE 1861403
  misc_feature: Encodes the peptide sequence at SEQ ID NO. 24943
atcatgagtccatgtcagcgtctggcgcgtctccgctcaccgcatcgcctcctcctcgtggcctcctctcgctctccctgcttcttcagctgctcgcgatccgccgccgcacctatgcacatcccctgaataccacgccggcgccggcggcgaaggcgaaggcacagcaggcgggcctctcggttgggctggtctccacgctgccatagacgctggatgcgatcacgaccgcggcggccaacatctcgtcattgccaatcggcggcatcctcggaggaggtaacatcagcctctcctaccctctagctgactgcctagacatcctcgacctctaaaccgacgagctcacttgaaccatgttccacacct

SEQ ID NO: 24943 - protein, 65 aa, Panicum virgatum
  misc_feature: Ceres CLONE 1861403
  misc_feature: Useful for making plants with altered carbohydrate content
MSASGASPLTASPPPRGLLSLSLLLQLLAIRRRTYAHPLNTTPAPAAKAKAQQAGLSVGLVSTLP

SEQ ID NO: 24944 - DNA, 707 bp, Panicum virgatum
  misc_feature: Ceres CLONE 1861424
  misc_feature: Encodes the peptide sequence at SEQ ID NO. 24945
atacacgtcaccgtaaagcagatggacgccggtgcaagaagcacatccagagcccagagaccattgagtggtttggacgagaagagcccggccggcctctagctcttagcatttggcgtgccttcacctaacacatggcaggcaaggcattgcggacgcggcaggtggtcgccgctgcttcgctgctgtggcttctccttctcccatggccatgggcttcggccgtccaccggagcgacttcccggcgtccttcctcttcggcaccgccacttcctcgtaccagattgaaggcgcataccttgaggacaacaaaagtttaagcaactgggatgtgttcactcatgtgccaggaagaatcaaagacggaagcaccggggatatcgcggatgatcactaccaccgttacgaggaagacattgagcttatgcactctctgggcacggacgcatacagattctcgatatcatgggccagaattcttccaaagggaaggttcggcggagttaaccaattaggcatcgagttctacaacaaactcatcgattcactcctgttcaaaggtatggcctgctggatttgtccaatacaagttgggagttttgaagttcctcacctcccctgtcagcaccttgctatttcagcatattattttctgctggagcacgcagggatagagccattcgtcacgctgagccactacgacatc

SEQ ID NO: 24945 - protein, 190 aa, Panicum virgatum
  misc_feature: Ceres CLONE 1861424
  misc_feature (32)..(190): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
MAGKALRTRQVVAAASLLWLLLLPWPWASAVHRSDFPASFLFGTATSSYQIEGAYLEDNKSLSNWDVFTHVPGRIKDGSTGDIADDHYHRYEEDIELMHSLGTDAYRFSISWARILPKGRFGGVNQLGIEFYNKLIDSLLFKGMACWICPIQVGSFEVPHLPCQHLAISAYYFLLEHAGIEPFVTLSHYD

SEQ ID NO: 24946 - DNA, 733 bp, Panicum virgatum
  misc_feature: Ceres CLONE 1861426
  misc_feature: Encodes the peptide sequence at SEQ ID NO. 24947
gtcccgccgagtcctgcgttcttgcgggttgggggtcaggtcaatctggcctctggttgcttggattccagtggtcggcacccccagctcgcgatctttcctgctggtttcgtcagccgctggtcaacttggccggtcggttttggtctccgggggctgttcggcttcgggctgccaccgtcgctttagttcgtcagtctccgccaagatttcggcaatcttcctgtcaaagcccgcccaagatttgattgaagctttaccagttcttggattcgttttttcggcacaacaagccggttcttgtgtcgtctctggtgctgcaagtatgttctgtggcacaccgggtctctagtaaagagtccgtctgttgttagtttagggacttccggcatcgttcctggaaagttgctctcggcccctgcggcgatggcatctagcaccagcgagatgcccgaggcaaaggcgaagctgaagaggtccgggagcacgggaagcaaagatacatatgtgcgagctgacaagattgatcttacgagccttgacatccaacttgagaagcagctcaccaagacctggggtaaggccagcctcaagtcccaggggcccaaggaggagtgggagattgatcttgcaaagctggagatccgctatgtcatcgcgcaggggacttatggcaccgtgtatcgtagcacctatgatggtcaggacgttgcagttaagcttttggattggg

SEQ ID NO: 24947 - protein, 102 aa, Panicum virgatum
  misc_feature: Ceres CLONE 1861426
  misc_feature: SWISSPROT Homolog: EC 2.7.11.1 Non-specific serine/threonine protein kinase
MASSTSEMPEAKAKLKRSGSTGSKDTYVRADKIDLTSLDIQLEKQLTKTWGKASLKSQGPKEEWEIDLAKLEIRYVIAQGTYGTVYRSTYDGQDVAVKLLDW

SEQ ID NO: 24948 - DNA, 1291 bp, Panicum virgatum
  misc_feature: Ceres CLONE 1861436
  misc_feature: Encodes the peptide sequence at SEQ ID NO. 24949
aaacgccttcccctccgggtgccgatgaccgcgacaagtagccttcttttaccaatcccagcaatcatcgtcgccccctctcccgctccgaagcttcctccgtcgttttccccggcgggcgacgctcaccgggcgcgagagcgcgcgcgccgggtcagagaccccggcggacaagaaacctccctccccgcctccgctgccgctgcatcatcgcattgcattgccgccgggtggagcgataagcaattgacttgacttccctccctcccccactgcacttcgagcccccagcggggttcttgacttcttccccctccggttattattgttgtgaccgagtgcgccgcgcttcatccggtgggcggcccgcctgactcccgtcgtcgtcttcctcatcctcgccctcgttgcggagcggaggcgcgcgttcttggacgccacgggacacgggcggaggtgggtgagcccccacgtgggtcgctgattcgctggtcgggttccgtgcggtggtgtatctgctctggttttcttggcccggtctcgatttctcgcaccggcaagcccgtctcatctgcccaatttcccctcccccacttctcctaccccgttctttctccacttggtkaggacgccgaattctcggttggcttagccgcttaggaggtgtttggatcaaatccagtcaggaagctcatcagggtgttggggtcatccggaggtgcaggctgaacaatggggcaaaaggactccaagccttcctatagctactcttatgattatggcaatacttcatcggggtatacttccaggcatgctggaaatccaacatccagttatagcgcgaggtacgccccttcttcagagaacaatgtgcagccagaaacacacgccaggttgcagaggaagtattcaaggattggtgatgactaccgctctttgagtcaggtgactgaagctttggcacaagcaggccttgaatcttcaaatcttattgtaggcattgatttcacaaagagcaatgaatggacaggtaaaatgtccttcaatcgccgctgcctgcatgatattggaagcactccaaacccatatgaacaagccatatctattattggaaggacactttcagcttttgatgaagataatttgattccctgctttggatttggtgatgcatcaactcatgatcaggaggtattcagcttttacccagagaaccgtccatgcaacggttttgaagaggcgctagaaagatacagagaaattgttccaactcttcgattagctgggccta

SEQ ID NO: 24949 - protein, 186 aa, Panicum virgatum
  misc_feature: Ceres CLONE 1861436
  misc_feature (108)..(186): Pfam Name: Copine Pfam Description: Copine
MGQKDSKPSYSYSYDYGNTSSGYTSRHAGNPTSSYSARYAPSSENNVQPETHARLQRKYSRIGDDYRSLSQVTEALAQAGLESSNLIVGIDFTKSNEWTGKMSFNRRCLHDIGSTPNPYEQAISIIGRTLSAFDEDNLIPCFGFGDASTHDQEVFSFYPENRPCNGFEEALERYREIVPTLRLAGP

SEQ ID NO: 24950 - DNA, 628 bp, Panicum virgatum
  misc_feature: Ceres CLONE 1861436-R
  misc_feature: Encodes the peptide sequence at SEQ ID NO. 24951
gccagatgttgaaggaccattggaggttattctctttgaaagatggatgcttggatttaaacctcttccaaatgaagttgtgaaagcagtggatcctcagctcgaggtggttaacaagaacctagaagcatactataatgcttgggacaggttcattgagtcatggatcgttataaaaatacgagaacccaattgtgtattccagtggaggctgcaggcagagatagctatgagagcggatggaaaacctggaatgtccgatgaggaagttatggattttgtatcgcgctacctaccggcataccatgcgtatttgcccacgctatacaaagagggaccaaatggttcaaaaccagagcagctgctggtcattgacatagatgaagggaggaaccctttgtggggcagctgaggttgtgaattcctaatgtacatgctgaaaaagtgaaaatggattttttttctgactccacagagcagcttgggatctctgctctttatgagacttcttatgttaagcaagcactgtaggcatctttgttcccatggttcgaatatattgtgaacctgtaaattccatgcataacgaattttgttatctatcaaggaaatcaatgttttttcttcc

SEQ ID NO: 24951 - protein, 136 aa, Panicum virgatum
  misc_feature: Ceres CLONE 1861436-R
  misc_feature: SWISSPROT Homolog: EC 2.7.1.31 Glycerate kinase
PDVEGPLEVILFERWMLGFKPLPNEVVKAVDPQLEVVNKNLEAYYNAWDRFIESWIVIKIREPNCVFQWRLQAEIAMRADGKPGMSDEEVMDFVSRYLPAYHAYLPTLYKEGPNGSKPEQLLVIDIDEGRNPLWGS

SEQ ID NO: 24952 - DNA, 1014 bp, Panicum virgatum
  misc_feature: Ceres CLONE 1861438
  misc_feature: Encodes the peptide sequence at SEQ ID NO. 24953
acccttttcaacgggacgacggttcctcttcgcgtcgatcgtgtcctctgttcctcttccatctccagtggggaaagaaaaatcaaagctcgcggcgaggggagagcccaacaagcgagcggcggcatgggtagcaccagcaacaggggcggtggcggcggcggggaggagagcggcagcgaccacgacggcgggatgcggaagccgctgctggtcgtcaacacgggcagctggtaccggatgagctcgcggcagtccagcgtcgcccccggggcctcctccatggccgtcctgcgcgagtcccacgtctccgccttcctctgcacgctcatcgtcgcgctcgggcccatccaattcggcttcaccagcggcttctcctcgcccacccaggacgccatggttcgggacctcagactctccatctccgagttctctgtgttcggttcgctgtccaacgtcggcgccatggtcggggcgattgccagcgggcagatggccgagcacattggccgcaaaggggcgagaaattcggcacctttctttcttggcagttactagctgttgttccattctatgatcagtttgttacttgtaagctgacgatgaaggaggagggtcaacatcactttctcttatgtagacagagagtaggttgtgtgcagactaaccaacaagaaaagccattcattcccctgctagaaatcacttctttttatgtggggccttttttcatgaaaaagcaggtggaattttgaaaattaaaagtcaattattttcaatgcaatggaggcttggggactgtggagatacttttctgtatagtcaactaaattgggatttgaaactatttttttcatgttcgtttgctttctttgctttgatattatgtgttaaagatgcagttagtatgggagagaatgtgtggttccatgtgtaatttgtacataaagtttggtctcttgtgacacgtgtggcaacatttcagtagttaaccgcactaaagctttactactc

SEQ ID NO: 24953 - protein, 143 aa, Panicum virgatum
  misc_feature: Ceres CLONE 1861438
  misc_feature: Useful for biocontainment applications
MGSTSNRGGGGGGEESGSDHDGGMRKPLLVVNTGSWYRMSSRQSSVAPGASSMAVLRESHVSAFLCTLIVALGPIQFGFTSGFSSPTQDAMVRDLRLSISEFSVFGSLSNVGAMVGAIASGQMAEHIGRKGARNSAPFFLGSY

SEQ ID NO: 24954 - DNA, 250 bp, Panicum virgatum
  misc_feature: Ceres CLONE 1861447
  misc_feature: Encodes the peptide sequence at SEQ ID NO. 24955
tttttttttcccccctcttatcccttcgtctacggctgccccgcacccgccgcccaccaccctagcgacttcgacccgccccccctccgtcaccatggctgacgaccactactcctcccagcgcaagtaccaccacccctcgccgccgccgcggcgcacgcggttctcctccggcccgccgcccgcctcgccgcccgccggcgccccgtcctacaacagcgcgccgccgcccccccgacgagatccacct

SEQ ID NO: 24955 - protein, 51 aa, Panicum virgatum
  misc_feature: Ceres CLONE 1861447
  misc_feature: Useful for making plants with altered carbohydrate content
MADDHYSSQRKYHHPSPPPRRTRFSSGPPPASPPAGAPSYNSAPPPPRRDP

SEQ ID NO: 24956 - DNA, 659 bp, Panicum virgatum
  misc_feature: Ceres CLONE 1861462
  misc_feature: Encodes the peptide sequence at SEQ ID NO. 24957
agctcgtcccaacacacacatattgtccctgggcatcttcttcgtccttcgcctctagatcgagctcgatcgcgagcaacttcgggtagctgctcgcgtcgatcgatcggagcctagacgtacgaagtctggccatggccatggcgctctcctcctcctccgctcttccgtgctccctcctcatggcggccctgatgctcctcgcctccatcgcccaagtgcaaggcatcaccagatactacgacttcaatgtgacaatggccaacgtgacacggctgtgcgccaccaagagcatcgtcacggtgaacgggcagttccccggccttttttttgtcgccagggaaggcgaccgcgtcgtcatccgcgtcaccaaccacgcccagcacaacatctcgctgcactggcacggcatccggcagctgcggacggggtgggcggacggcccggcgtacatcacgcagtgcccgatccagacggggcagagctacgtgtacaacttcaccgtcaccaggcagcgcggcacgctgtggtggcacgcgcacatctcctggctgcgcgccaccgtctacgggcccctcgtcatcctccccaagctcggcgtgccctacccgttcccggggccctacaaggaggtccccgtcatcttcggtgagtggggg

SEQ ID NO: 24957 - protein, 174 aa, Panicum virgatum
  misc_feature: Ceres CLONE 1861462
  misc_feature (39)..(155): Pfam Name: Cu-oxidase_3 Pfam Description: Multicopper oxidase
  misc_feature: SWISSPROT Homolog: EC 1.10.3.2 Laccase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MAMALSSSSALPCSLLMAALMLLASIAQVQGITRYYDFNVTMANVTRLCATKSIVTVNGQFPGLFFVAREGDRVVIRVTNHAQHNISLHWHGIRQLRTGWADGPAYITQCPIQTGQSYVYNFTVTRQRGTLWWHAHISWLRATVYGPLVILPKLGVPYPFPGPYKEVPVIFGEW

SEQ ID NO: 24958 - DNA, 711 bp, Panicum virgatum
  misc_feature: Ceres CLONE 1861471
  misc_feature: Encodes the peptide sequence at SEQ ID NO. 24959
agcagttgccagttgcagcgccctcctctctcctctcctctcctctcatctctgggtggacgcaccgcaccgcaccccaactcccaagccctcccaagcaggcagaggcagcagcacaccgaagagggaggcgacgagagatcccatcccatcccatcccctccgctcgccgtctccctccctcctccgcgctacgcccgccgccgcttcggtcccgcccgcctcgctttgctcgtccggcacaggttgcatcccgttccacctcctccgtctccgggttcggctggatcgaaatgggcgcctgcgtgtccaaggtcaccgactgctgctgccgcacgccgcgcaacggcataaccaacgagacaactgacgctgtgacggaggagcagggggaggcatacgagctgccggtgttccaggagttcacctttgagcagttgcgcctcgctacgtcagggttcgcggtggagaacatcgtgtctgagcacggcgagaaggcgcccaatgtggtatacaagggcaagctcgatgcccagcgccgcatcgccgtcaagcgcttcaaccgctccgcctggcctgacccgcgccagttcctggaagaagctagatcagttggccagatccggagcaaaagattggcaaatttgcttggttgttgctgtgaaggtgatgagagattgcttgttgcagagtacatgcccaatgacacgc

SEQ ID NO: 24959 - protein, 139 aa, Panicum virgatum
  misc_feature: Ceres CLONE 1861471
  misc_feature: SWISSPROT Homolog: EC 2.7.11.1 Non-specific serine/threonine protein kinase
MGACVSKVTDCCCRTPRNGITNETTDAVTEEQGEAYELPVFQEFTFEQLRLATSGFAVENIVSEHGEKAPNVVYKGKLDAQRRIAVKRFNRSAWPDPRQFLEEARSVGQIRSKRLANLLGCCCEGDERLLVAEYMPNDT

SEQ ID NO: 24960 - DNA, 613 bp, Panicum virgatum
  misc_feature: Ceres CLONE 1861471-R
  misc_feature: Encodes the peptide sequence at SEQ ID NO. 24961
caagcaagaactgtcaaagaagaagaagaaaggaaagctccctaaggaggctcgccagcagctccttagctggtgggatctgcactacaaatggccttacccctcagagactcagaaggtggcgcttgcagagtcgactgggctggacctgaagcagatcaacaattggttcatcaaccagcggaagcggcactggaaaccatctgaggaaatgcaccacctgatgatggacgggtaccacccaactggggccttctacatggacgggcacttcatcaacgatggcgggctgtaccggctcggctagcgccactatcgccatttcacaccagctaaacactaatggttccaagtgtcagaagtactgaagacttggctagctatctaatgttgtgtgccgcatgcatgagctgtaaggaggccatgcttaactattttgttgcaggtgctactatatctgtgccctctatgcttacatgcatgaacattgctttaggtcgtactccacattgtggtggtgtgcttttgcttttgtggttgtatgcgtgacctgacagatggataactgattgctacatgtttgaataatttgcacgatctagctcgtttgtct

SEQ ID NO: 24961 - protein, 101 aa, Panicum virgatum
  misc_feature: Ceres CLONE 1861471-R
  misc_feature: Useful for biocontainment applications
  misc_feature: Useful for making plants with modulated biomass
  misc_feature: Useful for making plants with altered lignin content
  misc_feature: The sequence is a functional homolog of SEQ ID NO 2674 in the 10/374,780 US patent application
  misc_feature: The sequence is a functional homolog of SEQ ID NO 76 in the 10/225,066 US patent application
  misc_feature: The sequence is a functional homolog of SEQ ID NO 200 in the 10/225,066 US patent application
  misc_feature: The sequence is a functional homolog of SEQ ID NO 2334 in the 10/374,780 US patent application
  misc_feature: The sequence is a functional homolog of SEQ ID NO 272 in the 10/412,699 US patent application
  misc_feature: The sequence is a functional homolog of SEQ ID NO 601 in the 11/479,226 US patent application
KQELSKKKKKGKLPKEARQQLLSWWDLHYKWPYPSETQKVALAESTGLDLKQINNWFINQRKRHWKPSEEMHHLMMDGYHPTGAFYMDGHFINDGGLYRLG

SEQ ID NO: 24962 - DNA, 680 bp, Panicum virgatum
  misc_feature: Ceres CLONE 1861473
  misc_feature: Encodes the peptide sequence at SEQ ID NO. 24963
attccaacagcttcttcccctcaaagaccactccggattcttcccagaccggccggcgaatcacagctcgatcgatcgttctccggcgagccagcaaccactccctgatcggaatggacttcggaggggcgctgcagctgccgccggggttccggttccacccgacggacgaggagctggtgacccactacctcctgcgcaagtgcggcgggctggcgccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacaacgcgctcaggacggctggcccgggcgctctagagacctgtaaagctcgggcggcatggcgtcacggctcacgcacgcggcgatagggacaaccggcgcggccgccgcctgatctt

SEQ ID NO: 24963 - protein, 178 aa, Panicum virgatum
  misc_feature: Ceres CLONE 1861473
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered terpenoid content
  misc_feature: Useful for making plants with altered cell wall content and/or composition
  misc_feature: Useful for making plants with altered lignin content
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 851 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 852 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Useful for making plants with modulated light quality sensitivity
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Useful for making plants with modulated nitrogen use efficiency
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered carbohydrate content
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1729 in the 11/479,226 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 344 in the 10/666,642 US patent application
  misc_feature: The sequence is a functional homolog of SEQ ID NO 854 in the 11/435,388 US patent application
  misc_feature: The sequence is a functional homolog of SEQ ID NO 886 in the 10/412,699 US patent application
  misc_feature: Useful for biocontainment applications
  misc_feature: The sequence is a functional homolog of SEQ ID NO 582 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 310 in the 10/666,642 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNNALRTAGPGALETCKARAAWRHGSRTRR

SEQ ID NO: 24964 - DNA, 2015 bp, Panicum virgatum
  misc_feature: Ceres CLONE 1861478
  misc_feature: Encodes the peptide sequence at SEQ ID NO. 24965
ccaaacccagaacgtgcgcaccacgactcgtacaaaaatgaagccgagaacgaaagagtcgcacgagcgcggctgcttcggcgcgacacgacgaccggggcgccatgcaccggtggcgagcaggaagagcgcaccaccaccaccccttgctcccggcggcggccgtcctgacccacctcctcctcgccgccgccgccgccgccgctggcgccgatgaaccgggcacgccggcgatccttgccacggtgtgcggggccacgcagacgccggacccggagggcttcgacgtcagcttcgtcaccaccctggagatgatctaccagaacgtcacgcgctccggcttcggcgccacgggctccggcgccggcaacaacaccgtcttcggcctcggccagtgcctcgcctacctctccccgaccgactgccagctctgctacgcgcagagccgcgtgaagctgccccactgcctcccggccgacggcggccgcatctacctcgacggctgcttcctccgctacggcgccgacaacttcaccgccgtcgccaccgacgccagcgacaccgcggtgtgcggctccaacgccaccggcgccccgcccgcgccggggttcgcggcggccgccgcggcgctggtgcagaacgtcacggcggccgcgccgggcgcgagggactactactacgcctcgtcgtccccggactccgggcgcgcgctgcgggcgtacgccgcggcgcagtgctggaggtcgctcaacgccagcgcgtgcgcggcgtgcgtggcgagcgcgcgcgaccgggtgctccgccagtgcctgccgggcgccgccgaggggtacggcctgaacgccggctgcgtcgtcaggtactcgacgtggccgttctacctgccggccgccgccgccggcggcggcggatcatcctcacggcacatagttatcatcgtcatcgcttcggtcttctcggcactggccatcatcggcatagcgttcgtctggacgaaaatgcggccgagaagagacgatctccatgacgacatggacggctccggcgaggtcatccgcgccatcgccgcgtcgcacctcagcttcaagtaccaggagctgcggcaggcgaccgacgagttcaaccagatcaacaagctcggccagggcggctacgggtcggtttacaagggtgtgctgccggacgaccgggaggtggccgtgaagcggctcttcttcaacacgcggcagtgggcggaccagttcttcaacgaggtgcggctcgtcagccaggtgcagcacaagaacttggtgaagctgctcggctgcagcgtcgagggccccgagagcctcctcgtctacgagtacctctgcaacaccagcctcgaccactacctgtttgacgcgttcaagaagaacgcactggattgggagcggcggttcgagatcatcctcgggacggcggaggggctctcctacctgcacaatgcttcggagatcaggatcatacacagggacatcaaggccagcaacatactgctggacgagaggttcaggcctaagatcgccgatttcggcctggcgaggaacttcatggaagatcagagccacctcagcactggtctggctgggacctttgggtacatggctccagagtacatcgtgcacgggcagctgacggagaaggccgacatctacagctacggcgtgctggtcctcgagatcatcaccggtcggaagaaccacaactcggtggcttcgtcggcagaaggcctttccctcatggcactgatatggaagcactacaacgcagggaccctgacggaactcctggacccgaaccttcgcgagcagtgctcggaggaggaagccctgcaggtgttccacgtcgggctgctctgcgcccaggcgtcgccgaacctcaggccgccgatgtggaaggtggttgagatgctgagcggcagggacaagatgcttccccggcccacccagcccccgttcatcgatgtgaaggggtcgaacgcgaagagcgacggc

SEQ ID NO: 24965 - protein, 636 aa, Panicum virgatum
  misc_feature: Ceres CLONE 1861478
  misc_feature (339)..(586): Pfam Name: Pkinase Pfam Description: Protein kinase domain
  misc_feature: SWISSPROT Homolog: EC 2.7.11.1 Non-specific serine/threonine protein kinase
MHRWRAGRAHHHHPLLPAAAVLTHLLLAAAAAAAGADEPGTPAILATVCGATQTPDPEGFDVSFVTTLEMIYQNVTRSGFGATGSGAGNNTVFGLGQCLAYLSPTDCQLCYAQSRVKLPHCLPADGGRIYLDGCFLRYGADNFTAVATDASDTAVCGSNATGAPPAPGFAAAAAALVQNVTAAAPGARDYYYASSSPDSGRALRAYAAAQCWRSLNASACAACVASARDRVLRQCLPGAAEGYGLNAGCVVRYSTWPFYLPAAAAGGGGSSSRHIVIIVIASVFSALAIIGIAFVWTKMRPRRDDLHDDMDGSGEVIRAIAASHLSFKYQELRQATDEFNQINKLGQGGYGSVYKGVLPDDREVAVKRLFFNTRQWADQFFNEVRLVSQVQHKNLVKLLGCSVEGPESLLVYEYLCNTSLDHYLFDAFKKNALDWERRFEIILGTAEGLSYLHNASEIRIIHRDIKASNILLDERFRPKIADFGLARNFMEDQSHLSTGLAGTFGYMAPEYIVHGQLTEKADIYSYGVLVLEIITGRKNHNSVASSAEGLSLMALIWKHYNAGTLTELLDPNLREQCSEEEALQVFHVGLLCAQASPNLRPPMWKVVEMLSGRDKMLPRPTQPPFIDVKGSNAKSD

SEQ ID NO: 24966 - DNA, 2179 bp, Panicum virgatum
  misc_feature: Ceres CLONE 1861502
  misc_feature: Encodes the peptide sequence at SEQ ID NO. 24967
gattctcaagccggagtccttgttccccagccgcccagcgcccgcacggcacgatccttaaagctccattgctccctcgcctcgcctccttcggctcccagcacgccacccgcgcccgcaacccggcctcgcgagccctccgggagcgcgcggcgcggcgggaggagccctagaccccccccgcgggggaggacgtgcggcgcgcgccccggcgatggcggcggagggggatgggggtggcggcgcggaggagggcgtcggggagagctcgtccccgcctcgcgcgcctgcgcccgcgcccgctgcctcaggcgggagcgggggtggcggcctcgggggaggaggaggaggaggggtgggaggccgcgacgtctgccgcgaggtgttcgagcgcctcgtcgccgacggccacgtggaggcggcgggggcgtccggcccggagctccgcgcccggctcgaggcccacttcgcccggctccccaccagctatcagctagatgtgaatattgacaaagcagaggacgtgttaatccatcagaaggttttggcagaagcaaaggatcctgataggcgtccagcattcgctgtccgtttcctcaggcttgaagaggtaaatgtggccgagacaactaactctgatgcacatgaagaaggggctgacattggtgaagctctttctgccaggtcaaaggcatttacacacattcatgagattctattctccactacggacaaacccaagctcctgagtcagctgtctgctttgctttctgacattggactgaacattagggaagcacatgtgttctcaacaacagatggttattctcttgatgcttttgttgttgatggttggcccattgaggatactgatggtttgcataaggcactagaagcatcaattttgagaaatgagggttcatggtctggctctgattcatcaacttcaggaaagtcactgccattcttatcagaagattatgaatcagatattgacacaaaacttctgaagattgtaaagaaggttgcttctggatcttgtggggatatgtttcttgggacttatggtggtgaggaggttgctgttaaagtccttaatcctgagaattttaaccaaaatgcatggagtgaatttaagcaagaaatctacatgttaagggaagttgatcatcccaatattgtccgattcattggctcatgtacaaagccacctcagttttacataattacagaatgcatgtctagaggaagtctgtttgatttcttgcacaacgagcataatgtcttggacctcccaacaattctgaagttcgcattagatatatgcagagggatgtcctacttgcatcaaaagggcatcatccacagagatttaaagtctgccaaccttttactgggcaaagaccatgttgtgagagtggcagattttgatctagcccgtttccaggatgaagggggtgctatgacagctgaaactgggacctatcgatggatggcgcctgaggttatcaatcatcagccctatgataacaaagcagatgtctacagttttgctattgtactttcggagctcatgacatccaagattccatatactaccatgagccccctccaggcagctattggtgtgaggcagggattgcggccacaacttccagaaaatgcacatcccaagctcctaatcttgatgcagagatgttgggaagcccttccatctaaccggccttcctttgcagatatcattactgaactggaagatattcagggaacttcaggggagtcgagccagaaacaaaaggatggtgacgagtgaccactaaacatttgacattcaacacgtacttgtttgcagtttcacgtaactgatccgactgacttaggatccaggccactaatgttggagaaagtatagcaaatcaacttttggcccagttttgtctgcgcttcttggggccaatttctcggtcccactcatctcacacagacctagtcccatttttcttgcatagaggagaggaaatcagcctgtgagttttggggttgcggcttgatatgtgaatatctgaatgagaatccagtgctgcccggcatgtaatgtgcaaagctttttgcatctgcttcacctgtacaattcaggcgaaatggcgaattaataactgttcaggtatgtgaaatgctc

SEQ ID NO: 24967 - protein, 532 aa, Panicum virgatum
  misc_feature: Ceres CLONE 1861502
  misc_feature (265)..(513): Pfam Name: Pkinase_Tyr Pfam Description: Protein tyrosine kinase
  misc_feature (165)..(228): Pfam Name: ACT Pfam Description: ACT domain
  misc_feature: SWISSPROT Homolog: EC 2.7.11.1 Non-specific serine/threonine protein kinase
MAAEGDGGGGAEEGVGESSSPPRAPAPAPAASGGSGGGGLGGGGGGGVGGRDVCREVFERLVADGHVEAAGASGPELRARLEAHFARLPTSYQLDVNIDKAEDVLIHQKVLAEAKDPDRRPAFAVRFLRLEEVNVAETTNSDAHEEGADIGEALSARSKAFTHIHEILFSTTDKPKLLSQLSALLSDIGLNIREAHVFSTTDGYSLDAFVVDGWPIEDTDGLHKALEASILRNEGSWSGSDSSTSGKSLPFLSEDYESDIDTKLLKIVKKVASGSCGDMFLGTYGGEEVAVKVLNPENFNQNAWSEFKQEIYMLREVDHPNIVRFIGSCTKPPQFYIITECMSRGSLFDFLHNEHNVLDLPTILKFALDICRGMSYLHQKGIIHRDLKSANLLLGKDHVVRVADFDLARFQDEGGAMTAETGTYRWMAPEVINHQPYDNKADVYSFAIVLSELMTSKIPYTTMSPLQAAIGVRQGLRPQLPENAHPKLLILMQRCWEALPSNRPSFADIITELEDIQGTSGESSQKQKDGDE

SEQ ID NO: 24968 - DNA, 2464 bp, Panicum virgatum
  misc_feature: Ceres CLONE 1861506
  misc_feature: Encodes the peptide sequence at SEQ ID NO. 24969
gggccgatgccatttttaccctcgcctcgtctctcccggcccgttcctctgttgtctgttcctctggcagctttggccgcgagtgagagagcgagcggccgcgtcgtcgtcttcctcgcgaatcctcgtcgcgatcgccgctcaaatccacaccaattcgctgcggccggtctccgatcccgcaccaccacccctccccttccgccgcgggcctgcggccgttatcccaaagccctagcgcggggcagcgcgccgcagccacccgcggagggcgcggctgctcctggggggacggctcaaaaccccgcgcccgcggcgtaggggttgctgaagtggcggccgccgctccggcctctgccaatggcgcggatccagcctgttctggatgaaagaatggacccatttcttggtagattgactataccaaccaccattaaccaatcatggtgtactgctcagagcggcctgcccttgttcaatgggcctttccctgaagctaggatttcttctgcagagcttaacaacagttttaccgagttcaaggatgcatctgtgccatctgatgttgcaaacaactttgaaccatttgcaactgtagtgtcaaggttgcatcaacaccttctggctgcaaatgttgacgttacttatacagagtacttagatttgatgaaagtagaagttgatcagtggcttaataagctcactgaggacataagggtcttcaaaagctatagcttgacccataaatatgatgcaaatggttcatgctctgcagcttgccatgtcgggaagctaactgagatagatgaggggttcaacagcttgaaggtgctgctggttgtggtgttccaacaaattagagagatgttcgcattggtcaatgcttcaattcgtgatcttcagtgggaacatgaattacagttagatgttactggcattattattagagactgcattagaggtcttcaggacgagctagagaggaaattgtatgagcaaagttccatagtgaggagtctaagcaaaaactggcaggaaactgtggctcagtgtgcttccatccgtgaagacctgattgctatttctgatatactattaccttcagaagaggaaccccacgttcccctttgtaggcatgaaagtttgggtaactggagcgacagatggaagttcagctttttcagaaagagaacacatcaggatcattctctatcttcctcagagcaaaaccagaattctgcgacacagaaatctataagtcccagtgaagttatttcagaaaaatctgatttccgacatctgaagggtatgaatagacaacaaattcttaactacttcagatctgagatcagtaaattaaaaaggctgcatgagttggatttgcaagagaaaacagaagagctgttcaaattcaaacgagagaaatggtcattggctcttaagtatgatgtagaattcgagcctctaaggaagaaattccctgaggtcatttcaagatttgaccaaatcatgtccaatggagtggcagcacctacaacctgcagtactagtgatgcacttgatgaaagaagcagattgaataatagaattgattcactatatcgtgacaaccagcatcttcggtgtttgcttgcagagaaaacgaagaatgctcaggaattatcatgccagatatctgatgccagtaggaaaatgtcacttcaatattctctagaaaaacaacatttgaggcaaatcaacaacagcaaagaagagtatgatgatctttatgtcgaaagtacaatcagagatgaaatttaccaaactgttatgagaaaattggctgatcatcataggaacatcttggaggatactgcccaaaagtttcatgtaaaactgtcctcatatgaaactgcactctcagaaaaggacaaggcgttgtgtttatctaatgaagaaaatcgaaagctaaaggaaaagctgtcgacactagaaaaggagcattttatccattataagcagcaagatccagagctaaacaaggaagagagtgaggaaatgatacttcgtgatattgagatggagcctcatgtggcaccacgaagaccatatgagatttctgatcaggacatgccttatgaggagctcatcaagctgaatcagactttagaggttgcctcaaccaccttaaaagaagttgaaacaaaaacgttagattacagtgatatcctaggtaaaagagagcaagaagagcagctagattgcattctggtatcaatcatggatctatcaaaagagtttgtggagattgaacataaaatgtcagaagatgtaaaagggaatgagaaaaagacagaaatcctgaatgatcgatgcaaccatatggtacaacaagccattgtactgacgaagaaaggcctatggtacaagaacatgattgacacaagacgttctgagcttcaaaaagcagaatctgaggtagata

SEQ ID NO: 24969 - protein, 701 aa, Panicum virgatum
  misc_feature: Ceres CLONE 1861506
  misc_feature: SWISSPROT Homolog: EC 2.7.11.1 Non-specific serine/threonine protein kinase
MARIQPVLDERMDPFLGRLTIPTTINQSWCTAQSGLPLFNGPFPEARISSAELNNSFTEFKDASVPSDVANNFEPFATVVSRLHQHLLAANVDVTYTEYLDLMKVEVDQWLNKLTEDIRVFKSYSLTHKYDANGSCSAACHVGKLTEIDEGFNSLKVLLVVVFQQIREMFALVNASIRDLQWEHELQLDVTGIIIRDCIRGLQDELERKLYEQSSIVRSLSKNWQETVAQCASIREDLIAISDILLPSEEEPHVPLCRHESLGNWSDRWKFSFFRKRTHQDHSLSSSEQNQNSATQKSISPSEVISEKSDFRHLKGMNRQQILNYFRSEISKLKRLHELDLQEKTEELFKFKREKWSLALKYDVEFEPLRKKFPEVISRFDQIMSNGVAAPTTCSTSDALDERSRLNNRIDSLYRDNQHLRCLLAEKTKNAQELSCQISDASRKMSLQYSLEKQHLRQINNSKEEYDDLYVESTIRDEIYQTVMRKLADHHRNILEDTAQKFHVKLSSYETALSEKDKALCLSNEENRKLKEKLSTLEKEHFIHYKQQDPELNKEESEEMILRDIEMEPHVAPRRPYEISDQDMPYEELIKLNQTLEVASTTLKEVETKTLDYSDILGKREQEEQLDCILVSIMDLSKEFVEIEHKMSEDVKGNEKKTEILNDRCNHMVQQAIVLTKKGLWYKNMIDTRRSELQKAESEVD

SEQ ID NO: 24970 - DNA, 1752 bp, Panicum virgatum
  misc_feature: Ceres CLONE 1861508
  misc_feature: Encodes the peptide sequence at SEQ ID NO. 24971
aactgcttcctcaacctattgccccgccaaggcgccaaccacacagcaacagctagttgctgggtggttctggtgtcatggcggggaagcagcagaatgttgcaatattcaccactgcgagcctgccatggatgactggtacggccgtcaaccccctgtttcgggccgcatacctcgccaaggctggaaactgggaggttacgctggtagtgccgtagctgtccaagggggatcagattcttgtttaccctaacaagatgaagttcagttcgcccgcagagcaggaagcctacgtgcggcggtggcttgaggagcggattggggtgttaccaaagttcgatataaagttctaccctgggaagttttcaactgagaaaaggagcattctacctgttggggacatcagtcagaccatatctgatgacaaagcagatattgcagtgctagaagagccagaacatcttacatggtaccatcatggacggaggtggaaaaccaagttccaaaaagtcataggtgttgttcacacgaactatttggaatatgtgaaaagagagaaaaatggatatatcagtgcatttatcttaaaacacatcaattcttgggttacagacatctattgccataaggttataagattgtctgcagcaactcaggacgtccctaggtctgtgatttgtaatgttcatggagttaaccccaaatttattgaaatcggcaaattgaaacatcagcagctatgccaaaaggagcaggcattcttcaagggtgcatattatattggaaagatggtatggagtaaaggttacacagagcttcttcatctgcttcataagcaccaaatggagttatctggccttaaaatggagttgtatggcagcggggaagattctgatgaagtgaaagcatcagctgagcgattgagcttagatattagagtctatccaggccgcgaccatggagattcaatatttcacgactacaaggttttcataaacccaagcacaacagatgtggtatgcacaacgactgcagaagctttggcgatgggaaagattgtgatctgtgcaaaccatccttcaaatgaatttttcaaaaggtttcctaattgtcacatgtacaatagtgagaaagagtttgtcaggctaacaatgaaagcattgggagaagatccaatgccactgtcagatgaactgaggcatgagctttcctgggaggctgcgacagaaaggtttgttagggttgctgatattgcaccaaccatgtctgtcgggcaaaaagcaccctcttcaaagcatttcatgcgcatctccccggaggaactgcagaagaacatggaagaggcttcagcatttttccataactccatctctggaattgaagctgcccgatgtgtattcggtgcaataccaaataccctgcagccggatgagcagcaatgcaaggaacttgggtggaatttgcagggatagcattagcttctcttgcgatgctcttgccatggattacagaatcgcaactaaccagtccagttggtgtctgaggaactaaccagcaacacaaaaacctgtcattcaaaaaggatctcagattgttcagacaggttcttactgtgtttttctggtgtggcggcactcaatttttcttggaaaatcagaggcgttctgaagttcctgtaatgcagaattgcatatcttgcaattgtaaatctaaagcaggtgaagtgcaaatccgtgttataagttggcttcc

SEQ ID NO: 24971 - protein, 404 aa, Panicum virgatum
  misc_feature: Ceres CLONE 1861508
  misc_feature: SWISSPROT Homolog: EC 2.4.1.241 Digalactosyldiacylglycerol synthase
MKFSSPAEQEAYVRRWLEERIGVLPKFDIKFYPGKFSTEKRSILPVGDISQTISDDKADIAVLEEPEHLTWYHHGRRWKTKFQKVIGVVHTNYLEYVKREKNGYISAFILKHINSWVTDIYCHKVIRLSAATQDVPRSVICNVHGVNPKFIEIGKLKHQQLCQKEQAFFKGAYYIGKMVWSKGYTELLHLLHKHQMELSGLKMELYGSGEDSDEVKASAERLSLDIRVYPGRDHGDSIFHDYKVFINPSTTDVVCTTTAEALAMGKIVICANHPSNEFFKRFPNCHMYNSEKEFVRLTMKALGEDPMPLSDELRHELSWEAATERFVRVADIAPTMSVGQKAPSSKHFMRISPEELQKNMEEASAFFHNSISGIEAARCVFGAIPNTLQPDEQQCKELGWNLQG

SEQ ID NO: 24972 - DNA, 772 bp, Panicum virgatum
  misc_feature: Ceres CLONE 1861524-R
  misc_feature: Encodes the peptide sequence at SEQ ID NO. 24973
cacccctcctccggcacccaccacgccgccccccgccccggtgactccccccccagcccccaccacgccgccgccgtcgccgccggcctctcccccgcccgctcccaccaccccgccgccgtctcccccggcgaccccgccacccgctcccgccaccccgcccccgtccccgcccatggcgccgcctccggccacgcctcctccccccgccaccccgcctccggccgcgcccacgccggctcccagcaccgccccgacgctcccgcccatggtgacaccggccgcgtccccgaagagccccaagaccccgagccccgccgccgagacgtccccggcgcccgcgctctcgcctgctggcacgccgccgaccgaagactcgggtgcaagcgcacgcgcggccggcttcgccacggtcgtggcgttggcgggcgcgggcctcgccctcctgctttgagtagtagatctcctcctcctcctccgatcctgtcgatgttgccatccctccccagctccccgtgcgtcgacgacgacgctgctcctccgtctccatttcatctctctttttttctttcttttttctaccgtgttgttatttaattttaccggcatgctcggaccgaccgattcttgatgtacgatgatgacgatggtgatgcattggtttctttggttccgcgggcggattattggtggttagtgttctgctccgcggcgggtgtcgcactgtacttttaccgcactacattttggttctatagagaggattttgtgt

SEQ ID NO: 24973 - protein, 150 aa, Panicum virgatum
  misc_feature: Ceres CLONE 1861524-R
  misc_feature: Useful for making plants with altered cell wall content and/or composition
TPPPAPTTPPPAPVTPPPAPTTPPPSPPASPPPAPTTPPPSPPATPPPAPATPPPSPPMAPPPATPPPPATPPPAAPTPAPSTAPTLPPMVTPAASPKSPKTPSPAAETSPAPALSPAGTPPTEDSGASARAAGFATVVALAGAGLALLL

SEQ ID NO: 24974 - DNA, 681 bp, Panicum virgatum
  misc_feature: Ceres CLONE 1861524
gagcatctcgctcggaaaaaaactaccacgaccccatccattccgttccaccgcgcgcaccgatcgcggcggcggcggcatcaggagcggccgcgatggggaaggggccgtcgtcgcgggcggcgtcgcggcaccatcagttccgcgcgcgtgccaagacccgcgtggacgacctccaggagatgttctcgggcctccagtccgcgcgaaaggactcccgcccggccgacgccgccgtcctcgaggcgcagctgcagcagatgctccgggagtggcgctccgagctcagcgctccctccccggcctcctctctccagggcaacaccagggagctgtcggatccgccatcggagactctgcgattgctgcagctggcgacggccgatgaggaggacgacgccacgagcaagctggtcgagcagcagcagcagcagcagccccctcccccgcccccgcccccagccaaccagagccaggggcacgcgctgggatgccaggacctgaagccggagccgcgcgaggaagaagttgacatcgcagtggcgcagccacagccgcagctgctgggtcagggggttctgcctaatggtgctcctgccgcggctgctgtgttccatgatcagatgtactatgtgaatcacgagcttacggttgaggattttctttatgatgatgattaca

SEQ ID NO: 24975 - DNA, 2430 bp, Panicum virgatum
  misc_feature: Ceres CLONE 1861546
  misc_feature: Encodes the peptide sequence at SEQ ID NO. 24976
aagcagagttgccaaccgcaaggtgctgcgacctctgctcatgagcaaatcgcgggcacagcagaagccccgtcgaggtcaaggccgccgcctatggatggagatcagaggaggcacgccgccgccgtggtcatcgtccgcgcgcgggacagcccggcgcggcgcctgatcgcctggctgcagcttctcttccgggcgttcgttcagaggtacggcgggctcgcgagctgggacgcggcgggcccccccgcgctcgtcatcgccgccgcggcgttcttcctccagagggccctgcggcgccggtacctgtcatgggaggagtcgtcgcggctgcggctgcggacggccgcggccgtcaccgtgcaggccgccgtcagggccacggcggctcgccgcgagctctcgctctggaagcagatcagagcagccacgcgcatccaggcgcaatggcgtgcgcaccgggcggtgtggagctacctgatgacgaagagagcagccctgatctgccagcgagcttggaggcagggcattgcgagcagggagctcaggaagctcagactggaagatcttgagagggagatggtggacgagatgtgcaggctgcgtgagatggtggacgtgctccagcaagccgtcaatgacgccgagacgagggccgtcaacgagagggaggcggcgaagaaggcgattgctgagtcggaagcggccccggtgatcaaggagaccgtggtgatggtcgaggacaccgagaaggttacctcgttgaacgccgaagttgaccggctgaaggatttgctgggagctgaaatgaaggaaacgtttgctgcgaagaaggcgcttgctgaagctgaattgaggaatgagaaactggcaagactgcttggagttgaggaggttaagaacaaacggctgcaagattccctgaaaaggatggaggagaaggcttccaatctagatgaagaaaacaaaatgcttcgacaggctgttgcatcaattcctactatcaaatcaacatcgaccgaaaaacatgaaacgcctaatattcaggaaagtcctgataatgagaaaacaccaaatggtgcagtgaagcccatcatagtagatagggagggtactatccatgagaagagtcctgaacaacctagctcaaatggtcatgaagctgagaagcaacagcaagatcttctgatcaagtgtctctctgaagatctgggcttctcgatcggcaggcctattgctgcctacctcatctaccgatgtctggtccattggagatcatttgaagaggagaggacctcagtctttgatcggattattcagaagattactgctgcccttgagggtcgagacaacaatgacacattagcatattggctgtccaattcatgcacactgctggttcttctccaaaggacactgaaaatcaacggggtagctgctttggctcgtcagaggcgaagagcatcacctctcaaggttccacaggaaaaccaagatgccagtcatcctgaccgtacagtttctgacggacagttgatcagcggactagctgaagtttaccaggttgaggccaaatatccagctattgcatttaagcagcagctcacagcattgttggagaaggtctatgggataatcaggcacaatctgaagaaggaactgtctccacttctcagcttgtgtattcaggcaccaagaacatttgttgtcagtccaagggggtcatgttctcaaggaacagatttggcacagcaggcttccatggcacattggcagagcatcatcaagatcctcacaaattctctcaatatcttgaaatcaaattatgtgccggcattcctgatttgcaagttgttcacccaaattttttcttttatcaatgtgcaactgtttaacagtctcctgctacggcgcgagtgctgttcattcagtaatggagaatttgtcaaagctggacttgatgagctagagcactggtgcttttggctgactgaagagtatgctggctctgcctgggatgagctgaagcatataaggcaagcagtcacactattgatactcgaagagaagcacaggagtctcacagagatcacagacgacttttgcccagcgctgagcatgcagcaactgtaccggatcagtacgatgtattgtgatgacaagtatggaaccctgggcattcctccagaagtcatctcaagcatgcggaccaagatgatcgagggctctagcagtccatccgcgcacgacgatatcaactcgttcttgctagacgatgacttcagcataccgttctccgtcgacgacattgccaagctgatggtgcacgtggacgtagcagacatggacctcccgccactgattcaggagagcaatggctcgaaactgggacactgagatgaacaccgaactgatcgacaatatactctt

SEQ ID NO: 24976 - protein, 767 aa, Panicum virgatum
  misc_feature: Ceres CLONE 1861546
  misc_feature (586)..(692): Pfam Name: DIL Pfam Description: DIL domain
MDGDQRRHAAAVVIVRARDSPARRLIAWLQLLFRAFVQRYGGLASWDAAGPPALVIAAAAFFLQRALRRRYLSWEESSRLRLRTAAAVTVQAAVRATAARRELSLWKQIRAATRIQAQWRAHRAVWSYLMTKRAALICQRAWRQGIASRELRKLRLEDLEREMVDEMCRLREMVDVLQQAVNDAETRAVNEREAAKKAIAESEAAPVIKETVVMVEDTEKVTSLNAEVDRLKDLLGAEMKETFAAKKALAEAELRNEKLARLLGVEEVKNKRLQDSLKRMEEKASNLDEENKMLRQAVASIPTIKSTSTEKHETPNIQESPDNEKTPNGAVKPIIVDREGTIHEKSPEQPSSNGHEAEKQQQDLLIKCLSEDLGFSIGRPIAAYLIYRCLVHWRSFEEERTSVFDRIIQKITAALEGRDNNDTLAYWLSNSCTLLVLLQRTLKINGVAALARQRRRASPLKVPQENQDASHPDRTVSDGQLISGLAEVYQVEAKYPAIAFKQQLTALLEKVYGIIRHNLKKELSPLLSLCIQAPRTFVVSPRGSCSQGTDLAQQASMAHWQSIIKILTNSLNILKSNYVPAFLICKLFTQIFSFINVQLFNSLLLRRECCSFSNGEFVKAGLDELEHWCFWLTEEYAGSAWDELKHIRQAVTLLILEEKHRSLTEITDDFCPALSMQQLYRISTMYCDDKYGTLGIPPEVISSMRTKMIEGSSSPSAHDDINSFLLDDDFSIPFSVDDIAKLMVHVDVADMDLPPLIQESNGSKLGH

SEQ ID NO: 24977 - DNA, 705 bp, Panicum virgatum
  misc_feature: Ceres CLONE 1861553
  misc_feature: Encodes the peptide sequence at SEQ ID NO. 24978
gcgtcgcgtcgcatcgcacgcatcccccctgccctgccctccctcgtcgtcttccagtcttcctcgcccccgctcccagctagacacaccgtaccgccaggtttgctttatgctagttcatgtgtccgcagacaatggactgattgctggcctgcctctgtgattcaccatgggaagcagtggagctgatacaccgtctaagacaagcaaggggtctgccccacaggagcaacagccacctgctactacatttgctgcaacaccagctgtttatccagattggtccagcttccaggcatatcctccaatcccaccacatgggttcttcccttcacctgtgacatcaagtccacagggtcatccttacatgtggggagctcaacctatgatcccaccatatggaacaccgccgccgccatacgtcatgtaccctcctggagtatatgctcacccgtctatgcccccgggtgcacatccattcaccccttatgccatgacttctccaaatggcaatgctgatgctactggaactactgcagcaggtggtgatactgacgggaagccctctgaaggcaaagataaaagtccaacaaaaagatccaaaggaagtttaggtagcttgaacatgcttactgggaagaatcccaccgaacatggtaagacctcaggagcatcagctaatggagccacttctcaaagtgggga

SEQ ID NO: 24978 - protein, 178 aa, Panicum virgatum
  misc_feature: Ceres CLONE 1861553
  misc_feature (1)..(178): Pfam Name: MFMR Pfam Description: G-box binding protein MFMR
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MGSSGADTPSKTSKGSAPQEQQPPATTFAATPAVYPDWSSFQAYPPIPPHGFFPSPVTSSPQGHPYMWGAQPMIPPYGTPPPPYVMYPPGVYAHPSMPPGAHPFTPYAMTSPNGNADATGTTAAGGDTDGKPSEGKDKSPTKRSKGSLGSLNMLTGKNPTEHGKTSGASANGATSQSG

SEQ ID NO: 24979 - DNA, 666 bp, Panicum virgatum
  misc_feature: Ceres CLONE 1861560-R
  misc_feature: Encodes the peptide sequence at SEQ ID NO. 24980
gtgagaaaagaccctggctgggtggcagggattttcttctaccttgagccagaattttgtcgcactgccattatctcaactaagagcgatgtgtattcctttggtgttatttgtctcgagataatcactgctcgaaatgcttctaccttctccaccaaggggcaatccttggttgtttatgcttgggaattatggtcatcagaaagagcaatggagctgatagatccagcactgcgtgttgaaccaggaacaagcaagatacttcgatgcttccagatagcactattgtgtgttcaagataatcgggcagacaggccaacaatgtcagatgttctgatgatgctaaaatgtgattgtctgaccttgcctgtccctaggcgacctgaggatcaatggggaccaaggggtttatcagcagatgacagggattcggcaggccatacatgctattcaagcgcagggtggacgagtgaagaattagaaggcaggtgatgtgacaacagtgacctagacattattgcttgaagcagcataatgtagagggtagtactaatagcatcgttgtggctaatgagtttacctactgtcaatacatgactgtgattgtggtgacattgtcttttcaagggcatgtttgcactgaatgtaaataaaacttgtgcgcgc

SEQ ID NO: 24980 - protein, 163 aa, Panicum virgatum
  misc_feature: Ceres CLONE 1861560-R
  misc_feature: SWISSPROT Homolog: EC 2.7.11.1 Non-specific serine/threonine protein kinase
VRKDPGWVAGIFFYLEPEFCRTAIISTKSDVYSFGVICLEIITARNASTFSTKGQSLVVYAWELWSSERAMELIDPALRVEPGTSKILRCFQIALLCVQDNRADRPTMSDVLMMLKCDCLTLPVPRRPEDQWGPRGLSADDRDSAGHTCYSSAGWTSEELEGR

SEQ ID NO: 24981 - DNA, 677 bp, Panicum virgatum
  misc_feature: Ceres CLONE 1861560
agggtctcttctgcaagacattagggggcggcggtatgggatccggcgcgccgtgctgccgccggccggctaccgccgaccttgccgccgtgcgtccctcgctcccttccatatttccaggccaccacttcgtccagtccgctgtggttccctcacccgcgtcgcgtcttcctcggcagcgccggcgccatcgatcgagattcgagaggtcgcgcggcggccggagacggcgagggtccgtgccacctgtatctcgctgagacggcgcccgcacgttcaacttccgttcctcttcttctcaagctgccctgcctgctgggttcctctgcaaaggcccatgcatttcccccccaatcctaccaagaaacagaggtcaggactcttctcctctcgtcgccgccggcgcggcgggtcattaccgattacgcctcctcgggcgagaaggcgggacgcgccgtaagacactcgggctacaaggcggaggcttcgcaagcccctctctcgccgccggaaacggacccggcgggcggagcctcgcattcggcggaaaggcgagagcgccgcgacggtgttcggagaaatgccgcaccggagtccgcggctgaccggcgggttgattggctggttccaagcgtcatctctcgtcacgcagtcttatgccgtatctacaccgatct

SEQ ID NO: 24982 - DNA, 711 bp, Panicum virgatum
  misc_feature: Ceres CLONE 1861565-R
  misc_feature: Encodes the peptide sequence at SEQ ID NO. 24983
atgtggcacctgaatatgccagtactgggatgttaaacgagaggagtgatgtctatagctttggcatacttataatggagatcatcactggtagatctcctgtagattatacaagaccagctggagaggtgaatttggttgaatggctgaagaccatggtcgccgagaggaaagcagaggaagtagtggaccctaagatggctgaaaagccttctcccaaaacactgaagcgggcgctgctcgttgcgcttcgctgcgtcgaccctgatgccaacaagaggcctaaaatggggcatgtaattcacatgctcgaaatggatgatctcctattccgagatgataagagggccggaagggatagttcagacagatacagctccaaggaggatgggagcttcagcaagcgcgagcaccatcggtacagatgatgaactacaacgcaatactagaccaggatatggatgttgtatggattgccactagagagtagcgatattaaccatgttcccattacattctttcccctctcgttcaatctcattgctctttgattgtattatgtatatgccagcatcattctgtggagacacttgatatttgaattacacagacaagtgtagcaagcatggtgctgtgactaacatgcccccagccaatacttgcagttttaaaggcaatgaatccagcaaaatgcaagtacggtttttgtcg

SEQ ID NO: 24983 - protein, 141 aa, Panicum virgatum
  misc_feature: Ceres CLONE 1861565-R
  misc_feature: SWISSPROT Homolog: EC 2.7.11.1 Non-specific serine/threonine protein kinase
VAPEYASTGMLNERSDVYSFGILIMEIITGRSPVDYTRPAGEVNLVEWLKTMVAERKAEEVVDPKMAEKPSPKTLKRALLVALRCVDPDANKRPKMGHVIHMLEMDDLLFRDDKRAGRDSSDRYSSKEDGSFSKREHHRYR

SEQ ID NO: 24984 - DNA, 665 bp, Panicum virgatum
  misc_feature: Ceres CLONE 1861565
aacacttggcattggacatggcttgataaaatgtcagggaatccgaggtggcgaccgtctgtcaacattcatcaatgattcaattccacctgatccacttcgcatggcaccgatctttcggggcaaaaaaaaaaaaaaacttcgcaccgcctcccacgttcaaattcgaaccgcctcccggtccccggccccaacggtcgccgtcctccccaatccccaaattccccaccgctcgtctcgtcgcaccacacccacgccacgccccgactccggaaaaactaattcgagctccagccgcctcgccgctcgcgcaacccccgccgtgatcctctctccgatggcggccgcctcaacacccgctggatccgccgcgccctcttcgcagccggtgcgcgtcgtgctgcgcgtgcgcccgttcctaccgtcggaggccacctctgcggcggcgccctgcgtctccctcctcggcagccaccccggcggcgaggtcaccgtccagctcaaggaccagcacaccagccggagcgagcattataagctggatgcattcttcggtccagaggacagcatcagccagatatttgatcgggaggtcagcacagtgatcccgggcatattcgagggggccaacgccactgtcttcgcctacggggcaactggcagcg

SEQ ID NO: 24985 - DNA, 478 bp, Panicum virgatum
  misc_feature: Ceres CLONE 1861573
  misc_feature: Encodes the peptide sequence at SEQ ID NO. 24986
  misc_feature (95)..(95): n is a, c, t, g, unknown, or other
tagtttgcctcctcttttgcattacctgttggagaaattgtaggacatgcatagtagagcgtgaagatgcatttgcatgcagaagaatcacatgngcccggcacactgtcgctctctctccgatgattccgaggccccgaatctgaacaagtggggagccaatctcacggaaaggggaggggctgctcactgagaagctgatcgcttctgcaactaccgcgacgagcgaccatgaccggggatcgatggaggtacgcggccgcacgcccccgcgcgcccggcaagatcatcctcgcgggcgagcacgccgtcgtacacggctccgccgccgtcgccgccgccatcgacctctacaccacctcttccctccgcctcctccccgcaggagaggatagcggcgcaggcgcggtggagctggacctcagggactcgggcctcaccttctcttggccgtgctcgcgcgtccgcgcggcgctgg

SEQ ID NO: 24986 - protein, 82 aa, Panicum virgatum
  misc_feature: Ceres CLONE 1861573
  misc_feature: SWISSPROT Homolog: EC 2.7.1.36 Mevalonate kinase
MTGDRWRYAAARPRAPGKIILAGEHAVVHGSAAVAAAIDLYTTSSLRLLPAGEDSGAGAVELDLRDSGLTFSWPCSRVRAAL

SEQ ID NO: 24987 - DNA, 748 bp, Panicum virgatum
  misc_feature: Ceres CLONE 1861580
  misc_feature: Encodes the peptide sequence at SEQ ID NO. 24988
gatagctggagcccattacgagttctatcaggtaaagcatcgattgaggacgcgaaccgtcggccgcgagcggccgacaccagagccctgcccaccaccaccccgcgcgcactgcagctagctacccacacacagctcgaaccatcccctcgtccgccggcgccatgtcctcggcggctccgctgctcggctcccgcccggccgacgacggccaccagcaggagcggcggcggtgctcgttgtggctcggccccgtggtggacacggaggaggcgtgggcgcagctgcgcttctcggggccgatgatcctcatgaacatgttctactacggcatcccgctggtgtccgtcatgttctccggccacctcggcgacgtagagctagccggcgccacgctcggcaactcctgggtcaccgtcaccggatacgccttcgtcatcggcctgagcggcggcctggagacgctgtgcgggcaggccttcggcgccgggctgtaccggcggctgggcctgtacctgcagtcgtcgctcatcatgtcggcggcggcgtctgcgctcgtctccgtgctgtgggtgttcacggagccggtgctgctgctcctgcggcaggagccccgggtgtcgcgcgccgcggccgggttcgtccgcgcccagatcccggggctcttcgccttcgcctccctgcagtgcctgctccggtacctgcagatgcagtccgtcgtcctgccgctcgtcgcctttctccgccc

SEQ ID NO: 24988 - protein, 194 aa, Panicum virgatum
  misc_feature: Ceres CLONE 1861580
  misc_feature (46)..(193): Pfam Name: MatE Pfam Description: MatE
MSSAAPLLGSRPADDGHQQERRRCSLWLGPVVDTEEAWAQLRFSGPMILMNMFYYGIPLVSVMFSGHLGDVELAGATLGNSWVTVTGYAFVIGLSGGLETLCGQAFGAGLYRRLGLYLQSSLIMSAAASALVSVLWVFTEPVLLLLRQEPRVSRAAAGFVRAQIPGLFAFASLQCLLRYLQMQSVVLPLVAFLR

SEQ ID NO: 24989 - DNA, 655 bp, Panicum virgatum
  misc_feature: Ceres CLONE 1861600
  misc_feature: Encodes the peptide sequence at SEQ ID NO. 24990
aaaacccccaatccccaaacccccgcccctcctccatggcgggctggagccggcgcgacggcgggatggggggcggcaactacggctcgcagatggatgcgtcgctgaggctcatcgcctccgctgccctcagggggcggaccgccggcatgagtcccgagatggcggaggagatgaagcgctccatagcctcgtcggattgcgaagggagagcagggaggagctacatggagtttctggacagaattactgacgactctgaagaggaagagcacctggggccactgcatgatgcagcaagggaggccaaaatggatacttgcaagcacttggtggagaatcttgggtttgatgtcgatgttcgtgctaatgatggctcgggtaagactcctttggcttgtgcggtgtcgtgtggcaaagtgattgctgtgaggtatcttcttcacaaaggtgctgatgttaataagcaagatgtcatgggcttcgctcctctgcactatactgccaaacgaggatacgatggaatagcacgtctgttgctatctagaggagctaatgttgatttgaattcttctgaagggacaccgctacatgttgctgctgtgcatgggaactctggtgtcatgcagattttgttagagcaccatgccgatcc

SEQ ID NO: 24990 - protein, 206 aa, Panicum virgatum
  misc_feature: Ceres CLONE 1861600
  misc_feature (115)..(147): Pfam Name: Ank Pfam Description: Ankyrin repeat
  misc_feature (148)..(180): Pfam Name: Ank Pfam Description: Ankyrin repeat
  misc_feature: SWISSPROT Homolog: EC 2.7.11.1 Non-specific serine/threonine protein kinase
  misc_feature: The sequence is a functional homolog of SEQ ID NO 1843 in the 10/374,780 US patent application
MAGWSRRDGGMGGGNYGSQMDASLRLIASAALRGRTAGMSPEMAEEMKRSIASSDCEGRAGRSYMEFLDRITDDSEEEEHLGPLHDAAREAKMDTCKHLVENLGFDVDVRANDGSGKTPLACAVSCGKVIAVRYLLHKGADVNKQDVMGFAPLHYTAKRGYDGIARLLLSRGANVDLNSSEGTPLHVAAVHGNSGVMQILLEHHAD

SEQ ID NO: 24991 - DNA, 615 bp, Panicum virgatum
  misc_feature: Ceres CLONE 1861608
  misc_feature: Encodes the peptide sequence at SEQ ID NO. 24992
atcactccctgctcgatcgatcgctcacacacacttcgctacggtgagcagacatcaactcgttgcccgagacagctagcgcacggagcatctatcggaggagcagtgcgactgcaatgtgccactgctccgagccgacacaatgccaccaccaggccctgctcccgccaaccaaggcctgccccgccctgggtgaccgcccgaggccggccggagacggagccgaggcggagtccatcctgcgcctcgccgcgcccatggtcggcgcggggctgctcatgtacatgcgctccctcatgtccatgctcttcctcggcaggctcggccgcctgcccctcgccggcggctccctcgcgctcggcttcgccaacatcaccggctactccgtgctctccggcctcgccgccgggatggaccccgtgtgcggccaggctttcggcgccggccgcacctccgtcctcgacgccgcgctccgccgcaccgtggcgctgctcctggccgcgtccgtgcccatcgccctgctctggctcgacatgcgccgtgtgctcgtcgccgcccgccaagagcccgacattgccgccgccgcgtacgacttcatcctgtgctcgctcccgg

SEQ ID NO: 24992 - protein, 166 aa, Panicum virgatum
  misc_feature: Ceres CLONE 1861608
  misc_feature (47)..(165): Pfam Name: MatE Pfam Description: MatE
MCHCSEPTQCHHQALLPPTKACPALGDRPRPAGDGAEAESILRLAAPMVGAGLLMYMRSLMSMLFLGRLGRLPLAGGSLALGFANITGYSVLSGLAAGMDPVCGQAFGAGRTSVLDAALRRTVALLLAASVPIALLWLDMRRVLVAARQEPDIAAAAYDFILCSLP

SEQ ID NO: 24993 - DNA, 470 bp, Panicum virgatum
  misc_feature: Ceres CLONE 1861626
  misc_feature: Encodes the peptide sequence at SEQ ID NO. 24994
attaccccctgcgaatttttttttctctcaaagctccagagagcttccatggcttccgtcgcctcctccatctcgccgcaccccgtcgacctcctgcgatgtccaagtcgcgaggattggactcgtgaggcagcatgtggccgcggctccggcggcgcgggggctgctcgttcgggcggggcgaccgctgcgggcagggaagccggggaggcacccggtgacggcctccgcggcctcggcggcgcgcgggggcgcccgtggcccacaatgtggcagcctctgctacggcggactacaacgccccgtctcgcgcgctcgaaggtgcgccggcgctggaggggatggatccgtcgctgggcatgtccggatccgagatcttcatcgcctgtactggcgcggaggacatggcgctgatccagcacgcgaagctgacggggcgccccttcctggtgtccagcctggacacgagg

SEQ ID NO: 24994 - protein, 42 aa, Panicum virgatum
  misc_feature: Ceres CLONE 1861626
  misc_feature: SWISSPROT Homolog: EC 1.8.4.9 Adenylyl-sulfate reductase (glutathione)
  misc_feature: Useful for making plants with modulated nitrogen use efficiency
MDPSLGMSGSEIFIACTGAEDMALIQHAKLTGRPFLVSSLDT

SEQ ID NO: 24995 - DNA, 623 bp, Panicum virgatum
  misc_feature: Ceres CLONE 1861627
  misc_feature: Encodes the peptide sequence at SEQ ID NO. 24996
acccatcggccagctcttcatagcggcgcaagatcgaaaaagcagcagccatccagagactttttcagagcgagctcgagtggtgaacggtgaacctgatcccagctacagcagctagcggcaggcagcaaacaggtcgaccggcatgggccgttggttgaagccagatgtgtacccgctgatcgcggccatgtcgttcgtgacggggatgtgcgtgttccagctcacccggaacgtgttcatgaacccggacgtgcgggtgagcaagagcaaccgccaaagcgccgtgctggacaacgccgacgaggggcggcgctacagtcagcacgcgttccgccacttcctcagcacgcagcgcccggaggtcttccccgcgctcaaccggttcttctccgagtcgtcgtcgtccgccggcgacaagtgatgatcagataatcagacgacgacgcggcgtcgatgcctgctgcggcgcgcagtgttcgccgtcgcggcggagcgctgctccggcgttcaggtcgatcgtacgggcgcgtgtgaatattggtgtgcgggtgcgggcgtaagggtgtgcctggagtcatgttatggtgtgtgccgaataaacttgggatttgttggagtcg

SEQ ID NO: 24996 - protein, 92 aa, Panicum virgatum
  misc_feature: Ceres CLONE 1861627
  misc_feature (1)..(87): Pfam Name: B12D Pfam Description: B12D protein
MGRWLKPDVYPLIAAMSFVTGMCVFQLTRNVFMNPDVRVSKSNRQSAVLDNADEGRRYSQHAFRHFLSTQRPEVFPALNRFFSESSSSAGDK

SEQ ID NO: 24997 - DNA, 679 bp, Panicum virgatum
  misc_feature: Ceres CLONE 1861645
  misc_feature: Encodes the peptide sequence at SEQ ID NO. 24998
ccccgcgacgcgagcccgcggccgaaatttcacgcaaccaaaccaaagccccaaggccaaaccggaggagagagatagcagcaaagcgagcgcggggcggcggcaatgtcggcgctgcagagctggcgcaaggcgtacggcgcgctcaaggactccaccaccgtcagcctcgccaacctcaactccgacttcaaggatctcgatgtggcgatcgtgagggccaccaaccacgtggagagcccgcccaaggagcgccacctgcgcaagattgtggcggcgacctccatcgcgaggccccgggcggacgtcgcctactgcatccatgcgctcgcccggcgactagccaagacacggaattggatcgttgccctgaagacacttgtggtgattcataggcttctccgcgaaggtgatcctgcattccgtgaagaatttcttacatttacacagagagtgcggattttgcagctgtcaaacttcaaggatgactccagccctgttgcttgggattattcttcttgggttcgcacatacgggttgtttttggaggaaaaactagaatgcttcagggtcttgaagtatgacattgaagctgagcgtttgcccaaacaaggtcaaggacctgaaaagttccagggccacagtaaaactagagaattaaattctgaggacttgctgg

SEQ ID NO: 24998 - protein, 191 aa, Panicum virgatum
  misc_feature: Ceres CLONE 1861645
  misc_feature (29)..(190): Pfam Name: ANTH Pfam Description: ANTH domain
MSALQSWRKAYGALKDSTTVSLANLNSDFKDLDVAIVRATNHVESPPKERHLRKIVAATSIARPRADVAYCIHALARRLAKTRNWIVALKTLVVIHRLLREGDPAFREEFLTFTQRVRILQLSNFKDDSSPVAWDYSSWVRTYGLFLEEKLECFRVLKYDIEAERLPKQGQGPEKFQGHSKTRELNSEDLL

SEQ ID NO: 24999 - DNA, 686 bp, Panicum virgatum
  misc_feature: Ceres CLONE 1861646
  misc_feature: Encodes the peptide sequence at SEQ ID NO. 25000
acacagcctttgcagccgagttgaatcgtttggttcaaaatctcccttcccattcctctttctctctctctcagccttgttagttggtttggttggcaagagccatggcgctgacgctgcgatccaccacgtcgttcctgtcgcccgtcgaccccatctccaagctcctccacaagcccggcgccgacgacgcgccgccgagctgcgccgccgtgccgtccccgccccacgccgccgcgccgagccgcaggctgcgcctcgtcagggcggccgccgcggcggcgcccgcgccggcggcgggccgcgcgccggccggggccgccgagctgctgcacgccggcggcgcgggccaggagcacgggcgcgcgcgcggcggggtccccgtctacgtgatgctgccgctggacacggtggggcccggcggccagctgtcgcggcagcgcgcggtggcggcgagtctgatggcgctgcggggcgccggggtggagggcgtcatggtggacgtctggtggggcgtcgtccagcgggagggccccggccgctacgactgggaggcctacgccgagctggtgcgcatggtggagcgcgccggcctgcggctccaggccgtcatgtccttccaccatgcggcggcaacgtcggcgacccctgcaacatccccttgcccccctgggtgctggaaggag

SEQ ID NO: 25000 - protein, 193 aa, Panicum virgatum
  misc_feature: Ceres CLONE 1861646
  misc_feature: SWISSPROT Homolog: EC 3.2.1.2 Beta-amylase
MALTLRSTTSFLSPVDPISKLLHKPGADDAPPSCAAVPSPPHAAAPSRRLRLVRAAAAAAPAPAAGRAPAGAAELLHAGGAGQEHGRARGGVPVYVMLPLDTVGPGGQLSRQRAVAASLMALRGAGVEGVMVDVWWGVVQREGPGRYDWEAYAELVRMVERAGLRLQAVMSFHHAAATSATPATSPCPPGCWK

SEQ ID NO: 25001 - DNA, 2229 bp, Panicum virgatum
  misc_feature: Ceres CLONE 1861648
  misc_feature: Encodes the peptide sequence at SEQ ID NO. 25002
cccaaacgctaaacccaccaccggcaaaaccaaaatggcggctctcctaaaccctacgtcccggcgacttgccaccgctgcctgccgccggatctcgacgccggcggcagcggatccccttgtgtctcaccggaagttccaagagagatgcagttccagtctggtggatgtgagtggcaggttcagtgagatgcttgatgctacgcaaaggtactacgtggttggaggcaagggcggtgttgggaagaccagcatggcagcggcacttgctgtgaagtttgccaaccaaggagaaccaacactcatcgtctccacgaacccaacacgatcactgggtgattcatttgaacaagacatgagcgacagcaaagctgtacgtattgatggatttgactccctttttgcaaccgaggtagggaaaattatgcaaaaatgtctactttattctttattctctgagctactgtgattaagcaggtgctgtccagttggaaaataaacaccttggattgtgttgatggtaacccatttcgtatttttagctcactggccatttgctggacttttagtcataattttagcaacaaatccaatgaatataactgctgtctttttttggaaatgtagtgtgtgcaagttgtgtattcaagaataggttggatctttcaagtacattttttatagatattaacatttccacgatgttgacaaattacttctgaatgaccctagaaatcatatggaacaaccatgtgtttcgtgactcgttgctgtaaaacaaatgcttagttttgtttctttgctcaaagttgatccagaacatttcactatcggccagactgctcccaaggggtgatgatgcatttgcattttctgggtcacagatctctttcttgtgatggtagttttcgctttaactatctgttatattgtttggaacatgttcttttacagattagccgtgtgaagttagaggggggaccaggtgttggatcttttatcaacagtttgatgggaagtatggggcttggaacacttgctgatctgtctatgctcaatgagacgctgagtagattccccccgggacttgaagaagcatatgcactatcagaggtatcaatcaaaatttacatgatttattattttctcacgcattttccaaaatacccatcacttgatgcgtatcctctgcagctgataaaatcaatcgaattgcaagggactgataaatttaggcgtatagtgctggatgctccgtccactgttcgtccccgctcacctcaatatttgcaatcaaactatactattcatctttttttttctccatccaccgacaattatttgactaaacatttatttcacagggacatacacttaagcttttgtcagctaataattggattgaaaaattcctcggtatagccattaagggtgtaaatgccgcttcatccatgccaatcttcaaatcgtctcttgagaaatggcaagaaattgtaagtgtgcaatagttcccagtttatttatattaatgtgggcttaaagcaaattacaagcttatcatcttccttgtttcaagtcttcggggctagagaaactaaggcagcagattgccagagtgcatgagcttttggttgatccacgatcaacggaattcatcattgtcacaattccaacgatgatggcagttagcgagtcatcaagattccactcatctttaaagaagtatggtgcacacacaagaaggcttgtcgtaaatcaagtgctaccaccgtctgcatccgactgcagattctgtgctgcaaaacggagggaacaagcacgcgccttcagtgcgataagggaggaccgcgaactcaggggcttgaagctgatccaggctccgctccttgatgtggagttgaaaggcgtccctgcacttcgattcctgagcgattcagtgtggaaatagctgacaccttagaaacctttttcatcggcatttcttcttctgaatttcatcttactggtacctactactatggcccacttgtgacgcacaaaagtatggttaagcctggacaccagaagatatgcacaccagaatcacattgttcaggttgtagagctgtagacgcttgcgtaccagcagagaacccaggcttgcttaacacacgtttgttaccagtgtttgttcccagaaacctgaaggggataagattgaacgacccagcagcgggccttttgtctgcc

SEQ ID NO: 25002 - protein, 144 aa, Panicum virgatum
  misc_feature: Ceres CLONE 1861648
  misc_feature: SWISSPROT Homolog: EC 3.6.3.16 Arsenite-transporting ATPase
MAALLNPTSRRLATAACRRISTPAAADPLVSHRKFQERCSSSLVDVSGRFSEMLDATQRYYVVGGKGGVGKTSMAAALAVKFANQGEPTLIVSTNPTRSLGDSFEQDMSDSKAVRIDGFDSLFATEVGKIMQKCLLYSLFSELL

SEQ ID NO: 25003 - DNA, 719 bp, Panicum virgatum
  misc_feature: Ceres CLONE 1861662
  misc_feature: Encodes the peptide sequence at SEQ ID NO. 25004
aagaatcaaagctcaaagctgcagaggcttccaatcatttcttcgttccggtttggctgggtgatcgatcctgccgtcttcgtgtcagtcccaagacgccgagatgtacctggtgaaagacattagcggcgccatcggcctgatggcggtggcgctggtgctcctgggcacctggcctgttgtcctggccgtgctggagcgccggggccggctgccgcagcacaccttcctggacttctccgtcaccaacttcctcgccgccgtgctcatcgccctcaccttcggccaaatcggccccgacacgccggagacgcccaacttcctcacccagctcactcagaataactggccgtcagtcttgttcgcgacggccggcggcgtcaccctcagcctcggcacgctggccacgcagtacggctgggcgttcgtcggcctttcggtcaccgaggtcatggcatcgagcctgaaggtcgtcatagggacaactctgaactactttctcgacggtcggatcaacaaggcagaggtcctgttccccggtgtcgggtgctttctgatcgcggcgatcctcgggtcacttgtccactcttccaatgctgccgacaacgaggagaagctggctaagtccctggccaattacagcaaaaacactaggaacagtacatatgaggatctcacgaaacaactccttgatgaggaagagagaccaaaggaccttg

SEQ ID NO: 25004 - protein, 205 aa, Panicum virgatum
  misc_feature: Ceres CLONE 1861662
  misc_feature (14)..(205): Pfam Name: FAE_3-kCoA_syn1 Pfam Description: Fatty acid elongase 3-ketoacyl-CoA synthase 1
MYLVKDISGAIGLMAVALVLLGTWPVVLAVLERRGRLPQHTFLDFSVTNFLAAVLIALTFGQIGPDTPETPNFLTQLTQNNWPSVLFATAGGVTLSLGTLATQYGWAFVGLSVTEVMASSLKVVIGTTLNYFLDGRINKAEVLFPGVGCFLIAAILGSLVHSSNAADNEEKLAKSLANYSKNTRNSTYEDLTKQLLDEEERPKDL

SEQ ID NO: 25005 - DNA, 723 bp, Panicum virgatum
  misc_feature: Ceres CLONE 1861672
  misc_feature: Encodes the peptide sequence at SEQ ID NO. 25006
actccactcgaattagaaccctagcggcaaaaacctcggtccgcgccgccgcctgctcctcccgtcccgccgccggcgccaccgcccgcttccgccgaggggctcgccgtccggggcgctctcgcgcggcgctgcgcctctccacgcgccgccgtcctcggctgccatgatctgcccgatctccggcgaggtgccggccgagccggtggtgtccaagaagtcggggctcctcttcgagcggcggctcatcgagcgctacattgaggaccatggcaagtgtccggtcaccaaggaggagctcaccatggacgatatcgtgccggtcaagaccaacaaggttgtgaagccgaggcctttgcagtctgcaagcattccaggacttcttgggatatttcaaaacgagtgggatgctctcatgctttctaattttgctttggagcagcagcttcacacagcaagacaagaacttagtcatgcactctatcagcatgatgctgcctgccgtgttatagccagattaaagaaggaaagagatgaggcaagaacacttttggcccaagctgagagacagattcctgcatcacttgcaggagctgctcctgcaactgtagtttccaacggaaaaagagcaatggaagatgaaattggccctgatggcaagaagattcgtcctggtatcaaccctgtcatgatcgaagaacttacagaatgcaataccatgct

SEQ ID NO: 25006 - protein, 185 aa, Panicum virgatum
  misc_feature: Ceres CLONE 1861672
  misc_feature (64)..(133): Pfam Name: Prp19 Pfam Description: Prp19/Pso4-like
  misc_feature (2)..(70): Pfam Name: U-box Pfam Description: U-box domain
MICPISGEVPAEPVVSKKSGLLFERRLIERYIEDHGKCPVTKEELTMDDIVPVKTNKVVKPRPLQSASIPGLLGIFQNEWDALMLSNFALEQQLHTARQELSHALYQHDAACRVIARLKKERDEARTLLAQAERQIPASLAGAAPATVVSNGKRAMEDEIGPDGKKIRPGINPVMIEELTECNTM

SEQ ID NO: 25007 - DNA, 1106 bp, Panicum virgatum
  misc_feature: Ceres CLONE 1861676
  misc_feature: Encodes the peptide sequence at SEQ ID NO. 25008
agctaaggcctcaaagcccatcttagcttgcacgagcagctagcgctcatggcagcgatgcgggccctcttcgtcctcatccccgttctgctgctaacaacccatcagcagctcgccggcggcagccccccgccggaccccgtgtcctgcgcgcgcggcacgtcggactgcacggtgacgaacacgtacggctccttcccggatcgcaccatctgccgggccgccaacgccacgttcccgagcaccgagcaggagctggtggcggccgtggcggcggcggccgccgcccggcgcaaggtcaaggtggccaccagccactcccacagcttcccgaagctggcctgcccgggggggcgcgacggcaccatcatcagcaccgagcggctgaaccggacggtgggcgtggacaaggccaggcggctcctgacggtggagagcggcatgctgctgagggacctggtcaaggtcgccgccgacgccggcctggccctgccgcactcgccttactggtacgggctcaccgtcggcggcatgctggccaccggcgcgcacgggagctcgctctggggcaagggcagcgccgtgcacgagtacgtcgtcggactcaggatcgtcacgcccgcgccggccagccaggggttcgccgtcgtccgggagctcggcgccagcgaccccgacctcgacgccgccaaggtctccctcggcgtcctcggcgtcatctcccaggttactcttgagctgcagccgcagttcaagcggtcggtgacgttcgtgacgcgcgacgacaaggacatggcagcgacgctggccgcgtggggcggcctccacgagttcggcgacgtgtcgtggctgccgcggcagggcaaggccatctaccgcgaggacaaccgcgtcgacgtctccacgccgggcaacggcctcaacaactacctcggcttccgggcgcagccgacgctggggctcctcaccgcccgggccgccgaggagcggctggaggaggacggcaccgacatcgcccggtgcctggcggcgcggctgccggcggcgacgttcgagctccaggcctacggcttcaccaacgacggcgtcttcttcacggggtaccc

SEQ ID NO: 25008 - protein, 352 aa, Panicum virgatum
  misc_feature: Ceres CLONE 1861676
  misc_feature (58)..(205): Pfam Name: FAD_binding_4 Pfam Description: FAD binding domain
  misc_feature: SWISSPROT Homolog: EC 1.1.3.8 L-gulonolactone oxidase
  misc_feature: Useful for making plants with modulated nitrogen use efficiency
MAAMRALFVLIPVLLLTTHQQLAGGSPPPDPVSCARGTSDCTVTNTYGSFPDRTICRAANATFPSTEQELVAAVAAAAAARRKVKVATSHSHSFPKLACPGGRDGTIISTERLNRTVGVDKARRLLTVESGMLLRDLVKVAADAGLALPHSPYWYGLTVGGMLATGAHGSSLWGKGSAVHEYVVGLRIVTPAPASQGFAVVRELGASDPDLDAAKVSLGVLGVISQVTLELQPQFKRSVTFVTRDDKDMAATLAAWGGLHEFGDVSWLPRQGKAIYREDNRVDVSTPGNGLNNYLGFRAQPTLGLLTARAAEERLEEDGTDIARCLAARLPAATFELQAYGFTNDGVFFTGY

SEQ ID NO: 25009 - DNA, 670 bp, Panicum virgatum
  misc_feature: Ceres CLONE 1861676-R
  misc_feature: Encodes the peptide sequence at SEQ ID NO. 25010
ttctgtggttggactccgttcctgcatttctgaaggtgcagttatagaggactctttgctaatgggtgcagactattacgagactgaagatgataagaaagtcctttcagagaccggcggtattcccattggtattgggaagaatgcacatatcagaaaagcaataatcgacaagaatgctcgtattggagaaaatgtgaagataaccaattttgataatgtccaagaagcagtaagggaggcagaaggatactttatcaaaagtggcatagtcacggtgattaaggatgccttgatccctagtggaacagtcatatagagtcaaccttcaccgtgtacataaggttggtttgcagcagatgctgatcaccgatgaacattaagttgtttccatcccttccagaacatggtttctttccatgttgcaaaatcatatcaccaagttccacatcaacttgcgagggtataatgaaataatagaatggagttattcaaaggcgccattttccaacaactagcatgaggctctgttcaaaatgtattgttgagtggaatttggatatcttgatatgtataatgtatccttttgcgctttcagacttcaaaatacattgttcttgaactctttgttaccttaatatgctccctgcattgcctgggaatgaggatt

SEQ ID NO: 25010 - protein, 105 aa, Panicum virgatum
  misc_feature: Ceres CLONE 1861676-R
  misc_feature: SWISSPROT Homolog: EC 2.7.7.27 Glucose-1-phosphate adenylyltransferase
  misc_feature: The sequence is a functional homolog of SEQ ID NO 37 in US patent 7312378
  misc_feature: The sequence is a functional homolog of SEQ ID NO 38 in US patent 7312378
  misc_feature: The sequence is a functional homolog of SEQ ID NO 39 in US patent 7312378
SVVGLRSCISEGAVIEDSLLMGADYYETEDDKKVLSETGGIPIGIGKNAHIRKAIIDKNARIGENVKITNFDNVQEAVREAEGYFIKSGIVTVIKDALIPSGTVI

SEQ ID NO: 25011 - DNA, 2486 bp, Panicum virgatum
  misc_feature: Ceres CLONE 1861687
  misc_feature: Encodes the peptide sequence at SEQ ID NO. 25012
aaaaccctcgccgtcgatctcgtcggcaccgaccatggaggcgcagaccggcgccgcccccggcggcggcgacgacctcgcaaccatgcgcgagcagtgccgagccctggaggagtccatcgccgcccgccgggaggcgcagctcgacctcatcggctccctgcagcacctcgtcacggacctggtgccgtccctcgaccaatccctccgcctcatcgccgccttcaacggccgccctttcgtccccacgctctaccccaacgccagtgcccacgcgcagagccacaacctcaagccccaccaccgccgcgccctccccgacccggcccgctccacccgccgcaagacctcgccgggctcctccccggcccctgccgccgcggggggctcgggcgccgttggcggcatcgacgctgtgcgcaccatggttgccgtgtgcctcctcgagctcgtccccttctccgagatcgacgccgccgcgctcgcgcgccgcctgcaggcggagacgtcgtccgccagcgaggccgagcgggcggcccttgccgacctcgccacggagcttggaggttccgcgcctgctgcggttgccctcgcgctccgtcgcatctcggaggacagcggcgccttgcagatcgaggaggccttcattggaggaaagcagatgacaattgtctgggccattgaccggagcaaactcctcaaagagctacctgaatccgcctccgtgccccaagtccaacctccgccaactccacaggcgcccccgaccgagactgatgctaacagcgccatcataccgaggcctccgccgctgcagcagccggagatgtggggtcacccaatgcaaccgatgttcccacgccccaggggcatggcaatgccgaggatgccgccagggttgatgccactgcagcggccattcatggcgccaggggcagttatgccaatgggtggtggcccggggctgagccctactcagatgaagcagaggacagaggaggaggaccttaaggaccttgagctgctgctgaacaagaagacatatagagagaagcagaatacgaaaactggagaggagctgctggatctcattcaccggcctacggcaaaggagacggctgtcgcggcaaagtttaaaacaaagggtggctcccagctaaaggaatactgcaccaatttaactaaggaagattgccgacgccaaacaggttcctttgtcgcctgtgataaggtccactttcggcgtattattgctccacatactgatacaaacctaggagattgctctttcctggacacatgtcgtcacacaaagacttgcaagtatgtccactacgaacttgatcaaacaccagatgtacctccaatgatggctggtgccctcgcaccacctaggcaaataaagccccagagagctgaatattgttcagaaatagagctaggagaatctcaatggataaactgtgacatccggaacttcaggatggacatcttaggacagtttggagtaattatggctgatcccccctgggatattcatatggagctgccatatggcacaatggctgatgatgaaatgaggacacttaatgttccagctttgcaaactgatggtttgattttcttatgggtgactggtcgtgctatggaacttgggcgtgaatgtctggagctctggggttacatgcgtgttgaagaaattatctgggtgaagaccaatcaacttcaacgtatcatccgaactggccgcactggccattggttgaatcacagcaaagagcattgtcttgttggaataaaaggaaaccctttagtgaacaggaatatagatactgatgttattgttgccgaagtccgtgagactagcagaaaacctgatgagatgtacgccatgctagagcggataagcccgaggacaaggaagctggaactgtttgcaagaatgcataatacacaagctggatggctttctctgggtaaccagttaaatggagtaaggcttgtggatgaagggttgagagcaaggtacaaggctgcttaccctgatgtggaggtccagctgccatcacctcccaggacgagcgggccaatggatgctgagcaaactagttcacagaaagctgctgcaccagatggcggtgagaggccttcctgatgctggcaaccttacatccaagtgcctggctgtgcatccaagtgccctaaacccttacatccaaccatacactgttagcgttacgtctgttgtaaaattaggcagctcggttgtattttgttgcacaaaaaaagtggaattaggcagctcggttgtattttgttgcacaaaagaagaggctggaggattgttatatgtgtcgaggggtatcggatgaaaggagtagcatcgtaacagccccagttttattgcaactgaaatgtaatcaagggcttgttatcaggccccgtcttgttttccagattccaagtgcatgggtatgccgaaattt

SEQ ID NO: 25012 - protein, 706 aa, Panicum virgatum
  misc_feature: Ceres CLONE 1861687
  misc_feature (490)..(650): Pfam Name: MT-A70 Pfam Description: MT-A70
  misc_feature: SWISSPROT Homolog: EC 2.1.1.62 mRNA (2'-O-methyladenosine-N(6)-)-methyltransferase
MEAQTGAAPGGGDDLATMREQCRALEESIAARREAQLDLIGSLQHLVTDLVPSLDQSLRLIAAFNGRPFVPTLYPNASAHAQSHNLKPHHRRALPDPARSTRRKTSPGSSPAPAAAGGSGAVGGIDAVRTMVAVCLLELVPFSEIDAAALARRLQAETSSASEAERAALADLATELGGSAPAAVALALRRISEDSGALQIEEAFIGGKQMTIVWAIDRSKLLKELPESASVPQVQPPPTPQAPPTETDANSAIIPRPPPLQQPEMWGHPMQPMFPRPRGMAMPRMPPGLMPLQRPFMAPGAVMPMGGGPGLSPTQMKQRTEEEDLKDLELLLNKKTYREKQNTKTGEELLDLIHRPTAKETAVAAKFKTKGGSQLKEYCTNLTKEDCRRQTGSFVACDKVHFRRIIAPHTDTNLGDCSFLDTCRHTKTCKYVHYELDQTPDVPPMMAGALAPPRQIKPQRAEYCSEIELGESQWINCDIRNFRMDILGQFGVIMADPPWDIHMELPYGTMADDEMRTLNVPALQTDGLIFLWVTGRAMELGRECLELWGYMRVEEIIWVKTNQLQRIIRTGRTGHWLNHSKEHCLVGIKGNPLVNRNIDTDVIVAEVRETSRKPDEMYAMLERISPRTRKLELFARMHNTQAGWLSLGNQLNGVRLVDEGLRARYKAAYPDVEVQLPSPPRTSGPMDAEQTSSQKAAAPDGGERPS

SEQ ID NO: 25013 - DNA, 1813 bp, Panicum virgatum
  misc_feature: Ceres CLONE 1861692
  misc_feature: Encodes the peptide sequence at SEQ ID NO. 25014
aacctgcacctcagctgtgcggtctgcggcggcggcgaaatggcggaaccggactggatcctggagagggagcggaggcagatggagcagatcctcgagctggacatggaggagctccaggtcgaggaggtcgacgacgacggctccacctcctcctcctccgttgacactttcctcagaaatactcatagagatggagggattagcacttctgaggagctaacagttgacacatctatggtttccttgcaagctaacacctatcttgaagcaaaggttgatggtacccgaggcaaatttactttcttggattgcgacagagtcctcaatttgccgatgctttatcttcaaggtgttgttttgtttcctgaagctttcctacctcttcgagtaattcagcctagattagcagaagctattgacaaggctgtcaatcatgttgatgctccatgcatgataggtgtggttcatgcttatcgaagtgcaaatgatggacatcatactattgcttctgtcggaacaacagcagagatacaggaaattcaacagttggatgatggttcatcatgtgttttctctcggggtcagcagcgatttcgtcttgcacgccattggttggacatcgatggagtaccatggggtgaagtccacattattgaagaagatacacctcaaagaactccaagagatgcttttggacagttagctgcaagtaatggtttcaggcaatgtgattcatcagtccctagtgtgtatgtgtcatgttctaaacaacttgatcacgtggattctgaaatagatggggtatctctatcacccactagctcttcaagtgatcactcagtaaaagataaaagagtatacctttcaggcttgttggcgtgtggtagtttggatgaatcctcaaatgaagatgaagatcccatacatgaacagtcctgttggcgccatgattctgatgggtgcagccagccagataagcatacaaacacaggagatgaggatgatctctgctccacatcctttttgggagtaagtaaggaaaataccgaacaaaggagacactactggagtggctataccacaaagatggcatcacaggctccattgtcattttggcctcgctgggcttatgaaatgtatgatccgtattcacttgctaggagagctgcagatttgtggagacaggttattgtaaacccttgcatggatgttcatgtgaaaaagccgaatcatttgtccttttacattggaagcaatcttccgatctcattatctctaaggcaagaattacttgagattgatggaatctcatatcgactacagcgagagattcagcttctcaaagctttcaatatcatacgatgcagaatttgtctgacttctattgcaagacgaagcgacatggtgatgatatccagctccgacgctattggttcttacagttctgtgaaagagttgattacagtacacagtgtcacaaaccttgcactgcgtggtgacccgtccaaaattcacagctggtttccaggatacacatggacgattgcactgtgtgctgcctgcgagtccaacataggctggctgttcagagctgacaagaagaacctgcatccaaaatctttctgggggatacgcacctcccaaatttctgatgatacgcaatcaagacaggtctgatcagatcagatcatccatgtatgactttcgtgacagtggcttgcagcaacccaagtacttctgccctctcttcattgcaagatgcaatttgccctgctacttcctacaaatacaaagggaaagagttttcagc

SEQ ID NO: 25014 - protein, 546 aa, Panicum virgatum
  misc_feature: Ceres CLONE 1861692
  misc_feature (97)..(437): Pfam Name: LON Pfam Description: ATP-dependent protease La (LON) domain
  misc_feature: SWISSPROT Homolog: EC 3.4.21.53 Endopeptidase La
MAEPDWILERERRQMEQILELDMEELQVEEVDDDGSTSSSSVDTFLRNTHRDGGISTSEELTVDTSMVSLQANTYLEAKVDGTRGKFTFLDCDRVLNLPMLYLQGVVLFPEAFLPLRVIQPRLAEAIDKAVNHVDAPCMIGVVHAYRSANDGHHTIASVGTTAEIQEIQQLDDGSSCVFSRGQQRFRLARHWLDIDGVPWGEVHIIEEDTPQRTPRDAFGQLAASNGFRQCDSSVPSVYVSCSKQLDHVDSEIDGVSLSPTSSSSDHSVKDKRVYLSGLLACGSLDESSNEDEDPIHEQSCWRHDSDGCSQPDKHTNTGDEDDLCSTSFLGVSKENTEQRRHYWSGYTTKMASQAPLSFWPRWAYEMYDPYSLARRAADLWRQVIVNPCMDVHVKKPNHLSFYIGSNLPISLSLRQELLEIDGISYRLQREIQLLKAFNIIRCRICLTSIARRSDMVMISSSDAIGSYSSVKELITVHSVTNLALRGDPSKIHSWFPGYTWTIALCAACESNIGWLFRADKKNLHPKSFWGIRTSQISDDTQSRQV

SEQ ID NO: 25015 - DNA, 662 bp, Panicum virgatum
  misc_feature: Ceres CLONE 1861704
  misc_feature: Encodes the peptide sequence at SEQ ID NO. 25016
ggcaaacccgcctgcctgccagtgccatcccttggcttggcttccctctcctccgcttctcaccaggccagcagccattttatccgccgtcggctggtcccggtccctggttcgcgcgcgaggcggccgcgtggttcacgtgcgcgcggggttgggttgggatcatttgggtgcgttgcgtccggggtcggtggcggcgcgggagatgaagagcggcggcggaggaggaggagacgggggtgggggagggggcaggcaacagtggccgtgcgactactgcggggaggaggcggcggcgctgcactgccgcgcggacgcggcgcggctctgcgtggcgtgcgaccgccacgtgcacgccgccaacgcgctctcgcggaagcacgtgcgggcgccgctctgcgcgggctgcgcggcgcgcccggccgccgcgcgcgtcggggccgaggcggcggcgttcctctgcgcggactgcctcgagggccgcggcgacgggggcgtcgcggtcgaggggttctcgggctgcccctcggcggccgagctcgccgcgtcgtgggggctcgacctccgcggcgcgggcgccgccgccgggtgcggtgagggcgacgccggggaggaggccgaggaccacgccttcttctcggcgctcgactactccatgctgg

SEQ ID NO: 25016 - protein, 152 aa, Panicum virgatum
  misc_feature: Ceres CLONE 1861704
  misc_feature (17)..(64): Pfam Name: zf-B_box Pfam Description: B-box zinc finger
MKSGGGGGGDGGGGGGRQQWPCDYCGEEAAALHCRADAARLCVACDRHVHAANALSRKHVRAPLCAGCAARPAAARVGAEAAAFLCADCLEGRGDGGVAVEGFSGCPSAAELAASWGLDLRGAGAAAGCGEGDAGEEAEDHAFFSALDYSML

SEQ ID NO: 25017 - DNA, 134 bp, Panicum virgatum
  misc_feature: Ceres CLONE 1861704-R
tgtagaagaaagaaaaaagaagagaattaaatggagttaaaagtgaggaaagatgtagggaaaagaaggtgttaataaagtggatattggaagataaaatggagatgaatatgggttagaagaaaagtgaataa

SEQ ID NO: 25018 - DNA, 676 bp, Panicum virgatum
  misc_feature: Ceres CLONE 1861708
  misc_feature: Encodes the peptide sequence at SEQ ID NO. 25019
atcactcccccagcgcgcgcggctaaggtcgttagttgccgtcggggcccgggcgacgagctaggcaagaacgaagcatcgtcttctatttcttgatcggcgatcgacgagacgtgatgatgggcggcggcggcggatggccgcggcgacgctggtggagatgcgcctgctggtgcgcctggcggcgcccgccgtgctcgtctacatgatcaactacctcatgtccatgtccacgcagatcttctcgggccacctcggcacgctcgagctcgccgccgcctcgctcggcaacaccggcatccagatcttcgcctacggcctcatgctcgggatggggagcgcggtggagacgctgtgcgggcaggcgtacggcgcgcacaagtacgacatgctgggcgtctaccttcagcgctccacggtgctgctcatggccactggggtgccgctcgccgccctctacgcctactcccgccccatcctcgtcctcctcggcgagtccccggagatcgcgtccgccgccgccgtcttcgtctacggcctcgtcccgcagatcttcgcctacgccgccaacttccccatccagaagttcatgcaggcgcagagcatcatggcgcccagcgcctacatctccgccgccacgctcgccgcccacctcgtcctcagctacctcgtcgtc

SEQ ID NO: 25019 - protein, 179 aa, Panicum virgatum
  misc_feature: Ceres CLONE 1861708
  misc_feature (18)..(178): Pfam Name: MatE Pfam Description: MatE
MAAATLVEMRLLVRLAAPAVLVYMINYLMSMSTQIFSGHLGTLELAAASLGNTGIQIFAYGLMLGMGSAVETLCGQAYGAHKYDMLGVYLQRSTVLLMATGVPLAALYAYSRPILVLLGESPEIASAAAVFVYGLVPQIFAYAANFPIQKFMQAQSIMAPSAYISAATLAAHLVLSYLV

SEQ ID NO: 25020 - DNA, 1217 bp, Panicum virgatum
  misc_feature: Ceres CLONE 1861726
  misc_feature: Encodes the peptide sequence at SEQ ID NO. 25021
aacccaccgaacggaacgagacccccaacacacgtcaaagcggaaagcctcagataacccccaggaaatcgtattataatctcgccctccactccccttgctccgctgcaactccactcggccgccccccaccctgatccttcccccagccattggtgcgtgcttgatcggatccatggacacccacatcggatccgtggacgggccggcgctggcggcggcgaacggcgcggtgggctgcccggcgtcggcgccggggtgcccgatggcgtccacgccggcgctgacggccggggaggcgtcgctggggcgccacctcgcgcgccgcctcgtgcaggtcggcgtcggcgacgtcttcgccgtccccggggacttcaacctgacgctgctcgaccacctgatcgccgagcccgggctgcgcctcgtcggctgctgcaacgagctcaacgccgggtacgccgccgacgggtacgcgcgcgcgcggggcgtcggggcgtgcgccgtcacgttcaccgtcgggggcctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccaccaggcggtggtgaccaatctggaggacgcgcacgagcagatcgacacggccatcgccacggcgctgagagagagcaagccggtgtatctcagcattagctgcaatctccccgggctacctcaccctacctttagccgcgatcccgtgccgttcttcctctcccccagaatgagcaacaagatgggactagaggctgcaattgaggcaactgttgagttcctgaacaaggccgtgaagccagtgcttgttggtggccccaaactgcgtgtggcaaaagcaggaaaggcatttgtggatctggtagatgccagcggctatgcatacgcagtgatgccatcggcaaagggacttgtgccagagacgcacccacacttcatcggcacctactggggtgccgttagcactgccttctgtgctgagattgttgagtcggctgatgcctacctctttgccggccccattttcaatgactacagctctgttggctactcttttcctcttcaaaaggacaaggccttcatcg

SEQ ID NO: 25021 - protein, 347 aa, Panicum virgatum
  misc_feature: Ceres CLONE 1861726
  misc_feature (42)..(218): Pfam Name: TPP_enzyme_N Pfam Description: Thiamine pyrophosphate enzyme, N-terminal TPP binding domain
  misc_feature (240)..(346): Pfam Name: TPP_enzyme_M Pfam Description: Thiamine pyrophosphate enzyme, central domain
  misc_feature: SWISSPROT Homolog: EC 4.1.1.1 Pyruvate decarboxylase
MDTHIGSVDGPALAAANGAVGCPASAPGCPMASTPALTAGEASLGRHLARRLVQVGVGDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLSPRMSNKMGLEAAIEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFPLQKDKAFI

SEQ ID NO: 25022 - DNA, 755 bp, Panicum virgatum
  misc_feature: Ceres CLONE 1861726-R
  misc_feature: Encodes the peptide sequence at SEQ ID NO. 25023
ggcctccaccggcgcgggcaagtacggcctctccgtcgtctccagcggcgacgacgtgtcgctggacaccggtttgggcaagtcccgcgtcgcgtctaccgtgctcgacaacacaccgacggtcatcctcacggtggacaaattgctgctcccgtccgagcttttcggcggcgcgccgtcccccgcgccggcgcccggaccggccgccgacgtgcccgtttcggccccggctcccgaaacatctgcgcccgcaccctcccccaaggccgcgggcaagaagaagaagaaggccaagtccccttcgcactccccgcccgcgcccccgtcggactcgcccgacctggcccccgccgacgcgccggagggtgacgccgcagacaaggcagactcgaagaagaacggcgccgccgcagcggccgtgaacttcgcggccacggtggcctgcatcgccctggccgtcgcggccttcttgtgagcgggcgagcggcaggtgttcgacgccgagcccccgcatagttattctccctctgagcatgcgtgatctgacgcaatgcaatctgttgttgctcgtgagttctcgtgggctccattgataatttgatatgctcatcaggtgtttctccttcttcctggtttgcttgttggtaggtagtggaagtaagaatttgttaggatttggtcctccacttatcaggtggagatgaagagctaggaactgtcatttgaggtttatttgttcttcctattgtcctgtc

SEQ ID NO: 25023 - protein, 157 aa, Panicum virgatum
  misc_feature: Ceres CLONE 1861726-R
  misc_feature: Useful for making plants with altered carbohydrate content
  misc_feature: Useful for making plants with altered cell wall content and/or composition
ASTGAGKYGLSVVSSGDDVSLDTGLGKSRVASTVLDNTPTVILTVDKLLLPSELFGGAPSPAPAPGPAADVPVSAPAPETSAPAPSPKAAGKKKKKAKSPSHSPPAPPSDSPDLAPADAPEGDAADKADSKKNGAAAAAVNFAATVACIALAVAAFL

SEQ ID NO: 25024 - DNA, 1890 bp, Panicum virgatum
  misc_feature: Ceres CLONE 1861728
  misc_feature: Encodes the peptide sequence at SEQ ID NO. 25025
tttgattaccttctatatactccagactttgaatggcaagagtactctgcctatcacagttccgcaggactcgtgtgacatgcctgcctactgcaagccgtactccatttgcaaccgtggtacagggtgccagtgcccttcagccctcagctcttatgccaactgcaaccctggcatcatatcaccatgcaactcaaaggacaagtttcagctggctcaactggacaccggtgttgggtatgttggcactagcttcaagtcgcctgtacccaagacaaacctcacaggatgcaagaattattgcatggttaactactcatgcatctctgtattctttgaccaaacgtcaggcaattgcttccttttcgaccagataggtagcttgcaacagaaagatggaggtaagagtagttttgcttctttcatcaaggtgtcaagcagtaaccgtggctcagagcaaggtggaagtggcagtggtaggctaaccatcattatagttgtcattatagttggaactttggttgtcataggggtccttgtgtatgttggtttccgcatttaccgaaggagacatcatccaccctcgcaagatgatgctggttcatcggaagacgatggtttcctgcaaactatatcaggagcaccgacacgctatacctacaaggagctccaggatgcaacaaacaacttctcagataagcttggtcaaggaggctttggatctgtgtatcttggtaccctgcctgatggcagtcgcatcgctgtaaagaagctagagggcataggccaagggaagaaagaattccgctctgaggtgaccatcattggcagcattcaccatatccatcttgtcaaactccgaggtttctgtgtcgagggtgctcacaagcttcttgcatatgaatacatggcaaaggggtcactggataggtggattttccaaagtaatgagggttcctccctgctagactgggatacaaggtttaacattgcacttggaacagcaaagggattgacatacctccatcaggactgtgagtcaaagatcattcactgtgacatcaagcctgagaatgttctacttgatgacaacttccttgcgaaggtgtctgactttggccttgccaagttgatgaccagggagcagagccatgtctttacaacgctcagaggcacgcggggctaccttgcacctgaatggataacgaactatgccatctcagagaagagtgatgtgtacagctatgggatggtcctgctagagataatcagtgggaggaagagctatgaccctgtggaaagctcagagaaagctcacttcccctcctatgccttcaagaagctggaagaaggtgaccttcgcgatatctttgatgtcaagctaaaatacaacgacaaggatgagcgagttcaggtggcaatcaaggtcgcactgtggtgcattcaggaggacttctatcagagaccatccatgtcgaaggtcgtacaaatgctggaaggcgtctgcgacgtgccccagccaccaatatcttcgcagattggataccggctttatgcaaacgccttcaaatcgagcagtgaagagggaacatcatcagggatgtcggacaacagcaatgctctgctttctgctgtgcggctctctgggcccagatgaaatgaatcatatgtacattgctgtgctttagctagcgttatgttcaattttggggaaggtctatggtttggtgttcatttgctcatagtcatgtatatatatgttgtagatagaaactcgatcgcaattttgcatctatacacaaagatttctcagattccgtattgaagctgtgatcagggatatatgccaaacttactgatgttgatgatgtataaacatcttaagtctag

SEQ ID NO: 25025 - protein, 551 aa, Panicum virgatum
  misc_feature: Ceres CLONE 1861728
  misc_feature (228)..(498): Pfam Name: Pkinase Pfam Description: Protein kinase domain
  misc_feature: SWISSPROT Homolog: EC 2.7.11.1 Non-specific serine/threonine protein kinase
LITFYILQTLNGKSTLPITVPQDSCDMPAYCKPYSICNRGTGCQCPSALSSYANCNPGIISPCNSKDKFQLAQLDTGVGYVGTSFKSPVPKTNLTGCKNYCMVNYSCISVFFDQTSGNCFLFDQIGSLQQKDGGKSSFASFIKVSSSNRGSEQGGSGSGRLTIIIVVIIVGTLVVIGVLVYVGFRIYRRRHHPPSQDDAGSSEDDGFLQTISGAPTRYTYKELQDATNNFSDKLGQGGFGSVYLGTLPDGSRIAVKKLEGIGQGKKEFRSEVTIIGSIHHIHLVKLRGFCVEGAHKLLAYEYMAKGSLDRWIFQSNEGSSLLDWDTRFNIALGTAKGLTYLHQDCESKIIHCDIKPENVLLDDNFLAKVSDFGLAKLMTREQSHVFTTLRGTRGYLAPEWITNYAISEKSDVYSYGMVLLEIISGRKSYDPVESSEKAHFPSYAFKKLEEGDLRDIFDVKLKYNDKDERVQVAIKVALWCIQEDFYQRPSMSKVVQMLEGVCDVPQPPISSQIGYRLYANAFKSSSEEGTSSGMSDNSNALLSAVRLSGPR

SEQ ID NO: 25026 - DNA, 1270 bp, Panicum virgatum
  misc_feature: Ceres CLONE 1861730
  misc_feature: Encodes the peptide sequence at SEQ ID NO. 25027
ttgttgtgacagtgcaatagtcatcgaaaacacatcccagtagcttccatggccgtgaaaaacttgtgcccgagctcaagcagcagagctcatcatcagctgcttctgctcttcttttccttggccgtgtcaccgcacgtccctcgtgccagttctctctccttcagctacaacgccttcaacccctatgacttcaagccggaggccgacgcgagggtcaaagacggcaggctggagctgctcggcgacgagtttgcggcgcgtgccaggggccgggcgtggcacaagcagttttttttgctctgggacggcgccaccggcaagtctgccagcttcgccgcgaacttcaccttcagcatccagtccgtgccagccggcaagggcgctcccggcgtcgggcacggcatgacattcttcctcgcgccgtacccgccggacctgccgcaggagtcctacgacggctgcctcggcctcttcgacgagaaccagaaggacaactacgcgacggttaacgcgtccggcgacgcgaggttcgtcgccgtggagttcgacacccaccaggacccctgggacccgagcagccggcacatcggcgtcgacgtgaacagtatggactcccgcggcgactacaaggtcttgcctgacggcagcctcgtcgacgccggcgtgatatccgcgacggtcgagtacgacaacggcacgaggaggctggacgtcgccttgatcgtcgggagccacacttacaccgccgcagcgaccgtggacctgccaagcttgctgccggagcatgtcgccgtcggcttctcggcggcgaccggggacgcttacgccagcaaccacaccgtgctctcgttctcctttctctcgacgttgccaaccaagaacatcacctccttgtctgcttcctcctcctcctccaataagagaaccatagagctcggcgccggggtggccgcagcttctgccttgctggccctcctactcgccgccgccgttgcggtgctactagttcggcgaaggggcaagcagccgtacgacgaagagaagctgaccacggacggcgacgactccctcgacgccgtcgacgatggtgacttcgagtccagcacggggccccgccccatcccctacgcccaactcgcggcggccacgaaggacttcgcggcggaggggaagctgggtcagggcgggtctggggcggtgtaccgtggccacctgaaggagcggggccgtgacgtcgctatcaaggtgttctctcggggcgcgtcca

SEQ ID NO: 25027 - protein, 407 aa, Panicum virgatum
  misc_feature: Ceres CLONE 1861730
  misc_feature (35)..(272): Pfam Name: Lectin_legB Pfam Description: Legume lectin domain
MAVKNLCPSSSSRAHHQLLLLFFSLAVSPHVPRASSLSFSYNAFNPYDFKPEADARVKDGRLELLGDEFAARARGRAWHKQFFLLWDGATGKSASFAANFTFSIQSVPAGKGAPGVGHGMTFFLAPYPPDLPQESYDGCLGLFDENQKDNYATVNASGDARFVAVEFDTHQDPWDPSSRHIGVDVNSMDSRGDYKVLPDGSLVDAGVISATVEYDNGTRRLDVALIVGSHTYTAAATVDLPSLLPEHVAVGFSAATGDAYASNHTVLSFSFLSTLPTKNITSLSASSSSSNKRTIELGAGVAAASALLALLLAAAVAVLLVRRRGKQPYDEEKLTTDGDDSLDAVDDGDFESSTGPRPIPYAQLAAATKDFAAEGKLGQGGSGAVYRGHLKERGRDVAIKVFSRGAS

SEQ ID NO: 25028 - DNA, 646 bp, Panicum virgatum
  misc_feature: Ceres CLONE 1861730-R
  misc_feature: Encodes the peptide sequence at SEQ ID NO. 25029
gcgtccaccgagtccgacatgtacagcttcggcatcgtgctgctggagatcgtctgcgggcggcggcccatggtggcgcccagcgccgccgaggggaaggacgggcaggtgttccggctggtggaatgggcgtgggacatgcacggccgcggcgcagcgctcggcgccgccgacgagcggctcgggggagccttcgacccgtgggagatggagcgggtgatcgccgtcgggctctggtgcgcgcacccggaccccaagatgcggccggggatctgtcaggccgccgaggcgctgcggtcgaggaagttcaggatgccgctgctgccgcccaagatgccggtcgccgtgtatcttcagccattcggtgcttccaccatggagttcagcgacaccaccggctctgtcgggtccatgccgtacacctcgatgacgagccacgccacaggaacaggggcgtccagctccagctcgccggcggtggtcacagagcaattgagcccaagagcatagacaggctatgtacccgtatgcgtatagtgtaattttgttcaaagcataacgtttttgatgaagttacgtacaattgtgcacttgagattgctccgctggttttatacgagttacaaaaaatatggttgtttcggat

SEQ ID NO: 25029 - protein, 169 aa, Panicum virgatum
  misc_feature: Ceres CLONE 1861730-R
  misc_feature: SWISSPROT Homolog: EC 2.7.11.1 Non-specific serine/threonine protein kinase
ASTESDMYSFGIVLLEIVCGRRPMVAPSAAEGKDGQVFRLVEWAWDMHGRGAALGAADERLGGAFDPWEMERVIAVGLWCAHPDPKMRPGICQAAEALRSRKFRMPLLPPKMPVAVYLQPFGASTMEFSDTTGSVGSMPYTSMTSHATGTGASSSSSPAVVTEQLSPRA

SEQ ID NO: 25030 - DNA, 427 bp, Panicum virgatum
  misc_feature: Ceres CLONE 1861743
  misc_feature: Encodes the peptide sequence at SEQ ID NO. 25031
acttccttccctctccacctccgcctccgttcccatacctctccctccctccgccccgccatccaagaaagaactcgccactccgtcccaccaatcatcgcaaatcggtcggcccgaagcgaccagcaggcagcagcccgcgcgtgtcgtctgcacccatggcgtcctcctcgccgtcgtgccgcgccggcgacggcaagccggacgtggaccggatcaagggcccctggagccccgaggaggacgaggccctgcagcggctcgtggcgcgccacggcgcgcgcaactggtccctcatcagccgctccatcccgggccgctccggcaagtcctgccgcctccgctggtgcaaccagctctcgccgcaggtggagcaccgccccttcacgcccgaggaggacgacaccatcctccgcgcgcacgcgcg

SEQ ID NO: 25031 - protein, 89 aa, Panicum virgatum
  misc_feature: Ceres CLONE 1861743
  misc_feature (21)..(67): Pfam Name: Myb_DNA-binding Pfam Description: Myb-like DNA-binding domain
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 1942 in the 10/374,780 US patent application
  misc_feature: The sequence is a functional homolog of SEQ ID NO 2262 in the 10/374,780 US patent application
  misc_feature: The sequence is a functional homolog of SEQ ID NO 774 in the 10/225,066 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
  misc_feature: Useful for making plants with modulated biomass
  misc_feature: The sequence is a functional homolog of SEQ ID NO 1664 in the 11/479,226 US patent application
  misc_feature: The sequence is a functional homolog of SEQ ID NO 2578 in the 10/374,780 US patent application
  misc_feature: The sequence is a functional homolog of SEQ ID NO 62 in the 10/225,066 US patent application
  misc_feature: The sequence is a functional homolog of SEQ ID NO 1676 in the 11/479,226 US patent application
  misc_feature: The sequence is a functional homolog of SEQ ID NO 2580 in the 10/374,780 US patent application
  misc_feature: The sequence is a functional homolog of SEQ ID NO 64 in the 10/225,066 US patent application
  misc_feature: The sequence is a functional homolog of SEQ ID NO 850 in the 10/412,699 US patent application
  misc_feature: The sequence is a functional homolog of SEQ ID NO 142 in the 11/375,241 US patent application
  misc_feature: The sequence is a functional homolog of SEQ ID NO 1918 in the 10/412,699 US patent application
  misc_feature: The sequence is a functional homolog of SEQ ID NO 2180 in the 10/374,780 US patent application
  misc_feature: The sequence is a functional homolog of SEQ ID NO 470 in the 10/225,066 US patent application
  misc_feature: The sequence is a functional homolog of SEQ ID NO 1687 in the 10/374,780 US patent application
  misc_feature: The sequence is a functional homolog of SEQ ID NO 1695 in the 10/412,699 US patent application
  misc_feature: The sequence is a functional homolog of SEQ ID NO 132 in the 10/286,264 US patent application
  misc_feature: The sequence is a functional homolog of SEQ ID NO 2576 in the 10/374,780 US patent application
  misc_feature: The sequence is a functional homolog of SEQ ID NO 280 in the 10/225,066 US patent application
  misc_feature: The sequence is a functional homolog of SEQ ID NO 114 in the 10/412,699 US patent application
  misc_feature: The sequence is a functional homolog of SEQ ID NO 275 in the 11/479,226 US patent application
  misc_feature: The sequence is a functional homolog of SEQ ID NO 84 in the 10/286,264 US patent application
MASSSPSCRAGDGKPDVDRIKGPWSPEEDEALQRLVARHGARNWSLISRSIPGRSGKSCRLRWCNQLSPQVEHRPFTPEEDDTILRAHA

SEQ ID NO: 25032 - DNA, 1029 bp, Panicum virgatum
  misc_feature: Ceres CLONE 1861754
  misc_feature: Encodes the peptide sequence at SEQ ID NO. 25033
cctccccccgccccccgttatattacaacccgcatcgcggctgcactgaccaccgcctcggacccgtcgcccaccctcccctgctcgcatccgactcaccgccacccgcccccgcctggctcccgggcccattcgccgacccgtcgccggcgaaggcgcgccgcctcctcccgctgaaagcgaagcgcgccacctcggtgggattgtagccgccgtcctcctcctgtagacggcgggagggcggagatcccgccggagttggggctgatcccccctttctctcgattcaaggcgctggtagttcatacgagaagctcctggggggggggggggatatggacatggcattgccagttgtgaatgccaccgcggcggtgctcgctcgtgtctcggctgcgttcaatgccccttttgcccgtgccgtcgtcttcggggtacatattgatgggcacttggtcgtggaagggcttcttattgcagtcatagtgttccagctcaccaggaagagctacaaacccccaaagaagccactcactgaaaaggagattgatgagctatgtgatgaatgggagccagagccgctatgccctccgatcgagggggccaggattgacactccaatgttggaaagtgctgccggaccgcatacaatcgttgatggtaaagaagttgtcaactttgcatcggcaaactaccttggtttaattggcaatgagaagattattgattcttgtgttggttcactggagaaatatggtgttgggtcttgtggtccacgtggcttctatggaacaattgatgtccaccttgactgtgaggcaaaaatagctaaattcctcggaactccagactccattctgtattcttatgggatttctacaatattcagtgtgataccagccttttgtaagaaaggagatatcatagtcgccgacgagggtgttcactgggcagtgcaaaatggtctccatctatcaagaagtactgtggggtacttcaagcacaatgatatggcttcacttgcaagca

SEQ ID NO: 25033 - protein, 231 aa, Panicum virgatum
  misc_feature: Ceres CLONE 1861754
  misc_feature: SWISSPROT Homolog: EC 2.3.1.50 Serine C-palmitoyltransferase
  misc_feature: Useful for making plants with modulated nitrogen use efficiency
MDMALPVVNATAAVLARVSAAFNAPFARAVVFGVHIDGHLVVEGLLIAVIVFQLTRKSYKPPKKPLTEKEIDELCDEWEPEPLCPPIEGARIDTPMLESAAGPHTIVDGKEVVNFASANYLGLIGNEKIIDSCVGSLEKYGVGSCGPRGFYGTIDVHLDCEAKIAKFLGTPDSILYSYGISTIFSVIPAFCKKGDIIVADEGVHWAVQNGLHLSRSTVGYFKHNDMASLAS

SEQ ID NO: 25034 - DNA, 1867 bp, Panicum virgatum
  misc_feature: Ceres CLONE 1861769
  misc_feature: Encodes the peptide sequence at SEQ ID NO. 25035
acactcgcagcggcagtccagccgtgagccgtgccgtgccgtgcgtgccgactaccagcgagcaatccgccgcgggggagtccgattgaggccacccaggcgggggccgcgcggccgaccggctctcacccggcgccgcgccgacgcctcctctccggatcccgatctgcgcggccgcgtgggtgcgtcaggggatggaggaggggcggcaggagcatgaggaggcggaggcggagggggtggagggctgcccgtgcggcgagggccgggaccagttcgaccgcctccacgacgcggtgctgctcgacgtcctcaaccgcatcggcgacgtcaaggcgctgggccgctgcgccctcgtctcgcgccgcttccacgcgctcgtcccgctcgtcgactccgtcttcgtccgcgtcgactgcgtcatccccgacgacccgccgccctccgcgtccgcgggccccggctccccgcagcagcagcacccccaccaccaggcgccggcggccgcgcgcggccgcggcgcgctcgcgcacttcgcgcgcgtcctgctcggcggcatcgccaggcccatccacgcgctcggccagatcctctcccccgccgcggccgccgtctccaggcgcgccgagccgccgcccgcctccccgcccgcgcccgccgcggacgtctcccaccactcgccctccgaggtgctccgctccttcaaggagctgcgccgcctccacatcgagcttcccacgggcgagctcggcatcgaagacggcgtgctcctcaagtggaaagccgatttcgggtccacccttggccgctgcgtcatcctcggcgcctcgtcggtcacgtccaagccgacgtcgccgttggcgcagcccgaaaccgctgctgacgacagcacggccgcctctcccgattccaacagggagactgaagagctggggagcgtacctgagtcgctctataccaatggaggcctcaagcttcgcgtcgtctggaccatcagctcgctgattgctgcgtcggcgaggcattacttgctgcagccgataatttctaatcatgcaactctggagagcttgaacctcactgatgctgacggacagggggtgctcaccatggacaagaggcagcttcaggagctgcgagtgcggccagtctcggcatcagctagctcgcatcgcacactcatgccggcactcagcatgcgactgcactacgcgccgctaattaagttgccttgtggaacgctgctgaagggtgcgacgctggtggcgatcagaccaagcgaagatgccctgagagagggtcaaggggttggggctgctggttctgttggtacatgttggatttcagaggcctttgaggagccatatcggactgccgcaaaggtgcttctcaagagaagcccatattgccttgaaatgaactcgttctgaccaccagggattcagttcaagagagttatacccttcttgcaggatggtgggatgctttttggatgaatataggagtatttataattcagtgcaggaaccggacaaatacgatctccatctggtgattctgattccagtgtcgtggtaactttgcttacctgtaagtatatatatacatgtctgtgttgggttactacaggcgaaatggaatgccattcgagtggaatctacagcaatgtactaagaagagaagcaatggaatgttcctcacttgagcttggtgcatggtgctcctaggccaagctaacattacgctttcctcaaggaagcccccaaagatttcgttattatcagcacctttttttttgtttaaatcttgtggggtcatgcttttggcactgtatcaattatagaccagaatatacagcccttttcag

SEQ ID NO: 25035 - protein, 411 aa, Panicum virgatum
  misc_feature: Ceres CLONE 1861769
  misc_feature: Useful for making plants with modulated low light sensitivity
  misc_feature: Useful for making plants with modulated nitrogen use efficiency
MEEGRQEHEEAEAEGVEGCPCGEGRDQFDRLHDAVLLDVLNRIGDVKALGRCALVSRRFHALVPLVDSVFVRVDCVIPDDPPPSASAGPGSPQQQHPHHQAPAAARGRGALAHFARVLLGGIARPIHALGQILSPAAAAVSRRAEPPPASPPAPAADVSHHSPSEVLRSFKELRRLHIELPTGELGIEDGVLLKWKADFGSTLGRCVILGASSVTSKPTSPLAQPETAADDSTAASPDSNRETEELGSVPESLYTNGGLKLRVVWTISSLIAASARHYLLQPIISNHATLESLNLTDADGQGVLTMDKRQLQELRVRPVSASASSHRTLMPALSMRLHYAPLIKLPCGTLLKGATLVAIRPSEDALREGQGVGAAGSVGTCWISEAFEEPYRTAAKVLLKRSPYCLEMNSF

SEQ ID NO: 25036 - DNA, 2778 bp, Panicum virgatum
  misc_feature: Ceres CLONE 1861785
  misc_feature: Encodes the peptide sequence at SEQ ID NO. 25037
ccattccctccctccgaccccctcacttctccctccctccctccccgcccaaagctttccctttcctgcacctcccgttaaatcctcttcctctcccgccgtcctcgccctgccatgcttcgcctgggattttaatcacttgcttctgtgcgggacgcaaaatcgccaggaagcagacgacgacgagcccgtttctctccccgccggttcgcctgccgccggccgaggaggaagggaggatgttcggggactgccaggtcctgtcctcgatggccgccatggcgggggcctcctcatctgcggacgcgctcttcatccccaacccgggcgcgctcgccggcttcatgtcctcctccgccgccgccatgccgttccaccacttctccaccaccaccacctccctaatacctaaggaggagggcggcggcatcatgggcgcgctagtccaggcggccaaggacgaggacatggagctcagcggcggctccggcagcggccgcctggacggcctactcagcttcgcggacgtggacgacgaccggcccgagcagaagccgcagcacggcggcctcgagctccagacggcggacgccgccgggaaccagcagctggccaccaacagcggcaagaagaagcggtaccaccgccacactgcgcaccagatccagcagatggaagcgatgttcaaggagtgcccgcacccggacgacaagcagcggctgaagctgagccaggagctggggctcaagccccggcaggtcaagttctggttccagaaccggcgcacgcagatgaaggcgcagcaggaccgcgccgacaacgtgctcctccgcgccgagaacgagagcctcaagagcgacaactaccgcctgcaggccgccatccgcaacgtcgtctgccccaactgcggccacgccgccgtcctcgccgagatgtcctacgaggagcagcagctccgcatcgagaacgccaggctcaaggacgagctcgaccgcctggcgtgcatggcgacacggtacggcggcggccgccagccgagcatggcgtccgcgctgggctgcttaccggcgccgccgccgctgctcatgccgccgctcgacctcgacatgagcgtctactctcgccatttcacggaccaatcttcggtaatgggctgcggcgatctcatccagtccgtcctcgcgccgccgcagcagatcaccgctggcgccgagcaccacgacgcgtcgtcgtacatgggctccatggcgcctgtcccggagcaggacaggcaggtggttctcaacatcgccgccacggcggccgacaccctcgccaagatgtgccgcgccggcgagccgctctgggtgcgctgccgcggcgcgagctccgaggtcatggtggccgatgagcacgcgcggatgttcagctggccggtcgacggcgggaagcagggcggaggctccgcggctgccgccgccgccaggactgagggttcaagggacagcgccgttgttatcataaacagcatcacgctggtggacgccttcctcgacgcaaacaagtggatggagttgttcccttccatcgtgtccaaggcaagaaccattcaggtcataaaccatggagctgcttcaggccatctgggcagtggagctcttgtcttgatgcaagcggaggtgcagttcccgtctcctttggtgccggcgcgggaggtggtgttcttccgctattgtgtgcataaccctgaagaggggacctggtccgtcgtcgacttccctgcagaggggtttcagctggaggcgctgcagacatcatcagtggtcaaatgccggaggcgcccctctggctgcatcatccaggacatgcccaatggttactcaagggtggtgtgggtggagcacatggagatggttggggaggagaagccgctgcaccaggtgttcaaagactatgttaccaacggcactgcctttggtgccacgcgctgggtctccctgcttcagcgccagtgtgagcgccttgccagtgaactcgctcgcaacattgctgacctcggagtgatccgcagcccagaggcaagaacaaatatgatgaagctgtcacaacggatgatcactactttctgttccaatatcagtgcttctgggagtcaatcttggacgacactctcagagtctacagaggacacgatcagggtcaccactcggaagaacactgatccagggcagcccagcggtgtcatactgactgctgtctccaccagttggcttcctttcagccatcagcaggtcttcgagcttcttgctgatgaacaacaacgctgtcagcttgagattttgtcaaatggaggctcacttcatgaagtggcacatattgcaaatggatcacacccaagaaattgtatttcacttcttcgaattaatgctgcaagcaactcgtcacagaatgtggagctcctgctgcaggaaagcagcacccaccctaatggcgggagtcttgtggtgtttgcaacagtggatgtggaagcaatccaagtgacaatgagcggcgaggacccttcctatatccctctcctccccctgggttttgccatcttcccagcaaccaacccttcgcctgctgcaaccagcgcaagctctggcaacggcggcgaaagcagcccaggtaacccagatgagcctgccagcggctgcctcctcaccgtcggcatgcaggtgctagccagtgcggtgccctcagccaagctgaacctctcaagcatcaccgctatcaacagccatgtctgcaatgccatcc

SEQ ID NO: 25037 - protein, 846 aa, Panicum virgatum
  misc_feature: Ceres CLONE 1861785
  misc_feature (349)..(587): Pfam Name: START Pfam Description: START domain
  misc_feature (131)..(187): Pfam Name: Homeobox Pfam Description: Homeobox domain
MFGDCQVLSSMAAMAGASSSADALFIPNPGALAGFMSSSAAAMPFHHFSTTTTSLIPKEEGGGIMGALVQAAKDEDMELSGGSGSGRLDGLLSFADVDDDRPEQKPQHGGLELQTADAAGNQQLATNSGKKKRYHRHTAHQIQQMEAMFKECPHPDDKQRLKLSQELGLKPRQVKFWFQNRRTQMKAQQDRADNVLLRAENESLKSDNYRLQAAIRNVVCPNCGHAAVLAEMSYEEQQLRIENARLKDELDRLACMATRYGGGRQPSMASALGCLPAPPPLLMPPLDLDMSVYSRHFTDQSSVMGCGDLIQSVLAPPQQITAGAEHHDASSYMGSMAPVPEQDRQVVLNIAATAADTLAKMCRAGEPLWVRCRGASSEVMVADEHARMFSWPVDGGKQGGGSAAAAAARTEGSRDSAVVIINSITLVDAFLDANKWMELFPSIVSKARTIQVINHGAASGHLGSGALVLMQAEVQFPSPLVPAREVVFFRYCVHNPEEGTWSVVDFPAEGFQLEALQTSSVVKCRRRPSGCIIQDMPNGYSRVVWVEHMEMVGEEKPLHQVFKDYVTNGTAFGATRWVSLLQRQCERLASELARNIADLGVIRSPEARTNMMKLSQRMITTFCSNISASGSQSWTTLSESTEDTIRVTTRKNTDPGQPSGVILTAVSTSWLPFSHQQVFELLADEQQRCQLEILSNGGSLHEVAHIANGSHPRNCISLLRINAASNSSQNVELLLQESSTHPNGGSLVVFATVDVEAIQVTMSGEDPSYIPLLPLGFAIFPATNPSPAATSASSGNGGESSPGNPDEPASGCLLTVGMQVLASAVPSAKLNLSSITAINSHVCNAI

SEQ ID NO: 25038 - DNA, 540 bp, Panicum virgatum
  misc_feature: Ceres CLONE 1861785-R
caaacaaacagtgtgggggcattttgatcattttgggaagctagtgctatctgcaactactagaaagggtcttgtcacgttctcacttgcactggctgaatcaatcacacagatagaaatccggcattttggtcatgctgttgctgctgctctcagtctgttcccttgctcagcaaccagaactgtgaaggttagcttcgaccggtatgcttctttgatttttgtaataataagatgggagattacctaatagtttgcgcgtaatggttcgctgtatgtgtcgtagagccgtataactctgttagagattgaagactattgtgtaggaaagaagagaaaagtgtgagaggaggagtcaagagcgaaccaaactggttgtgacccttggactggatcccaggccaacaggggagaaagggtcttggttcgggaattgacttgttccctctcggcactgccctttgtcgatctgtaacctgctgtgttcgtgttactccaatcgtttgattacattacattggtagatgagttgtgtgttgc

SEQ ID NO: 25039 - DNA, 1309 bp, Panicum virgatum
  misc_feature: Ceres CLONE 1861791
  misc_feature: Encodes the peptide sequence at SEQ ID NO. 25040
cccgcaccgctctctaaccgagtcctgaacccgatctcctgctcctcccctgcagctaacgcccacgcacccgtcccgatggccgccgcctccgagctggtcacccccctgaagcgcccgttcgggagcgacgggctcggcgacggcaacaacatcagcagcggcagcagcaacggcggcggcgtcgcgctgggcggcgacgacgagaagcccaaggcgcggcggcgcgaggcggacccggcggcggcgctggccgcggcgcggcacgagttcggcgagcacggcggcgtgaacatgtccatcgaggcgtcggcgacgttcacggtgatggagccggacacgatgcggcggctgttcgcgggggagctgggccccgaccgcggcgacatgtacatctacagccggcacttcaacccgacggtgctggcgctggggcggcagatggcggcgctggagggcaccgaggccgcctactgcacggcgtcggggatgtccgccatctccgccgtgctgatgcagctggtgggcgcgggcgggcacgtggtggcgtcgcggtgcctgtacggcggcacccacgcgctgctgtcccggttcctgccgcgggcgtccggggtgcgcgccacgttcgtggacgcggacgacgaggccgccgtgcgcgccgcggtggtgcccggggagacgcgggtggtgtacgtggagacgatgtccaacccgacgctggccgtcgcggacatcccgatgctggcgcgggtggcgcacgaggcgggggccaagctggtggtggataacaccttcacccccgtggtggtctcccccgcgcgcctcggcgccgacgtcgtcgtccacagcgtgtccaagttcatcagcggcggcgccgacatcatcgccggcgcgatctgcgggccggcgagcctggtgaacgcgatgatggacctgcaggagggggcgctgatgctgctgggcccgacgatgaacgccaaggtggccttcgagctgtcggagcgcctgccgcacctgccgctgcggatgcaggagcactcgcggcgcgcgctggcgttcgcgtcccggatgcagcgcctgggcctgcgcgtgctctacccggggcttcccgaccacccgcaccacgcgcgcctcgccgccgcggccaaccccggctacggctccggcgggatgctctgcgtcgacatgggcaccgaggaccgcgccaaccgcctcatgcaccacctccagaacaccaccccagttcgggcctcatggccgtcagcctgggctactacgaaacgctcatgtcctgctcccgcagcagcac

SEQ ID NO: 25040 - protein, 410 aa, Panicum virgatum
  misc_feature: Ceres CLONE 1861791
  misc_feature (57)..(398): Pfam Name: Cys_Met_Meta_PP Pfam Description: Cys/Met metabolism PLP-dependent enzyme
  misc_feature: SWISSPROT Homolog: EC 4.4.1.11 Methionine gamma-lyase
MAAASELVTPLKRPFGSDGLGDGNNISSGSSNGGGVALGGDDEKPKARRREADPAAALAAARHEFGEHGGVNMSIEASATFTVMEPDTMRRLFAGELGPDRGDMYIYSRHFNPTVLALGRQMAALEGTEAAYCTASGMSAISAVLMQLVGAGGHVVASRCLYGGTHALLSRFLPRASGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFASRMQRLGLRVLYPGLPDHPHHARLAAAANPGYGSGGMLCVDMGTEDRANRLMHHLQNTTPVRASWPSAWATTKRSCPAPAAA

SEQ ID NO: 25041 - DNA, 414 bp, Panicum virgatum
  misc_feature: Ceres CLONE 1861791-R
agcagcggtgggcgcagtttgagagagcgctcgcgctcatgcagccgccgccgccgctgcaccacaaggccgccgccgccgaccgcgacgccggcaccaccaaccaccgcaagcactgtccgacgttcgaatccaaatgtgtgctggcagggggtgatatatgttatgctgtgcctgtttcttctggtgtatagtacactattattactaccatttgagtaagcaaggttaaggttaagcaccgtctgacccctccagttcagacggatagtagtgtaagccgcttcatctctggggatccgggaaacggacctgaataagtgtaatcagtgtgctgcttaatctgaacttccttgcaggaagatacatagcaacatttcagagttgagcggtgaaagcgtctcgctactcctt

SEQ ID NO: 25042 - DNA, 1354 bp, Panicum virgatum
  misc_feature: Ceres CLONE 1861800
  misc_feature: Encodes the peptide sequence at SEQ ID NO. 25043
attcaggagaggcgcctctcctctctaatctccatttggcaggcacgcctctccccgtccaacgccaggccaccattaaagttgccggagatccacaaaagcaaaactgaatccaatcaacaggggcggtctacctagctaccggctgcttcgttgcggttgcggcgttctgttacctgtcttcattgcttaatgattcctttgtttcataagttgttcatttgatgctgggggcagaaactctgcagaaatggagcagaaacacaacagaaaggagtttctttctccaagagttctaggagcaaagaatgggaatgccttgtcaaggcatggtacagagtactccatcaatcccacagttgatttgaaagagtccccaaatcagtcatcagtggcttccccgtcagcatcatcctcatccttcttcagaagtctttcagaaagtagaagtctaaaattcagcagcttcggttctcctgcaacaattagtagtaaccacacagaagctttcagggtagttgcagccacatggaacgtagctggaaagactccggacaggggtctcaatctgaatgatttcctgccttctgatgattactcagacatctatgtgttaggattccaagaagtcgtccccctcaacgccggcaacgtcctggtgatcgaggacaacgagccggcgtcgagatggcttgccctcatcaaccaggcgctgaaccggccttcaccaccatctgacgcgtacgccatttctgaagctgcagcgagcttctcgttctgccggtccgtagacacgacggcctccgcctccccggcctccggtctccaaacgcccagctccagccctctcgatccctcgcggttccacaaatcctccaacagagagatccgccgcgccgccatcacccgcggccgccggctccagacgtgcacctgcccgtcggagcggcctcggagtcggaggtcctacagggcgccgtgcctgatgggttgcggcaagaaggccgacgccgtcgagagcgacacgacgacgtcggacgaggaggacgacgaggtcagaaccagcagcttcgcggtgtccgacgtgaagagccccgcggcggcggtggcgagccggcgcgagaggtactgcctggttgcctgcaagcagatggtggggctgttcgcgacggtgtgggtgaggcgagggctggtgccgcacgtcggccatgtccggttctcctgcgtcggccgcggcatcatgggctacctcggcaacaagggttgcatctctgtgagcatgtcgctgcaccagacgagcctgtgctttgtgtgcagccacctggcgtccggggagaaggaaggcgacgagctc

SEQ ID NO: 25043 - protein, 367 aa, Panicum virgatum
  misc_feature: Ceres CLONE 1861800
  misc_feature: SWISSPROT Homolog: EC 3.1.3.56 Inositol-polyphosphate 5-phosphatase
MEQKHNRKEFLSPRVLGAKNGNALSRHGTEYSINPTVDLKESPNQSSVASPSASSSSFFRSLSESRSLKFSSFGSPATISSNHTEAFRVVAATWNVAGKTPDRGLNLNDFLPSDDYSDIYVLGFQEVVPLNAGNVLVIEDNEPASRWLALINQALNRPSPPSDAYAISEAAASFSFCRSVDTTASASPASGLQTPSSSPLDPSRFHKSSNREIRRAAITRGRRLQTCTCPSERPRSRRSYRAPCLMGCGKKADAVESDTTTSDEEDDEVRTSSFAVSDVKSPAAAVASRRERYCLVACKQMVGLFATVWVRRGLVPHVGHVRFSCVGRGIMGYLGNKGCISVSMSLHQTSLCFVCSHLASGEKEGDE

SEQ ID NO: 25044 - DNA, 642 bp, Panicum virgatum
  misc_feature: Ceres CLONE 1861800-R
  misc_feature: Encodes the peptide sequence at SEQ ID NO. 25045
atttctctggtatggtgaagggatagtgcagctgtcctacattcgcggggagtcaaagttttcagaccatcgtcctgtgtgtagtgtgttcattgtcgaggttgcagttcctgacaacaaactcatcaagtttgcatcaggtcccaacatgaaagttggcgtggaagaactcctatttgcccccaagtagcagatagcagtacatggaatgcagcattgtgctcaagatcatatacaacacacagtaatactcattccaaatatctggagcactaacttgaaacattgtgtacactactaatattaggagatattcacgagaggcaattgctgaccatagttctgatgaagtcatgagtacaattcatagaactgagtctgcactcaagaatcaaaattgttcccctcagcttcagtttgggagcccaaggccaagggctcccatgatcatgactccagaactgatacaaaaccttcaatccatggacattaatttgattttaatttgtgggaagatctatggacatcatggtgtcaacaactttcagtttagtcagtcatatgcatctctgtacttggttccgtacatgtcaatcaagatgtgaatccataggagcatgaaaggcgctcatttgttatcag

SEQ ID NO: 25045 - protein, 62 aa, Panicum virgatum
  misc_feature: Ceres CLONE 1861800-R
  misc_feature: SWISSPROT Homolog: EC 3.1.3.56 Inositol-polyphosphate 5-phosphatase
FLWYGEGIVQLSYIRGESKFSDHRPVCSVFIVEVAVPDNKLIKFASGPNMKVGVEELLFAPK

SEQ ID NO: 25046 - DNA, 699 bp, Panicum virgatum
  misc_feature: Ceres CLONE 1861817
  misc_feature: Encodes the peptide sequence at SEQ ID NO. 25047
acaaagcaccaagctttagcacgcacaagggcctaacacaatcctctaacacacacgcctctcgaaagctccagcagcggcgcaagcccagccagccagcctcgtcgccatggctcccaacctcagcaaggccaagccggacctgctcggcgacgcggccgcccccgtcgagggcctcaaggcgccgtcgcgcttcacgctcaagggcaaggacctcgccgtcgacggccacccgttcctgctcgacgtgccggccaacatccgcctcaccccggcgtcgacgctggtgcccgccgccgcggcgggcggcagcttcctcggcttcgacgcgccggcggccaagagccggcacgtggtgcccgtcggcaggctccacggcacccggttcatgagcatcttccgcttcaaggtgtggtggacgacccactgggtgggcgacagcggccgcgacgtggagaacgagacgcagctgatggtgctcgaccgctccggctccagcgccggcggcggccgcccgtacgtgctgctgctccccatcgtcgagggcgccttccgcgcctgcctcgagtccggcaaggtggacgactacgtggacatggtggtggagagcgggtcctcggcggtgcgcggcgccgcgttccggagctccctgtacctgcacgccggcgacgacccgttcgagctcgtgcgggaggccgt

SEQ ID NO: 25047 - protein, 196 aa, Panicum virgatum
  misc_feature: Ceres CLONE 1861817
  misc_feature: SWISSPROT Homolog: EC 2.4.1.67 Galactinol--raffinose galactosyltransferase
MAPNLSKAKPDLLGDAAAPVEGLKAPSRFTLKGKDLAVDGHPFLLDVPANIRLTPASTLVPAAAAGGSFLGFDAPAAKSRHVVPVGRLHGTRFMSIFRFKVWWTTHWVGDSGRDVENETQLMVLDRSGSSAGGGRPYVLLLPIVEGAFRACLESGKVDDYVDMVVESGSSAVRGAAFRSSLYLHAGDDPFELVREA

SEQ ID NO: 25048 - DNA, 1321 bp, Panicum virgatum
  misc_feature: Ceres CLONE 1861832
  misc_feature: Encodes the peptide sequence at SEQ ID NO. 25049
ctccaatttgaagcagcttcagaagcaatctatattgaactggtcgaccatgtggaggctaaaggtctcagagggaggaggggcatggctgcagacggtgagcaactttcatgggcggcaggtgtgggagttcgaccccgacgccggcacggaccaggagcgcgccaaggtggagcagcttcgccgggagttctgggagaaccgcttccgaaggagggaatcgcaggacctcctcatgcgcatccagttcacgggactatatcatctgcgggcggatatgcccgcggccgcgaaactggaagacggtgacgaggtaacggaagaaattctgaaggagtcgctcacacgagcgctcggttggatgtcagacctccaagctgaagatggccactggccaggtgatttaagtgggatcatgtacctgctgcctttctggattttcgcgctgcacatcacaggatcaatcgatgatgtactatccaaagagcacattcgtgagatatgccgccatatctacaaccatcagaacgaggacggcggctggggcttcaacgttttggacgagagtgccatgtttggcacatgcttaaactacgtcacattgaggctgctcggacaagtgcaaamsgatgagaatgatggactagcaaaaggtcgcgcatggatcttgtcccatggcactgcaactgcagcgccacaatgggcaaagatattactctcggtccttggtgtatatgattggtccggaaatcgcccagtgatccctgaactttggttggtcccacggtttctcccaattcatccaggacgattctggtgcttcacaagggttacctacatgtcaatagctttcctatatgctaagagagttgttggtccagttacaccgatcatcttagcattgaggaacgaactctacagttccccttatggtgagattgattgggatgaggctcgtagttcttgtgccaaggaggacatgcgctaccgtccctcagcagtgtacaaagctatttcaaattgtttgcacacgtttgtggagccagtcttgaacagttggccgatgaacaagctaagagagagagctttgagtcacatattgcaacatatccattacgaagatgaaactactcaatacgttggcttatgtcctgttacaaaggcattgaacatgatttgttgttgggtggaaaatccaaattcagatgtactcaagcggcatcttccaaggatacatgattatttgtggattgctgaagatggcatgaagacccaaatatatgatgggacccagaactgggatatagcacttatagttcag

SEQ ID NO: 25049 - protein, 423 aa, Panicum virgatum
  misc_feature: Ceres CLONE 1861832
  misc_feature (146)..(189): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature (193)..(193): Xaa is any aa, unknown, or other
MWRLKVSEGGGAWLQTVSNFHGRQVWEFDPDAGTDQERAKVEQLRREFWENRFRRRESQDLLMRIQFTGLYHLRADMPAAAKLEDGDEVTEEILKESLTRALGWMSDLQAEDGHWPGDLSGIMYLLPFWIFALHITGSIDDVLSKEHIREICRHIYNHQNEDGGWGFNVLDESAMFGTCLNYVTLRLLGQVQXDENDGLAKGRAWILSHGTATAAPQWAKILLSVLGVYDWSGNRPVIPELWLVPRFLPIHPGRFWCFTRVTYMSIAFLYAKRVVGPVTPIILALRNELYSSPYGEIDWDEARSSCAKEDMRYRPSAVYKAISNCLHTFVEPVLNSWPMNKLRERALSHILQHIHYEDETTQYVGLCPVTKALNMICCWVENPNSDVLKRHLPRIHDYLWIAEDGMKTQIYDGTQNWDIALIV

SEQ ID NO: 25050 - DNA, 673 bp, Panicum virgatum
  misc_feature: Ceres CLONE 1861832-R
  misc_feature: Encodes the peptide sequence at SEQ ID NO. 25051
aagaacttatgagaacagtgtttgcatcagaaaagcatgcaattttctgctgtcaacacagctgaaaacagggggctggggggaaagctatctttcttgtgaacgcgacgtctatgtggagggtaatcataccaatgctgtgagcaccgcttgggcaatgctaggattgatttctgctcggcagatggaacgtgatcaaacaccattacatcgtgccgcgaaggtattaattaatatgcagttggagactggtgattatcctcaacaagaacatatgggaaacaccaattcttctgtctacttcaactatccaaactaccgcaatttgtatcctatttgggctcttggagagtaccgtcgggggctgcgagcaaagaagaattgaaatattagactaatgtaatgcaaatatatgtcagacacaacaaatgggtgcgccatgctggagcaaaaacaataaaatggatatttaatgagtaattaatgtctacccgcaaaaaataaatgttaacataataatcgtttgtatttctctctaaacaatattcagttgtaagtgctggtttcattatcctgttttagttgcatgcaagtggatgattagtattgatcatagtaataagtggaggttgagatctcaaggaatgctaaagatgtactagtgattggcgtg

SEQ ID NO: 25051 - protein, 127 aa, Panicum virgatum
  misc_feature: Ceres CLONE 1861832-R
  misc_feature (7)..(55): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
RTYENSVCIRKACNFLLSTQLKTGGWGESYLSCERDVYVEGNHTNAVSTAWAMLGLISARQMERDQTPLHRAAKVLINMQLETGDYPQQEHMGNTNSSVYFNYPNYRNLYPIWALGEYRRGLRAKKN

SEQ ID NO: 25052 - DNA, 569 bp, Panicum virgatum
  misc_feature: Ceres CLONE 1861844
  misc_feature: Encodes the peptide sequence at SEQ ID NO. 25053
gatccgatccgtagtggctggcgtctcggttcctcgccggcggcagcggcgctgggcgagcggcggcgactgggagaggtcttcgccggcggcgatcatccactaggtcggttggtggcggcgggagatggaggcggacgtcgggaagctgttcatcggcggcatctcgtgggacaccaacgacgaccgcctccgggagtacttcgacaagtatggtgaggtggtggaggccgtcatcatgcgcgaccgggccaccggccgcgctcgaggcttcgggttcatcgtgttcgccgaccctgctgtcgccgagcaggtgattatggagaaacacatgatcgacggccggatggtggaggcgaacaaagctgtccccagagatgatcagcatgctctgagcaagagcggtggcagcactcatggatcaccagggcccagtcgcacgaagaagatattcgtcggtggtttggcttccaccgtgaccgacgcagacttcaggaagtattttgaacagtttgggacgatcactgatgttgtggtgatgtatgaccacaacacgcagcgtcctagac

SEQ ID NO: 25053 - protein, 147 aa, Panicum virgatum
  misc_feature: Ceres CLONE 1861844
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEADVGKLFIGGISWDTNDDRLREYFDKYGEVVEAVIMRDRATGRARGFGFIVFADPAVAEQVIMEKHMIDGRMVEANKAVPRDDQHALSKSGGSTHGSPGPSRTKKIFVGGLASTVTDADFRKYFEQFGTITDVVVMYDHNTQRPR

SEQ ID NO: 25054 - DNA, 965 bp, Panicum virgatum
  misc_feature: Ceres CLONE 1861847
  misc_feature: Encodes the peptide sequence at SEQ ID NO. 25055
actcaaccacacactagctttcccctggcactgcctgcagccagccagccagccagccacccaccacgctcttcaccatctgcagcgacagaacggggcagaaacaaacccaaaccagctcgatctgccgagctagcagcaaccgtcatctccacaaacaggccggcaagtagccctcgctacatgcctgcctgaagtgatctagaggagcagcggtgttacctgctgtaccagggtacgtaggatcggacatggtgtttccggccgtcctccccaaggtggccgcgcggtggctcttcacgttctaccgcgccgccaggaagctccggcgccacgccttccagctctacaaccgcaacgccgccgcagcagccaagccgccgccgtccgccgccgtctcgcagcagcagggccatggcgccgccgccgccactgccaggcagagcgccgccatccctgacgccgcgtcggcgggcgggaccgtggtctgcgacgtgcacggcgcgctgctgccctccaccgcgctcttcccctacttcatgctcgtggccttcgagggcggcagcctgctccgcggcgcgctgctgctctgcgcgttcccgctcgtctgggccctcggcgagcgccgcggcgccgccgtccgggtgatggcgttcgtcaccttcgcggggctcgcgcccagggacgccgacctcgtcgcccgcgccgttctgcccaagcactacatggagcagctcaacgcgctggtgtacgagcgcctgtggctccccgcgaggaggaaggtggccgtgaccgccgcgcccagggtgatgtccgagtggttcctcagggagtacatggccgccgacgccgtggtcggccccgagctgcaccacgtcgcggttggccgccgccgctacttcactgggctgctgctgcccgggcccgcgccggggcgggacgtgctgcgggaggcgtgcggggcc

SEQ ID NO: 25055 - protein, 237 aa, Panicum virgatum
  misc_feature: Ceres CLONE 1861847
  misc_feature: SWISSPROT Homolog: EC 2.3.1.15 Glycerol-3-phosphate O-acyltransferase
MVFPAVLPKVAARWLFTFYRAARKLRRHAFQLYNRNAAAAAKPPPSAAVSQQQGHGAAAATARQSAAIPDAASAGGTVVCDVHGALLPSTALFPYFMLVAFEGGSLLRGALLLCAFPLVWALGERRGAAVRVMAFVTFAGLAPRDADLVARAVLPKHYMEQLNALVYERLWLPARRKVAVTAAPRVMSEWFLREYMAADAVVGPELHHVAVGRRRYFTGLLLPGPAPGRDVLREACG

SEQ ID NO: 25056 - DNA, 673 bp, Panicum virgatum
  misc_feature: Ceres CLONE 1861847-R
tgaaggatttacttcttcaggagattgctaagggaatagatgcacttggtgtagctacattaagctcagcaacatctgcagcagcttccagattgccatttgctggtggtccatctccattaacctcactagatgatgaggatgtcactaacttgagaaatctatatcccctgctcctacttttatctaaggtttctcagaaggaaaattcatttctgattcctggaaataacagtgccatagagaaggaaggtggtagcacagatgaactttttcttgtgctgtatgaaataacatttttgccagattttttgccagttatttccatcattcctgagcttccactggagtcccaacagcagttgcttcttctgccaacagatttagcaagtcgtattttatctcgggctgttgctagaaccattagaagaatgttcatataaagctgaaggtacaagttttccatccctgcttccttaaatgtttctttaactattattttggaatcactactagaagacaaggagtttcccccccccccccccttgcagtagcatctaatctagaatccaagatcaaactgatttttgttatgaatgattttgggacacttctttattatatgtacatatttttcaaacaaaacgaggccctgtaaaaggccctttctgtt

SEQ ID NO: 25057 - DNA, 1268 bp, Panicum virgatum
  misc_feature: Ceres CLONE 1861857
  misc_feature: Encodes the peptide sequence at SEQ ID NO. 25058
atccgaaagcgcgtgatattttgtggaattgggcttggaaattgcatcgtaggagagttcttgggggattggttctgcgttctggtgaggaggacgcgaaaggcgatgcctttcagcagcatgatccaggagatgaagggcgagatcggcgcaatctcgcggcgcggcctgatgcggtcgcggtcgcggccgcacagcacgggccgcgtccagcgagtggagccggacgaggcggcgatgcgggagagctcctgggcgcacgtccccccggagctcctgcgggtggtgctggcgaaggtcgaggcggtggaggcgcggtggccgggacgcggggccgtcgtggcgtgcgccggcgtctgccggggctggaggggcgccgtgaaggagatcgtgcgcgcgccggaggcgtgtgggaggcttaccttacccatctctctcaagcagcctggcccaagggatggccctcttaaatgtttcattaggaggaaccgggctactcagtcatattttctgtgcattggagtcactgacggattagctgatgatgggaaattcctactttctgcccgcaaataccgaaggccatcatgcactgaatacctgatttcacttgatgcgcgtgatacgtcaaaggggaatggtacttatattggcaagttaagatcaaacttcttaggcacaaaatttactgtctatgatgcccatccaccttgtgccggagctgcggtttcgaagggttcatctgcgcacatgatcggttcagcccaagtttctcccatgaagcctctgcctgctgggaattatccagtttcgcacatttcttacgaagtgaatgtcttgggttctagggggccaagaaagatgaactgtgttatggattctatccctgtatcagcgattaaagaaggagggattgctcccacacagactgaatttccctctagttctagtaactccagctcgctcgcatcagttccattctttggatcgaaatcaggccgactggatgctcaattaaccactcagaatgaatgtaaggtggctctgaagaacaagtccccgaggtggcatgaacagctccagtgctggtgcctcaatttccatggacgggtaacggttgcgtccgtaaagaacttccagctggtggcttcagatgagcgtgctccaactccaagtaaccaggaggaggaggatgacgttatactccagtttggcaagatagggaaggacctattcaccatggactaccgctatcccatatctgcatt

SEQ ID NO: 25058 - protein, 387 aa, Panicum virgatum
  misc_feature: Ceres CLONE 1861857
  misc_feature (114)..(387): Pfam Name: Tub Pfam Description: Tub family
  misc_feature: The sequence is a functional homolog of SEQ ID NO 462 in the 10/666,642 US patent application
MPFSSMIQEMKGEIGAISRRGLMRSRSRPHSTGRVQRVEPDEAAMRESSWAHVPPELLRVVLAKVEAVEARWPGRGAVVACAGVCRGWRGAVKEIVRAPEACGRLTLPISLKQPGPRDGPLKCFIRRNRATQSYFLCIGVTDGLADDGKFLLSARKYRRPSCTEYLISLDARDTSKGNGTYIGKLRSNFLGTKFTVYDAHPPCAGAAVSKGSSAHMIGSAQVSPMKPLPAGNYPVSHISYEVNVLGSRGPRKMNCVMDSIPVSAIKEGGIAPTQTEFPSSSSNSSSLASVPFFGSKSGRLDAQLTTQNECKVALKNKSPRWHEQLQCWCLNFHGRVTVASVKNFQLVASDERAPTPSNQEEEDDVILQFGKIGKDLFTMDYRYPISA

SEQ ID NO: 25059 - DNA, 615 bp, Panicum virgatum
  misc_feature: Ceres CLONE 1861857-R
ccatctgcctaagcagctttgacaccaaaattggttgtgaatgaatcaaggtatgacattcaatctaagcttttagctgggtgtttatgatgtgtaccaacaatttatctttataagtggtctccatcaccagcatggcgtttctgcacacacatatacatttaacacgcaccattttattcattttttttttgcgagtgccaatttatttacttttagatcccattttcaaaggctatgttgttgttgttgttagatcccattttcctacaggtgttggaatcacagaaagtcgaatcaaagacagcaaggacaatctatactacttgagtttcaagatggcgagtttggtgaatggtgattatagagctagatacttctattctataatgtcgtgatataaatagcaacctagctttagtgggttttgtaagtgtcgggaagtctgaacgactgaacaccaggtccagagtgtcctctagtatttcgcttttcattcagcgtttgagttcagattaaaatggagaggtcatatattcatatttgcatctatgtatgaacccttctgagatgacagaaggctcgcagccgaatatattgatgacaagggttcaa

SEQ ID NO: 25060 - DNA, 1321 bp, Panicum virgatum
  misc_feature: Ceres CLONE 1861860
  misc_feature: Encodes the peptide sequence at SEQ ID NO. 25061
gtcgggacacgagttggcccgcgagccacatcctcgctccactctcctggctctctccctccagataaggctataaaatccagcgagctaatcctctcccgctgtcccctcccctcccgcctccgcttcccctcccctcggcgacgaggaggcgcggccccgccaccaccggaccggccggcggcgtggtgtgtgccaccaggttttgaaggaatcaggggtttgatatagttgcgggatacttaattcccttgattcaaaatgacgccagtgattcattgttctgtcggcaatattagcctgtttcacattggaagtatcaggaccaaccgagaaatccagataagaagattgcagggctcagctaggtattcgagggtagcatcaccatcacctcgaagactgttgctgccacaaacagcattccacttgatcagtatttacaaaagaagctggtcctcagcccagaggcaaagaaccttgtctgctgcaacggtgggaaccaatgtcacagtggaggatcagaattcatcctcttcaggagaaacttccgatgaaaactttgaggctgcacctgatgctgttgaagcaagtgagcaggctgaggctagcacggaccaagcttcttctgcccgtaaattaggacgcaacatacggaagagtgagatgcctccactgactgatgaggatctagttcctggtgcatcttttactgggaaggtgaggtctattaaaccattcggagtttttgttgacatcggagcattcacggaaggccttgtccatatctcccgagtaagtgatgggtttgtaaaagatatatcttccctcttcactgttggacaagaggtttcagtaaaattgcttgaagcaaataaggaaacagggcgcatctctcttaccatgcgggaaggtgatgactatgtcaagccaaaaaaggaagcacctaaggctacaactggtgggcggagtgccactgcgactcccagaagctcacctaggcaaacaaaggaaaggcaggaagccaaggcaacaagcgagtcaaaatatgcaccagggcaatctctgaatggcactgtgaaaagtacaacaagagctgggacatttgttacactacctgatgggagtgaagggttccttcccagagaagaggaagcagttgcattgtttacccttattgggcaatccgcaatggaagttggtaaacaaataagggttaaagtattgaatgtagcacaaggtcaggccactttgacaatgaaagacgtggaagatgatgaagatgatttgcaaacactgaacacggagcttaagcgtgact

SEQ ID NO: 25061 - protein, 353 aa, Panicum virgatum
  misc_feature: Ceres CLONE 1861860
  misc_feature (143)..(216): Pfam Name: S1 Pfam Description: S1 RNA binding domain
  misc_feature: SWISSPROT Homolog: EC 2.7.7.8 Polyribonucleotide nucleotidyltransferase
MTPVIHCSVGNISLFHIGSIRTNREIQIRRLQGSARYSRVASPSPRRLLLPQTAFHLISIYKRSWSSAQRQRTLSAATVGTNVTVEDQNSSSSGETSDENFEAAPDAVEASEQAEASTDQASSARKLGRNIRKSEMPPLTDEDLVPGASFTGKVRSIKPFGVFVDIGAFTEGLVHISRVSDGFVKDISSLFTVGQEVSVKLLEANKETGRISLTMREGDDYVKPKKEAPKATTGGRSATATPRSSPRQTKERQEAKATSESKYAPGQSLNGTVKSTTRAGTFVTLPDGSEGFLPREEEAVALFTLIGQSAMEVGKQIRVKVLNVAQGQATLTMKDVEDDEDDLQTLNTELKRD

SEQ ID NO: 25062 - DNA, 757 bp, Panicum virgatum
  misc_feature: Ceres CLONE 1861860-R
  misc_feature: Encodes the peptide sequence at SEQ ID NO. 25063
aggccaccgacggcgggagccggccgctgacgtgggcgcacgccaggagcatggcgctgacgcacagggtgattttggagagcttaaggatggcgagcatcatctccttcacattccgggaggccgtggctgacgtggagtacaaagggttccttatccccaaggggtggaaggtgatgccgctcttcaggaacatccatcacaacccggactacttccaggatccacacaagttcgacccttctagattccaggtggcgccgcggccgaacaccttcctgccatttgggaacggcgtgcacgcctgcccgggcaacgagctggccaagctcgagatgctgatcctcatccaccacctggtcaccggctacaggtgggagattgttggatccagtgacgaggtcgagtacagcccattccccgtgcccaagcacggcctgcctgtcaggctatggagagacaacaggaccgtggaccgaaagggtgtttgcgagagtgatgacgttgaggacattatagtttgacactcaaattaggcattaatttaacctggctagctatagagtttttttggtttctttctcgtttccttttccttttcgttgctcgcctttctcctgatcacattaagttggaggagaagaaagagggcagctttctcttccctctttttctttacttgtttctgataatggtgcaaaagtaagctcatgtagtaagctatgtggctatcaagtatcgttgatacattccccct

SEQ ID NO: 25063 - protein, 173 aa, Panicum virgatum
  misc_feature: Ceres CLONE 1861860-R
  misc_feature: SWISSPROT Homolog: EC 1.14.13.93 (+)-abscisic acid 8'-hydroxylase
ATDGGSRPLTWAHARSMALTHRVILESLRMASIISFTFREAVADVEYKGFLIPKGWKVMPLFRNIHHNPDYFQDPHKFDPSRFQVAPRPNTFLPFGNGVHACPGNELAKLEMLILIHHLVTGYRWEIVGSSDEVEYSPFPVPKHGLPVRLWRDNRTVDRKGVCESDDVEDIIV

SEQ ID NO: 25064 - DNA, 2088 bp, Panicum virgatum
  misc_feature: Ceres CLONE 1861866
  misc_feature: Encodes the peptide sequence at SEQ ID NO. 25065
ggctaaccttactccgcctgtgttaccacccttcgaccgccccccccccccacccaaaggccaacagcggattggagcagagatccatccggattctcgtcggtcggggaagaagacccgccccgccggagatggccacggtacctcctcgccgggctaggggagacgtaaatatcgagtccctggcgcggccggtcgctgtcgaccaccgcatcaccatccagtactacttccgcatcgccgacaacctccttcgccaggctgatgtgtatcgagaggagaagaaccttctggacctgtacattatcctcttgagatattcgagcttgttgcttgagacgatacccaagcatcacgattacattgcatttaaggcgagagaaaaggaattcctgaagaaaggcccccacaactctaagaaacttcataatgttctcaatgagctagaatccctgaagccagttgtgcagaaacaatttgccaactgtaatagcggtggtgcagaggaacctaatggtgtgcatggaacctatgctgcaagcagtgggatggagcagcatatcccaagcccgtatatgccaaagtcattggcgggaagccctactggactacagcagaaatcgttctctagttcaaaccttccagcagcatcagtgcagaatgttcaacctgagagacaactaatcaaacgatattctactctgccttatccaaaagaggaaacattatcaagacactcagtactaggaccaaatgggcttcatggccaatgggcagggcctgttactggtaccaggattgagtatccatgtaatcctgaattgacccaaactgatatctcaagtttagtgccatctatcttgaaccaggacagcttgcatggtcccaatacagtatcacaggacagaaatgatgatatgctgtctgttctctcacttgatgatggaagatggtctttgccagtagaagaaccaacctcagtatctccgggtttggaagcagagttttcccagctgaatataagacaaccttgtccccctcctgtcctagcacaggtgcattctcagcgtggaccgattcctccatcaagagttgctgatccaagaccaggacttgctacttctgacactggaagctatcagaatttgcatgtgccagtggcattaatggagtgcttcctgagggttgctgaggcaaataccgcaaaaaatttggaaacctgtgggattcttgcgggtagcctgaaaaaacgaactttctatgtgacgacgctgataattcctaaacagaaatcaacatctgattcatgtcaagctacaaatgaagaagaaatttttgaattccaggacaagggctcacttttacctcttggttggattcacacacatccaacacagacctgcttcctatcttccattgatcttcataatcattatgcgtatcagatcatgctacctgaagcgattgccattgttatggcaccaactgacacaacaagaaagcatggcatatttcatctcacggatccatgtggcatgggtgtgatccatgattgtgatgctactggattccatccccatgaggagcccctagatggcacgccaatctacgagcattgctcccatgtgtacgtgaacccgaacgtgaaatttgagatggttgacctacgtgcagtgtgagaagccatggttcccttttggcataaattgccagttatacttctagcaggtgaccttttcagatccaagaaccacagcggttgtacatagctattttattccattttcatgtacataacttctatattgaatggaggctttgttttcatatctggggttaagtgacatcaatctaggcaccatggtgtgtgtgtgtctgtctgggggtgggggtggttgcttcgttttataccctttcaagtgttattttgttttttacttccctttcttttggtaataaaagctagtctgagtagggtcgcgcttgcaccattgcgtggcacgcacttcgtttttttctcaatggcttgccatgtgttggcttgcgcgcccattgtctttgcgtattttgatattaaaggagagagtt

SEQ ID NO: 25065 - protein, 515 aa, Panicum virgatum
  misc_feature: Ceres CLONE 1861866
  misc_feature (334)..(443): Pfam Name: Mov34 Pfam Description: Mov34/MPN/PAD-1 family
  misc_feature: SWISSPROT Homolog: EC 3.1.2.15 Ubiquitin thiolesterase
MATVPPRRARGDVNIESLARPVAVDHRITIQYYFRIADNLLRQADVYREEKNLLDLYIILLRYSSLLLETIPKHHDYIAFKAREKEFLKKGPHNSKKLHNVLNELESLKPVVQKQFANCNSGGAEEPNGVHGTYAASSGMEQHIPSPYMPKSLAGSPTGLQQKSFSSSNLPAASVQNVQPERQLIKRYSTLPYPKEETLSRHSVLGPNGLHGQWAGPVTGTRIEYPCNPELTQTDISSLVPSILNQDSLHGPNTVSQDRNDDMLSVLSLDDGRWSLPVEEPTSVSPGLEAEFSQLNIRQPCPPPVLAQVHSQRGPIPPSRVADPRPGLATSDTGSYQNLHVPVALMECFLRVAEANTAKNLETCGILAGSLKKRTFYVTTLIIPKQKSTSDSCQATNEEEIFEFQDKGSLLPLGWIHTHPTQTCFLSSIDLHNHYAYQIMLPEAIAIVMAPTDTTRKHGIFHLTDPCGMGVIHDCDATGFHPHEEPLDGTPIYEHCSHVYVNPNVKFEMVDLRAV

SEQ ID NO: 25066 - DNA, 720 bp, Panicum virgatum
  misc_feature: Ceres CLONE 1861882
  misc_feature: Encodes the peptide sequence at SEQ ID NO. 25067
aagtctccagttcttccagcgcgcgtaactctccactccatggaagaccagagccccaagcccatccgctgctcattatccctttatctctaaccatcgacgacgtacgtctccggcagctgcggtgtgcagagccgccggcgagccgctcatcgtcgaggagatcgtcgtcgatccaccgaaagcgtacgagatccgcatcaagatcatctgcacctcgctctgccacagtgacatcaccttctggcgaggcaaggcagcaacagcttttccaagaatcttaggccacgaagcctacggggttgtggagagcgtgggggagcatgtggagggcttcgccgccggcgacacggtggtgccgacgttcatggggcagtgcgaccgctgcccgggctgcgcttccgagcacaacaacctctgcaccacggtgcccttcgtgttcggccccgggatgcggcgcgacggcaccacccggttccgggacgcccaggggaaccccctccacgacctggtcgccgtgtccagcttcagccagtacaccgtcgtggacgtgacccaggtcgtcaggatcgaccccgccgtgccgcccaagctcgcctgcctcctcagctgcggcgccagcaccggggtgggagctgcatggagggtggccaaggtggaaccaggctcatcagtggccatctttgggctggggtccgttggggtagcggtggcgcaagt

SEQ ID NO: 25067 - protein, 117 aa, Panicum virgatum
  misc_feature: Ceres CLONE 1861882
  misc_feature: SWISSPROT Homolog: EC 1.1.1.1 Alcohol dehydrogenase
  misc_feature: Useful for making plants with modulated heat sensitivity
MGQCDRCPGCASEHNNLCTTVPFVFGPGMRRDGTTRFRDAQGNPLHDLVAVSSFSQYTVVDVTQVVRIDPAVPPKLACLLSCGASTGVGAAWRVAKVEPGSSVAIFGLGSVGVAVAQ

SEQ ID NO: 25068 - DNA, 2168 bp, Panicum virgatum
  misc_feature: Ceres CLONE 1861894
  misc_feature: Encodes the peptide sequence at SEQ ID NO. 25069
accaccgtggcaccgtcccccgcgtcgcctcctcgtctccaccgaatcgagagacctacacgcgcacggaggaaagggggagagggagacggagcaggcaagccctacccctccaatgggcgactccgacgaggcgccgccgcccgtccaccgccgcccgccgcgcccggcccgcgggagcgggggcgggggcgccgtcgagcgcttcgcggccgcgctgcgccgtcgggtgaggtccggcgcctcggtggccgcgcgcgccagcttcgcggccgactccggggacgagtccgctgccagcgagccctcctcgtcgtcccgccgccgcgacaccagcggcgacgcttcgtccgccggcggtgccgccgggggaggggacttctcggctttcaccttccgcgcggccgcgccggtccaccggaaggccaaggagagccccctcagctccgccgccatcttcaagcagagtcatgcaggccttttcaacttatgtatcgttgttctggttgctgtgaacagcaggctcattatagagaacttaatgaagtatggcttattaataagatctggtttttggtttaatgctacatcattgcgcgactggccactgctaatgtgttgccttagtctacctgttttcccccttggggcatttgcagttgaaaagctggcattcaacaatattattactgatgctgctgctgccggtcttcacatctttcttacaacggctgaaattgtatatccagtgctcgtaattcttatgtgtgattctgcagttttgtccggctttctgttgatgtttattgcctgcattgtttggctgaagcttgtatcttttgcacatacgaaccatgatataaggaaattgatcacaagtggcaagaaggtcaataacgaactcagcgcagctgacatagacaatttacaagctccaactcttgggagtctagcatacttcatgatggctccaacactctgttatcagccaagctatcctcgaactccttgtattagaaaaggttggctaattcgtcaaattattctgtacttgatatttactggtcttcaaggattcattattgagcaatacataaatcctattgtcgtgaactctcaacatccactgaagggaggactattgaatgctgtggagactgttttgaagctatcattaccaaacgtatacctgtggctttgcatgttctattgcgttttccatctatggttgaatatacttgctgagattcttcgctttggtgaccgtgaattctacaaagactggtggaatgcaaaaacaattgatgagtattggagaaaatggaatatgcctgtgcataaatggattgttcgtcacatatactttccttgcatgcggaatggtatatctaaggaagttgctgtttttatatcattctttgtttctgctgtactccacgagctatgtgttgctgttccctgccacatactcaagttctgggctttcttaggaatcatgttgcagattccccttatcgtattgacatcttacctcaaaaataaattcagagacacgatggttggcaatatgatcttttggttctttttctgcatctacgggcaacctatgtgcgttctcttgtattaccatgatgtgatgaacaggatcaactagacaacataaacttctgcaggtccttctttgtgagtcactcttccatcatggaatctgaaaagcaataatttgtgttcactccgccaactgcatatattttttatccctttgctacggccatccaggtttttcaagggaatccagtgtatatcattttatcctgtgtatgatagctagccttatctcactcttgtatctgtacataagcttcattctggtgaggttctacatgtaactgtaatggaaatattattcccctttctgcactggtagtgccacatgctgacctgctcatgatgctagtataacatcatttggtgtctagcatggattaaagttaagtttctctgtaatctgaacgtagatctgtgatgccatctggtactccatttgatttattgtttgaaaatgtattgttctaaatagaagttgtattataaaaatattcttactggtgaaattagtggcattaatcttgtggtgaattgatagacggctagacgctattagtcac

SEQ ID NO: 25069 - protein, 512 aa, Panicum virgatum
  misc_feature: Ceres CLONE 1861894
  misc_feature (221)..(504): Pfam Name: MBOAT Pfam Description: MBOAT family
  misc_feature: SWISSPROT Homolog: EC 2.3.1.20 Diacylglycerol O-acyltransferase
  misc_feature: The sequence is a functional homolog of SEQ ID NO 2 in US patent 7067718
MGDSDEAPPPVHRRPPRPARGSGGGGAVERFAAALRRRVRSGASVAARASFAADSGDESAASEPSSSSRRRDTSGDASSAGGAAGGGDFSAFTFRAAAPVHRKAKESPLSSAAIFKQSHAGLFNLCIVVLVAVNSRLIIENLMKYGLLIRSGFWFNATSLRDWPLLMCCLSLPVFPLGAFAVEKLAFNNIITDAAAAGLHIFLTTAEIVYPVLVILMCDSAVLSGFLLMFIACIVWLKLVSFAHTNHDIRKLITSGKKVNNELSAADIDNLQAPTLGSLAYFMMAPTLCYQPSYPRTPCIRKGWLIRQIILYLIFTGLQGFIIEQYINPIVVNSQHPLKGGLLNAVETVLKLSLPNVYLWLCMFYCVFHLWLNILAEILRFGDREFYKDWWNAKTIDEYWRKWNMPVHKWIVRHIYFPCMRNGISKEVAVFISFFVSAVLHELCVAVPCHILKFWAFLGIMLQIPLIVLTSYLKNKFRDTMVGNMIFWFFFCIYGQPMCVLLYYHDVMNRIN

SEQ ID NO: 25070 - DNA, 718 bp, Panicum virgatum
  misc_feature: Ceres CLONE 1861913
  misc_feature: Encodes the peptide sequence at SEQ ID NO. 25071
ggtgcaagcaaagctaagccgattcttttcccaccagatcagcagcggcgcgaacaaattcggagctcgcagcccgcgaatcgccagtagttctcggattctcgccggcctccagacccagcccgccgcccgccgccgagcctatccgatcggcgcgggcggtcccccgccaccacttgcgcgggcgcgggcgcggccgccgccgggtttgggtgcggcggattccggggggcaccgccgctcgcaagtggcagcgcggcgcctcgtcgcgcgtgcccacccgcgcggctacatatctaccggcttggtgaaggggcggtccgtcgtcggttgcggtgcgcggtggagtctctcgctgagcgcgccggctgctggagctcggtctgagtttggatgggccagatggtttcggatgataaattcgaagaacaagcagctcgcaatggtgggatcatcaagaatggaagggaaatcttattccaggcttttaactgggaatccaataagcataactggtggagtatgttagaggaaaaagtaactgatctggcagaatctgggtttacatcagcatggcttcctccaccaactcagtcattatctcgagaaggctatctaccacagaacctgtactgccttgactcttgttatggttctctgtcagagctgaaatcattgcttcataaaatgaatgagcataatctaagggctatggcag

SEQ ID NO: 25071 - protein, 105 aa, Panicum virgatum
  misc_feature: Ceres CLONE 1861913
  misc_feature: SWISSPROT Homolog: EC 3.2.1.1 Alpha-amylase
MVSDDKFEEQAARNGGIIKNGREILFQAFNWESNKHNWWSMLEEKVTDLAESGFTSAWLPPPTQSLSREGYLPQNLYCLDSCYGSLSELKSLLHKMNEHNLRAMA

SEQ ID NO: 25072 - DNA, 728 bp, Panicum virgatum
  misc_feature: Ceres CLONE 1861917
  misc_feature: Encodes the peptide sequence at SEQ ID NO. 25073
aaccgccaccgacatcgcctggtaacccgtcgtccccgaatccacccacccacattccccgaaccccacgccgcattcttcccgatccaaccgcgccgccgcaccaggaggggaaggaagaggaaaggagacggaccatgtcgtcgccgcccgcccgcatggatctggacggcaaccccgtcgcgcccctcaccatctgcatgatcggcgcaggtggcttcatcggctcccacctctgcgagaagctcatggccgagaccgcacacgtcgtcctcgccgtcgacgtctactgcgacaagatccgccacctcgtcgaccccgcgccgccgcacctcgctggacgaatctccttccaccgcctcaacattaagaacgactccaggctcgagggactcatcaagatggccgatctgacgataaacctggcggccatctgcacgcccgccgactacaacacgcggcccctcgacaccatctacagcaacttcatcgacgccctcccagtggtcaagtactgctccgagaacaacaagcgtctcatccacttctccacgtgcgaggtctacggcaagaccatcggcagcttcctccccaaagaccaccctctccgcaaggaacctgaattttatgttctaaaagaagatgagtcgccctgcatttttggtccaatcgtgaaacagcgatggtcctatgcatgtgcaaagcaacttattgagaggcttattttt

SEQ ID NO: 25073 - protein, 196 aa, Panicum virgatum
  misc_feature: Ceres CLONE 1861917
  misc_feature (20)..(196): Pfam Name: Epimerase Pfam Description: NAD dependent epimerase/dehydratase family
  misc_feature: SWISSPROT Homolog: EC 4.1.1.35 UDP-glucuronate decarboxylase
  misc_feature: Useful for making plants with altered carbohydrate content
  misc_feature: Useful for making plants with altered cell wall content and/or composition
  misc_feature: Useful for making plants with altered lignin content
MSSPPARMDLDGNPVAPLTICMIGAGGFIGSHLCEKLMAETAHVVLAVDVYCDKIRHLVDPAPPHLAGRISFHRLNIKNDSRLEGLIKMADLTINLAAICTPADYNTRPLDTIYSNFIDALPVVKYCSENNKRLIHFSTCEVYGKTIGSFLPKDHPLRKEPEFYVLKEDESPCIFGPIVKQRWSYACAKQLIERLI

SEQ ID NO: 25074 - DNA, 671 bp, Panicum virgatum
  misc_feature: Ceres CLONE 1861932
  misc_feature: Encodes the peptide sequence at SEQ ID NO. 25075
atagaataagaacactactagagtactagttaggcaacaaactgaaggaaacgccatgggtgtcctgatactggttcatatccttatcagcttctctgcttgtgctgaagctctaaggagagcagacttccctccaggttttgtctttggcacggcttcttcagcttaccagtatgaaggcgctgtcaacgagggtcaacgtggacctacaatatgggatactctcacaagacgacctggacgggtgatagatttcagcaatgcagatgttgctgttgatcactaccatcgttacaaggaagatgtggacttgatgaaggacattggcatggatgcgtaccggttctctatctcatggtcccgtatctttccaaatggaactggtgaacctaacgaagaaggattgaattactataacagcctcatagatgctctgttagacaaaggtatacaaccatatgtaacactctttcactgggaccttccgcaagcactagaagacagatatggtggatggttaaactcccaaatcgtggatgattttgttcactatgcctctacatgcttcaaggaatttggagatagagtgaaacactggatcacttttaatgagccccataattttgcgattgaaggatatgatcttggcattcaagcaccagggagatgtt

SEQ ID NO: 25075 - protein, 205 aa, Panicum virgatum
  misc_feature: Ceres CLONE 1861932
  misc_feature (21)..(205): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
  misc_feature: Useful for making plants with modulated flowering time
MGVLILVHILISFSACAEALRRADFPPGFVFGTASSAYQYEGAVNEGQRGPTIWDTLTRRPGRVIDFSNADVAVDHYHRYKEDVDLMKDIGMDAYRFSISWSRIFPNGTGEPNEEGLNYYNSLIDALLDKGIQPYVTLFHWDLPQALEDRYGGWLNSQIVDDFVHYASTCFKEFGDRVKHWITFNEPHNFAIEGYDLGIQAPGRC

SEQ ID NO: 25076 - DNA, 2038 bp, Panicum virgatum
  misc_feature: Ceres CLONE 1861937
  misc_feature: Encodes the peptide sequence at SEQ ID NO. 25077
acagcagcagcggcccactcgtccgcttcgctttgtctctcctcgccgccgccgccccccccccctcctccgaccacgccaccgcgcgcgcaattcgaagcaggagtgccgcgccgggagacggggcagcgagcgggagcccgaggagggggccggcgcaatggggctcacgggcgcggccatctccgcgccgctcggctgccgcgggctgccgcgcggcgcggtcggcggcggaggcgacaaggcgcggagggcgggggcggagaggtggcggcgggcgggcgcgggtcggcgctcgggcggcgcgaaggtgaggtgcgtggcgaccgagaagaacgacgagacggcggcggcggcggtcggcgtcgagttcgcggacgaggaggactaccgcaagggcggcggcggcgagattctctacgtgcaaatgcaggccaccaagcccatggaaagccagtccaagatcgcctccaagctgctgcccatatccgatgaaaattcagtacttgatttggttatcattggctgtggtcctgctggtctttctctagcttcagagtcagccaagaaagggctcactgtaggtcttattggccctgaccttccattcacgaacaactatggtgtctgggaggatgaattcaaagatcttggtctagagaactgtatcgagcatgtctggaaggatactattgtctacctagacaataataaaccaatactgattggccgttcctatggcagggtgcaccgtgacctgctgcatgaggagttactgagaagatgctatgaagctggcgttacatacctcaactcaaaagtggacaagatcatcgaatctccagatggtcatagagtagtctgttgtgaaaggggccgtgagatactctgcaggcttgccattgttgcttcgggggcagcatctggtaggcttctggagtatgaggttggaggtccccgtgtctgtgtacagactgcatatggagtagaagttgaggtcgaaaacaatccatatgatcccagtttaatggttttcatggactacagagattgtttccaacagaaattctcagactctgaacaagaaaatccaactttcctgtatgctatgcctatgtcgtccacgcgagttttctttgaggaaacatgtttagcctctaaagatgcgatgccctttgatatacttaagaagagattaatgtatcggttggatgcaatgggagttcgaatcctgaaagttcacgaggaggaatggtcctacattcctgttggagggtccttaccgaatacagataagaaaaatcttgcatttggtgctgcagcaagtatggtgcatcctgcaacaggctactcagtggtcagatctttatctgaggctccaagatatgcctctgtaatatccgatatcttaaggaaccgagttcctgcacaatttttggcaggaagttctcaaaattacagtccatcaatgctcgcatggagaacactatggcctcaagaaagaaaacgccaacgatccttcttccttttcggattggcattgataatccaactgaataatgaaggcatacaaacattcttcgaagcctttttcagggtgccgaaatggatgtggcaagggttcttgggctcaaccctttcatcggtggatctaatactgttttcattctacatgttcgccatagctccgaaccaattgcgaatgaacctcgtcagacatctcctctctgacccaacaggctcgacaatgatcaagacctacctgaccttgtaaaactatgtcaccagtctgcaagaactctagaaactgtacagttttgtagttgtacataacttagaggggatctgagggttacttttctttttgctgtttgacagcgggtgggactcggggtcgctgctcagtggcatgatagagtacacttggtaactgtttgtttgctatagtgctgggatagggaagcacatggtgttgtgcatgctggacgaacaagtagagggatcaactgatggtcattgttcctgcatcatattggcc

SEQ ID NO: 25077 - protein, 537 aa, Panicum virgatum
  misc_feature: Ceres CLONE 1861937
  misc_feature (117)..(515): Pfam Name: Lycopene_cycl Pfam Description: Lycopene cyclase protein
  misc_feature: SWISSPROT Homolog: EC 5.3.99.8 Capsanthin/capsorubin synthase
  misc_feature: Useful for making plants with altered lutein content
  misc_feature: Useful for making plants with altered lycopene content
MGLTGAAISAPLGCRGLPRGAVGGGGDKARRAGAERWRRAGAGRRSGGAKVRCVATEKNDETAAAAVGVEFADEEDYRKGGGGEILYVQMQATKPMESQSKIASKLLPISDENSVLDLVIIGCGPAGLSLASESAKKGLTVGLIGPDLPFTNNYGVWEDEFKDLGLENCIEHVWKDTIVYLDNNKPILIGRSYGRVHRDLLHEELLRRCYEAGVTYLNSKVDKIIESPDGHRVVCCERGREILCRLAIVASGAASGRLLEYEVGGPRVCVQTAYGVEVEVENNPYDPSLMVFMDYRDCFQQKFSDSEQENPTFLYAMPMSSTRVFFEETCLASKDAMPFDILKKRLMYRLDAMGVRILKVHEEEWSYIPVGGSLPNTDKKNLAFGAAASMVHPATGYSVVRSLSEAPRYASVISDILRNRVPAQFLAGSSQNYSPSMLAWRTLWPQERKRQRSFFLFGLALIIQLNNEGIQTFFEAFFRVPKWMWQGFLGSTLSSVDLILFSFYMFAIAPNQLRMNLVRHLLSDPTGSTMIKTYLTL

SEQ ID NO: 25078 - DNA, 1573 bp, Panicum virgatum
  misc_feature: Ceres CLONE 1861938
  misc_feature: Encodes the peptide sequence at SEQ ID NO. 25079
atcggagcatggcgtcagcggcggtggcggacgccggcgacgcgccggagcccacggtgcagaacctcctcgaccaggacaccctcaagtgggtcttcgtcgggggcaagggcggcgtcggcaagaccacctgcagctccatcctctccgtcctcctcgcctccgtccgccagtccgtgctcgtcatctccaccgaccccgcgcacaacctcagcgacgccttccagcagcgcttcaccaaattccccaccctcgtccgcggattcaccaacctctacgccatggaaattgatccaaaggtagaaaatgacgatttatccaatgaaggaatggagggattcctttcagaactgacaaatgctattccaggagtagatgaagctatgagttttgctgaaatgctaaaattagtccaaacaatggattactctgttgtagtttttgatactgctcctacagggcatactttacggctgctgcagttcccagcaaccctagaaaagggtcttgagaaaatgatggagttgaaaaatagatttggcggtctgttgaatcaggccagtcgattgtttggtcttggtgatgaaataaacgaggatgcaatgcttgggagactcgagggtatgaaggacgtgatcgagcaagtgaacaagcaatttaaagatccggacttgacaactttcgtgtgtgtttgtatccctgaatttctttcattatatgaaacagaaagattggtgcaagaattggcaaagtttgagattgattcacacaatattattatcaaccaagttatctttgatgaagaacctgttgagtcaaaactgctaaaagcacgaataaaaatgcaacagaaatatattgatcagttccatatgttatatgatgacttcaacatcaccaagctgcccttactttcagaagaggtttgtggtgttcaagctttgcaaaacttttccgggcacttccttacaccatacaagtctgctctgaaaaggggcactgtcgaggagctggaacaaagagtatctatactgaaatctgcactgcaagaggctgagtcagaattagatagggttaagaaagggaagcaggcagcatgatcctctctttttcacgggtaaggtgtgtaaaacctgacagaagctatgaagaaagcagagttggagagagacatctcaaagttttcgtgtcattacacactcttgttgatttcacttcatatttcctcaatcgacatccttagatttgtaatagcaatcagcagagaagcgtatgattagcacgagatatagatacattcttttttgccagttattcaggtatctgacgatcggttccagaattcatcctcctggtacagtttgatcaaaggatgttattttccaagaaactctgcatttggcaggtgctagtttttctcgatgcataatactgagtttgcgttttggagtttttgagaaatactcaggttttggaaaactaggaggtgggtacaacaaaacatgtacttttagcaaaaaattgtagcttcgttaaacttcagtgttgcttaatactgtaaccttgagttatg

SEQ ID NO: 25079 - protein, 363 aa, Panicum virgatum
  misc_feature: Ceres CLONE 1861938
  misc_feature (26)..(321): Pfam Name: ArsA_ATPase Pfam Description: Anion-transporting ATPase
  misc_feature: SWISSPROT Homolog: EC 3.6.3.16 Arsenite-transporting ATPase
MASAAVADAGDAPEPTVQNLLDQDTLKWVFVGGKGGVGKTTCSSILSVLLASVRQSVLVISTDPAHNLSDAFQQRFTKFPTLVRGFTNLYAMEIDPKVENDDLSNEGMEGFLSELTNAIPGVDEAMSFAEMLKLVQTMDYSVVVFDTAPTGHTLRLLQFPATLEKGLEKMMELKNRFGGLLNQASRLFGLGDEINEDAMLGRLEGMKDVIEQVNKQFKDPDLTTFVCVCIPEFLSLYETERLVQELAKFEIDSHNIIINQVIFDEEPVESKLLKARIKMQQKYIDQFHMLYDDFNITKLPLLSEEVCGVQALQNFSGHFLTPYKSALKRGTVEELEQRVSILKSALQEAESELDRVKKGKQAA

SEQ ID NO: 25080 - DNA, 1285 bp, Panicum virgatum
  misc_feature: Ceres CLONE 1861969
  misc_feature: Encodes the peptide sequence at SEQ ID NO. 25081
actctcgcccagacgacagacagccaccgcgatggcgcagatcatcgacggcaaggccatcgccgccgacatccgccgcgaggtcgcggccgatgtcgccacgctctcctccgcccacagcgtcgtgcccgggctggcggtggtgatcgtggggagcaggaaggactcgcagacgtacgtgaacatgaagcgcaaggcctgcgccgaggtcgggatccgctccgtcgacgtcgacctccccgaggacatctccgagctcgcgctcgtcgccgaggtccaccgcctcaacgctgaccccgccgtgcacggtgccgcctttacttctcctctttccggtacactgtcgtctgggttgcagcagaacgcatgcttctgttctctggctcttagctaggcttagtctgttgggcatgctcctatgatccattcggcatttgtgctgcgaatgttgtcattgctgcttcactaccattcgtcaggatcagatgcttagatgttcacttgtgctatccgctgtgcctgcggataccattcattcacagacgccagacagtatgcataggcctccaggtttgcagttcattgaatttggtctgatcctgtctctatcgagtctatcatttctgatgccatacttggaattggaatcattgagggcactacggcatggaggtggatttgaaaagagtaatgattaatagtttaatactagtttgtgctttctatagtgtgggatgtgggttgtctcttaaccaagggtatgcagatcccaattcactccttgtttcttgggagtgtttggagtagtccaatctctattcactagattaggcatcagaacttaggtttttcaagtcaagttgcaaagttgcatagatttgtaaaaaggaacaaatggtcagaagaaaacagtgccccagatgttttgttttggtgtgatttgcctacctcatgcgacaggattccccatcttactgattttgttagttgttctgtcattttgttagaacctaggaggttctttttggccaagttcaaatattaaattggtaaggccatagagggatgaagcattgcattgctcggttgtaaatgagaaactataactaaagaaaatctgggcatgacgatctaagttgaatatcttcccaaaaatctgaactttggagttctgcatctggtcaatcaacttgtcttttcataactatggagataagtgttatccagcatgggaatagtcgactaggggactatggctttaaaaagaatttgtgtctacctctgc

SEQ ID NO: 25081 - protein, 120 aa, Panicum virgatum
  misc_feature: Ceres CLONE 1861969
  misc_feature (3)..(94): Pfam Name: THF_DHG_CYH Pfam Description: Tetrahydrofolate dehydrogenase/cyclohydrolase, catalytic domain
MAQIIDGKAIAADIRREVAADVATLSSAHSVVPGLAVVIVGSRKDSQTYVNMKRKACAEVGIRSVDVDLPEDISELALVAEVHRLNADPAVHGAAFTSPLSGTLSSGLQQNACFCSLALS

SEQ ID NO: 25082 - DNA, 603 bp, Panicum virgatum
  misc_feature: Ceres CLONE 1861969-R
  misc_feature: Encodes the peptide sequence at SEQ ID NO. 25083
accgttaaagggaagcgagctgttgtggttggccgcagcaacatagtcgggctaccagtatccctgctccttctgaaggcagatgcaacggtatcaattgtgcactcacggacccctgatccggaaagtattgtccgggaagctgacatagtcattgcagcagctgggcaggctatgatgatcaaaggggactggatcaagccaggcgctgcggttatcgatgttgagacaaactcggtcgacgaccctaccaggaagtctgggtaccggcttgtcggtgatgttgatttcgcagaggtgagcaagatcgctggttacctgacgccagtcccaggaggtgttggcccaatgacggtggctatgctgctgaagaacacggtggatggagcaaagcggggaatagtcgagtaggagggatttcatctcattctatgtgctgtacgatctgtactgcaaggatgggaactggctcaaaaagtgtgttgatgtaacggcttgttccccattttggttgtttcaacttgccaagaataacagtagttaccctgtttgacaaatacaataaaaatgattgctggctttgctgctgttactttagtacgg

SEQ ID NO: 25083 - protein, 136 aa, Panicum virgatum
  misc_feature: Ceres CLONE 1861969-R
  misc_feature (1)..(134): Pfam Name: THF_DHG_CYH_C Pfam Description: Tetrahydrofolate dehydrogenase/cyclohydrolase, NAD(P)-binding domain
TVKGKRAVVVGRSNIVGLPVSLLLLKADATVSIVHSRTPDPESIVREADIVIAAAGQAMMIKGDWIKPGAAVIDVETNSVDDPTRKSGYRLVGDVDFAEVSKIAGYLTPVPGGVGPMTVAMLLKNTVDGAKRGIVE

SEQ ID NO: 25084 - DNA, 727 bp, Panicum virgatum
  misc_feature: Ceres CLONE 1861976-R
  misc_feature: Encodes the peptide sequence at SEQ ID NO. 25085
cattcgttggtgttttatttggttcggtggagattggccttgcagttgcaattgccatttccttcgcaaagatcatcatacattcactccgacctcaagtagagattcttggcaggctacaagggacaaatatcttctgcagtatcaggcaataccccgtagcttgccgaactccgactgtactgacgatacgcattgacacatccttcatgtgtttcatcaatgccactttcatcaaagaaaggatcataaattgggtccgggaagaagtggaggcgtcagatggaaaggccagagagaggatacaagcagttgtcctcgatatgtcaagtgtggtaaacattgacacttcaggactcacagcactagaagaaatacacaaggagttggcgtctctaggcatacagatggctatagctggtccaggatggaatgcagtgcagaagatgaaagtgtcaccggtcgtggacagagtaggagaagattggatattcctgacagtaggtgaagcagtggaggcctgtctgagtgcacataagggaacggctctcgaatgttgagcgagtgctaatcattagaaataatcacataagcgatgcagatctgcatcctatgaaggtgttactgcaatgtttgcacatgatgagcaggcattggctgtagtggctagtggggaaacaaaaccctgccgttttacaaagagtcgtgtttggtgttctggtcattc

SEQ ID NO: 25085 - protein, 185 aa, Panicum virgatum
  misc_feature: Ceres CLONE 1861976-R
  misc_feature (51)..(170): Pfam Name: STAS Pfam Description: STAS domain
FVGVLFGSVEIGLAVAIAISFAKIIIHSLRPQVEILGRLQGTNIFCSIRQYPVACRTPTVLTIRIDTSFMCFINATFIKERIINWVREEVEASDGKARERIQAVVLDMSSVVNIDTSGLTALEEIHKELASLGIQMAIAGPGWNAVQKMKVSPVVDRVGEDWIFLTVGEAVEACLSAHKGTALEC

SEQ ID NO: 25086 - DNA, 1141 bp, Panicum virgatum
  misc_feature: Ceres CLONE 1861976
atccgcctccccactccagccgagagcatttcctccgatccattgcgacgggggggggggggtcgctcggctcatccatgcacgggatgggtgtcttgttcctctaatccctgagaataatatcgccgcccttacatgatccgtctcccccggtgatgtttacgcgagagcaattctagcccgcccgtgatcgttgtcacctctcacaccgcgagattctccgtccaaacgccagaaccagggtccccttttaaagccagggagctcctgctcccgagttcccccaaacacttcaccagctagcttgctagctagctagccctgctgcagccatggaggccgcggcagccgtcgagtcgtcggccaccgtgtccgcattcgaggtatccaagcgcccggacacggccaagctcgtgctgaacagccccggcccgccgggcctgcgcgaggagctcgccgccgtggtcggcaaggcgttccggccgcgggcctccggcggcggcggccgggcggcgccgcggtgcgcgtgggtcctcacggcgctgcagtgcgtgttcccggtgctgcagtgggggaggagctacacactcaagtccttcaggagtgacgtcatggccggcctcactctcgccagccttggcatcccgcagagcattggatacgccaatctcgccaaactggaccctcagtacggcctttacacgagcgttgtgccgcctctgatctacgctgtcatggggacgtcgagggagatcgccatcggccccgtcgccgtggtctcgctgctgctgtcgtcgatgatccagaacatcgtcgacccggccgccgacccggcgacctaccggtcgctcgtcttcaccgtgacattcctcgccggggtcttccaggtctccttcggcctgttcaggctgggatttctcgtcgatttcctgtcacacgctgccatcgtcgggttcatggcaggcgcggccatcgtcatcgggctgcagcagctcaagggcctccttgggctcagccatttcaccaacagcaccgacatcgtctcggtgatcaaggctgtgtgctcggcgctacacgacccgtggcacccgggcaacttcttcatcggatgctccttcctcatattcatcctcgccatgcg

SEQ ID NO: 25087 - DNA, 586 bp, Panicum virgatum
  misc_feature: Ceres CLONE 1861980
  misc_feature: Encodes the peptide sequence at SEQ ID NO. 25088
aaggctcactcctctcctctcctcttctctcctgctgtactcccactagtcctggatccaaccaagttacggccgtcgagcgctctcgatggcggggtgactacgacgaacgccggcgcgccggtgtggaaccaccaccaggccctgacggtgggcccgcgcgggtcgatcctgctggaggactacggcctgatctagaacgtggcccacttcgaccgccagcgcatcccggatcgtgtggtccacgcgcgcgtcgcctccgccaagggcttcttcgagtgcacccacgacatgtcggacctgacctgcgccgacttcctccacgccgccggcgcccgcacgccggtgatcgtccgcttctcctcggtgatacgcgatcgcggttgcactgagactatccgcgacccgcgcgggttcgccgtctagttctacacccggaagggcaactgggacctgctgggcaataacttccccgtcttcttcatccgagactgtatcgagttcctcgacgtgatccacgccttcaagcccaacccacggtcgcacgtggaggagtactggcgcgtcttctacttcctctcgcacc

SEQ ID NO: 25088 - protein, 44 aa, Panicum virgatum
  misc_feature: Ceres CLONE 1861980
  misc_feature: SWISSPROT Homolog: EC 1.11.1.6 Catalase
MSDLTCADFLHAAGARTPVIVRFSSVIRDRGCTETIRDPRGFAV

SEQ ID NO: 25089 - DNA, 709 bp, Panicum virgatum
  misc_feature: Ceres CLONE 1861981
  misc_feature: Encodes the peptide sequence at SEQ ID NO. 25090
accagaccaaccaccttcctcttcctttcccccttgtcgctccacatgttgcagcgactccactcctgaatcaaatcgatccgccatgccccttcctcctcctactccaccatctccagtccagcgatgacctgcgcctctccatggcgccctgcggccgcaccctcctcctcccgctcgccgccgccaccgtcctcgtcgcctccaccatcttcctcttcgccgccgccggcgcgcgctggcgccccgccgacaccggcctccccgtgccgccccacgccgtctccgccgcggccgtccccgtgaccgccggcgcctcctccaacaccaccggcgcccgcaaagagctctcctttcttgacgagaacgacggccccgacgacccgggcgccggtgcggcgcgatgcgacccgcgcgctgccgccgtcagggtattcatgtacgacctgccgcccgagttccacttcggcctcctcggctggtcgccgccctcccccgactccgtctggctggacctcaccaacgacgctgctgcaccgccgccgcggtaccccgggggtctcaaccagcagcacagcgtcgcgtactggctcacactcgacctcctctcctcgtcctcggcgccctgcggcgccgccgtgcgtgtcgccgactcgcgcgacgccgacctcgtcttcgtccccttcttcgcctccctcagctacaccgg

SEQ ID NO: 25090 - protein, 188 aa, Panicum virgatum
  misc_feature: Ceres CLONE 1861981
  misc_feature: Useful for making plants with altered carbohydrate content
MAPCGRTLLLPLAAATVLVASTIFLFAAAGARWRPADTGLPVPPHAVSAAAVPVTAGASSNTTGARKELSFLDENDGPDDPGAGAARCDPRAAAVRVFMYDLPPEFHFGLLGWSPPSPDSVWLDLTNDAAAPPPRYPGGLNQQHSVAYWLTLDLLSSSSAPCGAAVRVADSRDADLVFVPFFASLSYT

SEQ ID NO: 25091 - DNA, 1761 bp, Panicum virgatum
  misc_feature: Ceres CLONE 1861996
  misc_feature: Encodes the peptide sequence at SEQ ID NO. 25092
atgccttctgggctttcaaacatcgcgtcgcgtcgcttctagtattcgcatcttccatctgcaacacggctacagtagattggttatctcctgtgaccctgtcggtcttccaaatttgctcactactcgtccccaaccacctgccgcaatcgtcgatattggcagcggacccgcgatggccatgggtccggcacttgcagggtcctcctcggcacctcctcgcctccgcgtccacgacaccgccctcgtgccgccgtccccgtcgccgccggagacctcgctcccgctcaccttcttcgacatcttctggctccactccccgcccgtcgagcgcctcttcctctaccgcctcgcccccgacgctgacgtggccgccatcgtctccaacctcaaggactccttgcaccaggccgtccgcgccttctacccgctcgccgggcgcctccgcctcacccccggcacgtccggccgctacgagctgcactaccgcccgggtgacgccgtcaccttcaccgtcgccgagtgcgacgccgacgacgcggacatcgacggcctcgcgtgtgatgatccccgcgaggttgccaagatcgcggcgctcgtgccgccgctgccggagggcggcaggctgttagccctgcaggcaacagtgctgtccgcacgccgtggcctcgccatcggcgtcaccgggcaccacgcctcctgcgatggctcgggctcgacgcacttcctgcacatctgggcggccgcatgcatcggcgccgaagcgccgcccccacctcccgtcatcgaccggactctcctccttgccgacccgaggggcctgtacgacatcttcttccaaggggcgcccagcaccgatgagatggagttcgtcaagatgtccgccgacaagctcctcgccacgttcaccctgtccaaggacgacctgcagcgcgtcaaggacatcgtggccgatgaggccatgagacgcggcgctgcgccgccgcggtgctcctctcttgtcgccacccttggtttcgcctggtcgcgctacctccagggagccagagagagctgcggctccgacgagggcgcggtgaccaacatcctcttccctgttgatcaccgctcccggatgaagcctcctctcccggaaaagtacctcggcaactgcgtcggcccagcattcggggtggcacccaagggcgagctggcggcggcgggcgcaggcggcctcttcagcgcgtgcgccgccgtcgccgccgccatagacgaagctgtgcgcgacatcgggactcccagcatggacgcgtggctggaccgcgtcagggaggcaagcgcgaaaggcgtcctgtccgttgccggatcgccgaggttccgcgtctacgagctggacttcggattcggccggccggcgaaggtggacatcgtgtccgtggcgaggaccggtgcggtggcgccggcggagagccggagcggcaccggcgggatggaggttggcgtctctttgcagcccgctggcatggagaggtacctgaagtgcttcgcggatggtatcgcgtggctccgccagcgaagttgagaattgaagatgggattgtgtgaatgctgaatttggtggcgcatggagggcgacacacgccggcaagctagtacaagatcaatgttgcaactagtcacgtgtagactactggtttgtctttttatatacattattagatcattgtgatttcatttagtgtgttgtatagtccaacacacaattatttatcctttttactc

SEQ ID NO: 25092 - protein, 461 aa, Panicum virgatum
  misc_feature: Ceres CLONE 1861996
  misc_feature (15)..(453): Pfam Name: Transferase Pfam Description: Transferase family
  misc_feature: SWISSPROT Homolog: EC 2.3.1.153 Anthocyanin 5-aromatic acyltransferase
MAMGPALAGSSSAPPRLRVHDTALVPPSPSPPETSLPLTFFDIFWLHSPPVERLFLYRLAPDADVAAIVSNLKDSLHQAVRAFYPLAGRLRLTPGTSGRYELHYRPGDAVTFTVAECDADDADIDGLACDDPREVAKIAALVPPLPEGGRLLALQATVLSARRGLAIGVTGHHASCDGSGSTHFLHIWAAACIGAEAPPPPPVIDRTLLLADPRGLYDIFFQGAPSTDEMEFVKMSADKLLATFTLSKDDLQRVKDIVADEAMRRGAAPPRCSSLVATLGFAWSRYLQGARESCGSDEGAVTNILFPVDHRSRMKPPLPEKYLGNCVGPAFGVAPKGELAAAGAGGLFSACAAVAAAIDEAVRDIGTPSMDAWLDRVREASAKGVLSVAGSPRFRVYELDFGFGRPAKVDIVSVARTGAVAPAESRSGTGGMEVGVSLQPAGMERYLKCFADGIAWLRQRS

SEQ ID NO: 25093 - DNA, 1886 bp, Panicum virgatum
  misc_feature: Ceres CLONE 1861998
  misc_feature: Encodes the peptide sequence at SEQ ID NO. 25094
accatggcttccctctaccaccactcatccttcccactctccccgccccaacagcttaccgcccccgagcccacacgcgcgccgcctccctcctgtcgcatctccaccctgccgtcctcatcccaccatggcagcgcgctcccccgacccggcgcgtctccctccgtcgcttgccactgcaaggccccgccccgggaccacgacgccgacctcctccgcgctctgcagtccaacggcaacggcaccctccacggagagccggtgccgccgcaggtcctcgattcgcgctccgacggaccgagcggcgacgggaggggcaagaggcctcgtatctgcgcctgcgactgcgcgaagcggatcatggagctgcccgtggaggagcgggtgaaggtgctcgacctcctgcagcgcgacgacgcggcgctcaccgtctccgactacaacgacatcctctccgcgctcgcgcgcgcgggcgaccacgcctcggccgtcgcgctgttccgcgccatgcccgtcgcacccgacgcccactccttcgacaccgccgtgcagtgcctctgccgccagggcgcgcccgacgaggccaagctcgcgctcgacgagatggtggcgcgcgggttccgccccagcgtggccgcgttctccgccgtcgtgggctgcctctgcaagcgcggccgcgtcaccaaggccatggaggtgctggacgcgatgcgcgcgctcggatgcgagcccaccatccgcacctacaacagcctcgtcggcgggctctgctacgtcggccggctcgaggaggcgctcgacctgctgaacaatctgaaggactcgcccaggacgccggacatctacaccttcaccatcgtgctcgacggcttctgcaaggtcgggcgggcggaggaggccacggccatcttccacgacgccatcgggatgggcctctcgccgacgatcttcacctacaacgcgctcctcaacggccactgcaaggagggggagccgctcagggcgttcgcgctgctcatggagatgtacggcgacgagcgcggctgcccgccggacaggatcagcttcggcatcgtgctgacggcgctgctgcgcgccggcgagaccgcggcggcgtggcagacgtacaagcggatggagcgcgccgggttcgaggcggacgggcgcgcgctggacacgctggcgcggggcctgtgccggcggtgcgcgacggacgtctcggcgctgggcgacgcccgggaggtgttcgcgaagctggtggcgtccgggcacgagccggtgtcgtacacgtactgcctgatggcgcaggcgctggcgcgcggcggcgaggtggacgcggccgtggcgctgctggaggagatggtgcgccgcgggtacgcgctgcggaagcgcgcctacacggacgtggtgcgcgcgctctgcgaccggggccgggcccgcgacgcgctgcgggtgctggtgctggtgatgatcgtgcgggacttcgtgccggggcggaacgcgttcgacgcgctgctgggcgagctcggccggcaggggcggtggaccgacgccatggccgtgtacgccgccgccgtgaagcgcggcgtggtggtctcgtggaagcacctcagcagggaggaggagcccgtccggctgggggtcctgcagtgaccgctgcccgaccgcttcacaggatcacaccatctctgccaccacgacgcgtgtccggattccgttgccgccgtcggctcccagatacatgactctccgacgaggaagaacgtactctccggcgtgcgtggattttggcgatttttttgagaggaacacaccaggaatgtaccgattttctgtaaatcatttttgctgcttgatcagattgacagggccggagcattcaatcg

SEQ ID NO: 25094 - protein, 549 aa, Panicum virgatum
  misc_feature: Ceres CLONE 1861998
  misc_feature (211)..(245): Pfam Name: PPR Pfam Description: PPR repeat
  misc_feature (281)..(315): Pfam Name: PPR Pfam Description: PPR repeat
  misc_feature (246)..(280): Pfam Name: PPR Pfam Description: PPR repeat
  misc_feature (428)..(462): Pfam Name: PPR Pfam Description: PPR repeat
  misc_feature (176)..(210): Pfam Name: PPR Pfam Description: PPR repeat
  misc_feature (316)..(350): Pfam Name: PPR Pfam Description: PPR repeat
MASLYHHSSFPLSPPQQLTAPEPTRAPPPSCRISTLPSSSHHGSALPRPGASPSVACHCKAPPRDHDADLLRALQSNGNGTLHGEPVPPQVLDSRSDGPSGDGRGKRPRICACDCAKRIMELPVEERVKVLDLLQRDDAALTVSDYNDILSALARAGDHASAVALFRAMPVAPDAHSFDTAVQCLCRQGAPDEAKLALDEMVARGFRPSVAAFSAVVGCLCKRGRVTKAMEVLDAMRALGCEPTIRTYNSLVGGLCYVGRLEEALDLLNNLKDSPRTPDIYTFTIVLDGFCKVGRAEEATAIFHDAIGMGLSPTIFTYNALLNGHCKEGEPLRAFALLMEMYGDERGCPPDRISFGIVLTALLRAGETAAAWQTYKRMERAGFEADGRALDTLARGLCRRCATDVSALGDAREVFAKLVASGHEPVSYTYCLMAQALARGGEVDAAVALLEEMVRRGYALRKRAYTDVVRALCDRGRARDALRVLVLVMIVRDFVPGRNAFDALLGELGRQGRWTDAMAVYAAAVKRGVVVSWKHLSREEEPVRLGVLQ

SEQ ID NO: 25095 - DNA, 274 bp, Panicum virgatum
  misc_feature: Ceres CLONE 1862009
  misc_feature: Encodes the peptide sequence at SEQ ID NO. 25096
cggcttaaatacccccatggagcaatacctgtggcctcagtgatgctgggggagtactgcccccagctctggctgccatgggacaccgggtcatgactatccctcctcgctatgatcaatacaaggatgcatgggatacagatgtccttgttgagcgaaatgtgggtgacacagtagagactgttcgcttcttccactgctacaaaagaggagttgatcgtatttttgttgatcaccctatgtttcttgaaaaggtatggggcacgactggtgc

SEQ ID NO: 25096 - protein, 65 aa, Panicum virgatum
  misc_feature: Ceres CLONE 1862009
  misc_feature: SWISSPROT Homolog: EC 2.4.1.242 NDP-glucose--starch glucosyltransferase
  misc_feature: The sequence is a functional homolog of SEQ ID NO 4 in US patent 7169982
MGHRVMTIPPRYDQYKDAWDTDVLVERNVGDTVETVRFFHCYKRGVDRIFVDHPMFLEKVWGTTG

SEQ ID NO: 25097 - DNA, 1826 bp, Panicum virgatum
  misc_feature: Ceres CLONE 1862013
  misc_feature: Encodes the peptide sequence at SEQ ID NO. 25098
gtatggaaaggcgatcgatctaggtcttgagcgccgccgccgcctctctgatggaaaccccaatctcctccgcgcctggagatgcgaattctcctagggctagcttcgccggcggcggccccagcgaaggcgacggatcaacggcgaatggtcggagctactacgacaagttcgggtatccggatgcagcttcccatttcgaggcaaaggatcaggagactctcaccaagtacatgattcatgtgtccccaatactgcagcccgtattggccaaggacagggtcgccaagttcgagaacctctgctgcggctggtcgcactttatgggccgccgcgatttcattttcccagatgtcctcatttccatcatctcccagaacgccgtgcgctgcgccaaggtggcgctgagcggcgatctgtacaacggacgccgagctgaccccaacgcccggcaccgctacgggttcacgcccctccacgcggccgctgagactttcagcgtcgatatggtcaagctcctccttcgccatggcgcgtcggcgaacatccgcacggagggagacaatgttattgaaggtctcctccctcttcatgtcgcagtagagaatgctggcatgcataagttcctggaggaccattgggaagatgggtgccctctcgagaaactcatctctctcctctgtctgcctgagatgaagatgtacttggacacgaccaggctgattgccaaacatacagataacattgttgatgaggtatggaattatataaatgggaggaagtttgtcgagttggcaattttgctgctggctgctcagaagcagcttcgtggccccgtaaatgggggcagaagcaaggcttctcgggatgggtttgatgttgttagacgtcgcacctatcaagctattggctccctacatcgtcaagcaacagctttggttaatgagggaaaaaatggcagtgtcctaaagaagctgaagaacaagaaggaagatcttattacagcaggaactctagttgatattgttgacaatgcaggtgaagctcttgagagctacattcagacttactcagaggtgacccatgaggagattattgaacatgtttcatcaattctaaacagcaatggcattgttcattctggaatgggcattgacactggaaacctcaaaggctaccaatatctttgggcaacagcgattcataaatcagtctcacgagtggatgctgaggaacctgacaaagctgaaaactcatcttctctgaatgctaaagttattaacagggtactgcctaaaggattggccctaagagacaagagaaacaagttcttcccatactggaaatcggtgttgtctgctcggctgatggtgaatatagttccaccttgtgaaccaagcatgaaggacaagaaggcaatgcaaggtactgaaccaggcaggaagggtgtccaggtcacaaacaaatcaagggggaattcgacctcagcgcctcagttggggagcagatatgaatgtagaaggcagctttgcactattgttttgaggtccctgaaggtgctcagatgcacttgaatagatatctgatgagagtgtgcctgttgaaataccattcctgggtactgcctgaatacctttttgcttaactttccattggtactgtagatatatttttcattttggctgaggttgtatcatctatgtgtagatctgaggaaagcagaagcatcggggacatgaaaatgttatttttatggcctgtacttgtgatttgaaacctcgatgtcactgtactatttggaatattactattcaaagttgaccttc

SEQ ID NO: 25098 - protein, 507 aa, Panicum virgatum
  misc_feature: Ceres CLONE 1862013
  misc_feature (137)..(169): Pfam Name: Ank Pfam Description: Ankyrin repeat
METPISSAPGDANSPRASFAGGGPSEGDGSTANGRSYYDKFGYPDAASHFEAKDQETLTKYMIHVSPILQPVLAKDRVAKFENLCCGWSHFMGRRDFIFPDVLISIISQNAVRCAKVALSGDLYNGRRADPNARHRYGFTPLHAAAETFSVDMVKLLLRHGASANIRTEGDNVIEGLLPLHVAVENAGMHKFLEDHWEDGCPLEKLISLLCLPEMKMYLDTTRLIAKHTDNIVDEVWNYINGRKFVELAILLLAAQKQLRGPVNGGRSKASRDGFDVVRRRTYQAIGSLHRQATALVNEGKNGSVLKKLKNKKEDLITAGTLVDIVDNAGEALESYIQTYSEVTHEEIIEHVSSILNSNGIVHSGMGIDTGNLKGYQYLWATAIHKSVSRVDAEEPDKAENSSSLNAKVINRVLPKGLALRDKRNKFFPYWKSVLSARLMVNIVPPCEPSMKDKKAMQGTEPGRKGVQVTNKSRGNSTSAPQLGSRYECRRQLCTIVLRSLKVLRCT

SEQ ID NO: 25099 - DNA, 919 bp, Panicum virgatum
  misc_feature: Ceres CLONE 1862043
  misc_feature: Encodes the peptide sequence at SEQ ID NO. 25100
cctgtgtgctcacccaatctcactcccgcccccctcagactcaacaacaactgaggcatttgattgttccgttccgtcgcgtcaccacccgccaactcaccctcctctgctcctgttccattccactaatcgagcggtccctgatggcggtgatgacggacacgcccgcggcgacggcgctgcgcgcgccggccccggccgccgccgccgtgcccagcgacaaggacgccgagaagctgcggttcatcgaggagatgacctccaacgtggacgccgtgcaggagcgcgtcctggccgagatcctcgccaggaacgccgggaccgagtacctggcgcgctgcgggctcgccggcgccaccgaccgcgccgcgttccgcgcccgggtgcccgtcgtcacctacgaggacctgcagccggacatccagcgcatcgccaacggcgaccgctcgcccatcctctccgcgcaccccatctccgagttcctcaccagctccggcacctcggccggcgagcgcaagctgatgcccaccatcagggaggagctcgaccggcgccagctgctctacagcctcctcatgccggtcatgaaccagtacgtgcccggcctcgacaagggcaaggcgctctacttcctgttcgtcaagtcggagacgacgacgcccggcgggctggcggcgcggcccgtgctgacgagctactacaagagcgagcacttcaggaaccgcccctacgacccgtaccacgactacacgagccccacggcggccatcctctgcgccgacgcgttccagagcatgtacgcgcagatggtctgcggcctctgccagcgccacgccgtgctccgcgtcggcgccgtgttcgcgtcaggcctcctccgcgccatccgcttcctgcagctccactgggagcagctcgccgc

SEQ ID NO: 25100 - protein, 258 aa, Panicum virgatum
  misc_feature: Ceres CLONE 1862043
  misc_feature (30)..(258): Pfam Name: GH3 Pfam Description: GH3 auxin-responsive promoter
  misc_feature: Useful for making plants with modulated biomass
  misc_feature: Useful for making plants with modulated light quality response
  misc_feature: Useful for making plants with modulated low light sensitivity
MAVMTDTPAATALRAPAPAAAAVPSDKDAEKLRFIEEMTSNVDAVQERVLAEILARNAGTEYLARCGLAGATDRAAFRARVPVVTYEDLQPDIQRIANGDRSPILSAHPISEFLTSSGTSAGERKLMPTIREELDRRQLLYSLLMPVMNQYVPGLDKGKALYFLFVKSETTTPGGLAARPVLTSYYKSEHFRNRPYDPYHDYTSPTAAILCADAFQSMYAQMVCGLCQRHAVLRVGAVFASGLLRAIRFLQLHWEQLA

SEQ ID NO: 25101 - DNA, 624 bp, Panicum virgatum
  misc_feature: Ceres CLONE 1862043-R
  misc_feature: Encodes the peptide sequence at SEQ ID NO. 25102
gccggcggcggtggacggggagacgctggagcggtgctgcctggagatggaggaggcgctcaactcggtgtaccggcagagccgcgtggcggacggcgccatcgggccgctggagatccgggtggtgcggccgggcacgttcgaggagctcatggactacgccatctcccggggggcctccatcaaccagtacaaggtgccccgctgcgtgtccttcccgcccatcgtcgagctgctcgactcccgggtcgtgtcgcgccacttcagccccgcgccgccgcactgggagccggcgccgccgcgccgctccgactagcggccccaccgcggtgcacgcagcgcgtcacgttcgccgtagtactagctagtatatttattagtggcttgtttttgcatttttttttcttggtcgtgtcgggccaggtagtgattttcagctcctgctgattaggccacagtatcgtgcttctgagttagaggtgtgtgtgtttgggtagtaagtagtgtacgtgccatgtaatgcgggtgggtgaagaaggctttccctgcaggtaggggctagctagctcgatcattagctagctagctgctgccgggtgctgttaattgctagtggtgcttatt

SEQ ID NO: 25102 - protein, 104 aa, Panicum virgatum
  misc_feature: Ceres CLONE 1862043-R
  misc_feature: Useful for making plants with modulated biomass
  misc_feature: Useful for making plants with modulated light quality response
  misc_feature: Useful for making plants with modulated low light sensitivity
PAAVDGETLERCCLEMEEALNSVYRQSRVADGAIGPLEIRVVRPGTFEELMDYAISRGASINQYKVPRCVSFPPIVELLDSRVVSRHFSPAPPHWEPAPPRRSD

SEQ ID NO: 25103 - DNA, 468 bp, Panicum virgatum
  misc_feature: Ceres CLONE 1862049
  misc_feature: Encodes the peptide sequence at SEQ ID NO. 25104
tgaagattcggaacttttgcctgccacggcatgccccctctttaatccttcaaggctctttgccacttgctctgacagagccagcacccctgatgctgactggccccagagacgacgaacccatggacggagatcggccaatatcggcggagagcaggtgaccaggtcagtgaatcgtcgtctccgagatcgcagactcggaaaagagcaagatgtcatacgggcagggagagaccggcagctcctggatgttcgccggggcggggaacgtccgcggcgaggcgccgccggatgatctagacctggaggattggctggactccagggccggctcccacgacatcaacgttctcgggttccaggagatggtgccgctaaatggcaggatcgtgctcggtcccaagcagagatcggcggccatgaagtgctagccgctgatcgtggacgcactgaacggccggaggagga

SEQ ID NO: 25104 - protein, 72 aa, Panicum virgatum
  misc_feature: Ceres CLONE 1862049
  misc_feature: SWISSPROT Homolog: EC 3.1.3.56 Inositol-polyphosphate 5-phosphatase
MSYGQGETGSSWMFAGAGNVRGEAPPDDLDLEDWLDSRAGSHDINVLGFQEMVPLNGRIVLGPKQRSAAMKC

SEQ ID NO: 25105 - DNA, 571 bp, Panicum virgatum
  misc_feature: Ceres CLONE 1862050
  misc_feature: Encodes the peptide sequence at SEQ ID NO. 25106
accatatccatcttcaattctccatccatcaagtgatgttcagcgcaaatcaccccgatgccgagcatggcggctccattgctctgcctggcgctgctcctggcgtccggcgccgccgccggcgcccaagctctcaaagactacccacaggtaaagttcagcaccgcgtcggccacgccggagaagtacaacacctttatcgccgctgtccgcgccgcgctggtgagcaaagctggggggaagagcaacgggatccccgtgctgttcgaccgggacgacctgctcgcgcttcaaacctacctgaacatcactctgacgaagtcggcggggcattcgatcaggctgaagatggatgtaaccggagcttacttcaccgcctacgtggcgtggaagcactcgtgcctgctcaaacgatccggccgggcattctcgtcaacgatctgctaacccgatgatccatgggcaagctcacctgccattgctgccgccctgcaatactccgccggcgtcgggagaggcggcgcgagtcggctatcctgctgctacccgccaggatcttgcagccgccgcg

SEQ ID NO: 25106 - protein, 129 aa, Panicum virgatum
  misc_feature: Ceres CLONE 1862050
  misc_feature: SWISSPROT Homolog: EC 3.2.2.22 rRNA N-glycosylase
MPSMAAPLLCLALLLASGAAAGAQALKDYPQVKFSTASATPEKYNTFIAAVRAALVSKAGGKSNGIPVLFDRDDLLALQTYLNITLTKSAGHSIRLKMDVTGAYFTAYVAWKHSCLLKRSGRAFSSTIC

SEQ ID NO: 25107 - DNA, 651 bp, Panicum virgatum
  misc_feature: Ceres CLONE 1862063
  misc_feature: Encodes the peptide sequence at SEQ ID NO. 25108
gtatgtagcattaatttgtagtgtgttgtgttttcagggtcagtttggttttcttccgagatgaaggcattgagcgatgattgtgaacgcttcataaccttcccacctggacacctgtactccagcaaaacaggtgctctaaggagatggtacaacccaccatggttttcagagagcattccctcaaccccgtacaatgctctcctcctccgagagatgtttgagaaggcatgttccttcctattgccgtgttctactttcatacctactgatacagtctatgcagtcatctttgttttcagtctttatttcattttcacatcttttgaattttgacgcctacagtaataatgcatttgatatttttatgtatgtcatattcattttcatgctaatctatcattaattttgttcctttgttttgacgcttatatgctaagcctctggttaggcagcgctcagttgcttatttgtatatcagttgattttgtatgtacaatgattaattccagtgtgatgtgtcgttctgtagtcaatgatggctcaatgtgttgttttatgcataaggactttagataagtgacatgttcatagtcatgttggttggttttaaattgttttgcttactaatatcatttactttatgtcatc

SEQ ID NO: 25108 - protein, 91 aa, Panicum virgatum
  misc_feature: Ceres CLONE 1862063
  misc_feature: SWISSPROT Homolog: EC 6.3.5.4 Asparagine synthase (glutamine-hydrolyzing)
MKALSDDCERFITFPPGHLYSSKTGALRRWYNPPWFSESIPSTPYNALLLREMFEKACSFLLPCSTFIPTDTVYAVIFVFSLYFIFTSFEF

SEQ ID NO: 25109 - DNA, 689 bp, Panicum virgatum
  misc_feature: Ceres CLONE 1862070
  misc_feature: Encodes the peptide sequence at SEQ ID NO. 25110
agtagtctactagtctcccgcagtcccgagccgcaaggtcgcgacagaagcgccacgcgccgccgccggcttcgccttcctgccgacgagccgccactcccccagcggcatctactcttcacctcgacttcgccttcgccttcctgctccggatttccagaaacatggaagaggaaggagaagctcaagaagggtcccaagggcgtctcttatcattgataaccaaggtaacagggtcaaggacaacaaagtttccagtacaagcaccaccagtgttatctccttcatcagtatacaattgcaaagcctttcttgaccatgatattgaaatgcgagatgaagaagaagaagaagatgctgactatgaagaagaggatgaagaagacgatagctctgatgaagaggaagaggaagaagaagatgagtaggaagaggatgaacaagtctattttgatggggaacaaggagttgacatgggctcattttctgagctagggagaaagtttctgtccaaagtatggaaagaatatgatcctatccgtgttgatggactcgtagtcgcagctaaatgcaaacattgtgcaaggaatatttgtgctgagcgcaaacatggaacaagctctctgcgtaagcacttgaagagatgcattgaaaggaagaaggctgttagagttgttggtaaattaatg

SEQ ID NO: 25110 - protein, 71 aa, Panicum virgatum
  misc_feature: Ceres CLONE 1862070
  misc_feature (13)..(59): Pfam Name: zf-BED Pfam Description: BED zinc finger
MGSFSELGRKFLSKVWKEYDPIRVDGLVVAAKCKHCARNICAERKHGTSSLRKHLKRCIERKKAVRVVGKL

SEQ ID NO: 25111 - DNA, 651 bp, Panicum virgatum
  misc_feature: Ceres CLONE 1862085
  misc_feature: Encodes the peptide sequence at SEQ ID NO. 25112
gcacccgcggctcacattatcctcaccctcagcggccgccgctcgcgcgcttaaaacccgcagccttccgcccgcgatagcctcgcggcgcgggcaggcgaggcgaggagagacgagagagagctcgaggcaaggaggtacgaacaaaagcaaccggaggcaatctccatggcagccgaggcgcccgtgcgagcccccgccgcggcgcggtccgcgcgccggccggccgccgccgtctccgcctcgtcggcctcgcgcgtcctcctcggccaccgccccttcctcgcgccgcgcttcgccgccgggcgcgccgcggtggccggccccgcggctgggctccgcccgcgcccgcgcaggccgcggctctcggtcgtcgccatggctgccagtgatcgccaggtgcctttgcaggattatcgcaatatcggtattatggcccatatagatgcaggaaagacgacaactacagaacgcattctgtattacactggaagaaactacaagattggcgaggttcatgagggaacggccacaatggactggatggaacaagaacaggagagaggaataaccattacatctgcagcaaccactgccttctggaacaaacataggaatcacattattgattactcctgggcatgttgactt

SEQ ID NO: 25112 - protein, 159 aa, Panicum virgatum
  misc_feature: Ceres CLONE 1862085
  misc_feature (81)..(158): Pfam Name: GTP_EFTU Pfam Description: Elongation factor Tu GTP binding domain
MAAEAPVRAPAAARSARRPAAAVSASSASRVLLGHRPFLAPRFAAGRAAVAGPAAGLRPRPRRPRLSVVAMAASDRQVPLQDYRNIGIMAHIDAGKTTTTERILYYTGRNYKIGEVHEGTATMDWMEQEQERGITITSAATTAFWNKHRNHIIDYSWAC

SEQ ID NO: 25113 - DNA, 707 bp, Panicum virgatum
  misc_feature: Ceres CLONE 1862089
  misc_feature: Encodes the peptide sequence at SEQ ID NO. 25114
aacccgacgaccactgctctgttctctgttctgttccaccccccggcgcgatgctgagaagcgccatggcatccgcgtccagcccaatctgctccctcctcctcctcgtcctcgtcctgctactgcctcattgtaccgccgctctctcgaagccgccagcgcggtaccagtaccacacgcttcgcgctatcccgctctctgccaagcccgccgcccgcgctggggtcgacgccggatccatcttcggcgccaacttcgccgctttcttcgacgacgccggcaacgcctccaccgtgcgattgctgctcgcccaccgcgaggcgttcgcggcgcccaacgccaccgcgccccagctgctcgcgcaccgcctggcgcgcgacgccgcgcgtgccgaggcgatttctgacgcggcggccggggccacggtgaacgggacgcacgcgccgcagcgccgaggtggcggcggcttcgcggcgcccgtagtgtccggcctgtcgcagggcagcggcgagtacttcgcgcaggtcggcgtgggcacgccgcccacgccggcgctcctggtgctggacaccggcagcgacgtcgtctggctgcagtgcgcgccctgccgccactgctacgcgcagtcgggcagggtcttcgacccgcggcgctcccgctcctacgccgtcgtcccctgcgccacgccgctctgccaccgcctcgac

SEQ ID NO: 25114 - protein, 213 aa, Panicum virgatum
  misc_feature: Ceres CLONE 1862089
  misc_feature: SWISSPROT Homolog: EC 3.4.23.12 Nepenthesin
MASASSPICSLLLLVLVLLLPHCTAALSKPPARYQYHTLRAIPLSAKPAARAGVDAGSIFGANFAAFFDDAGNASTVRLLLAHREAFAAPNATAPQLLAHRLARDAARAEAISDAAAGATVNGTHAPQRRGGGGFAAPVVSGLSQGSGEYFAQVGVGTPPTPALLVLDTGSDVVWLQCAPCRHCYAQSGRVFDPRRSRSYAVVPCATPLCHRL

SEQ ID NO: 25115 - DNA, 534 bp, Panicum virgatum
  misc_feature: Ceres CLONE 1862089-R
  misc_feature: Encodes the peptide sequence at SEQ ID NO. 25116
cggctcgcccgccccgtgtacgcggcggtgcgcggggcgttccggtccgcggcagcggccgcgggcgggctccggccgagccccggtgggttctcgctgttcgacacgtgcttcgacctgcgcgggcggcgggtggtgaaggtgccgacgctgtcgctgcacctggcgggcggcgcggaggtggcgctgccgccggagaactacctgatccccgtggacacgcggggcaccttctgcctcgcgctggcgggcaccgacggcggggtgtccgtcgtcggcaacatacagcagcaggggttccgcgtggtgttcgacggcgacaagcagcgcgtcggcctggtgcccaggagctgctaagccagtttcttttcgtagcagtttactgctagcataagcgtttccattttttgaaggactacaaaagagtgtcgagatggctggcggcacaaaaaatagtggccaaacgaaagcatcatctgatgtctgtctgtgttgttctaattctaatatgagttatctgcgatattttttccc

SEQ ID NO: 25116 - protein, 118 aa, Panicum virgatum
  misc_feature: Ceres CLONE 1862089-R
  misc_feature: SWISSPROT Homolog: EC 3.4.23.12 Nepenthesin
  misc_feature: Useful for making plants with modulated biomass
RLARPVYAAVRGAFRSAAAAAGGLRPSPGGFSLFDTCFDLRGRRVVKVPTLSLHLAGGAEVALPPENYLIPVDTRGTFCLALAGTDGGVSVVGNIQQQGFRVVFDGDKQRVGLVPRSC

SEQ ID NO: 25117 - DNA, 1781 bp, Panicum virgatum
  misc_feature: Ceres CLONE 1862105
  misc_feature: Encodes the peptide sequence at SEQ ID NO. 25118
acagcgacgtcgctgctctccagaaccctccgccgcggcgccacctcgcgaatccccccgagacccttcgcgcccctcggcctcgatccatccgcgggcgccccccgttcccagtcgaggccgtcctactccaccgcctcgggggatccgggccaggaacccccgccgggcatggactccccgatcaaggtggtctcccacctggggaacggcggaggagcgggatcgggagaggggggaggggcggcgatcgacgcggggaagtcggcgcggaggccgctcagcctgtggcccgggatgtaccactcgcccgtgaccaacgcgctgtgggaggcgcgctccagcatcttcgagcggatgatggacgcggggaacgccgccgacgccaccgacgcgggggagcagcgcgcgcccacggagctgctcgtcaagacgcccgcgcagagccggaccagcatcgtgtacaagttcgtcaccgacgacatcctccgggagcagtaccgggacccctggaacgaggtgcgcatcggaaagctgctcgaggacctcgacgccctcgccggcaccatcgccgtcaagcattgttctgatgaagatagcactacaagaccccttttggttgtgactgcttctgttgataaaatggagctaaaaaagcctattcgcgtggacactgatttaaagatagctggagctgttacttatgttggccgttcatcaattgatatacagattgaagtgactcaggttgatcaagatggtgataatcagtctgatccatttgcattgactgctaacttcacatttgttgcacgcgattctaagactggaaaatctgctccagtgaaccgtctttcacctgaaactgagagagagaagcaactatttagtgagagagatgcacgtgataagatgagaaaaaggaagagagaagaacagaagggagggcttgcgaatgggatacataagcttcgtgctgaggctgagaggctgaatgcattacttgcagagggtcgtgttttctctgatctgcctgctttagctgatagagatagcatcttgctgaaggatagccgcctggagaactctctcgtctgtcagcctcagcaacgaaatttgcatggaaggatatttggaggtttcttgatgcaccgagcttttgagcttgctttctcaactgcatatgcctttgttggacagagaccttgttttcttgaggttgatcatgttgacttcttaaaaccagtggatgtaggagattttcttcgattcaaatcatgtgtcttgtacacccagcttgacaatccagagcagcccctggtcaatgttgaagttgttgctcatgtaacaagacctgagctgcggaaaagtgagatctccaacacatttcacttcaccttcacggtctgtagcgacttgttgaaaaaaggattgaagattcgtaatgttgtcccctcgaccgaagaagaggcgcgtcgcatactagagcgcatggaggcagagggtttatgtaactagtctttctgtagagccacttgtttcagacgtttgctagttgttacttgataagttgatatctcaattgtcgtaccagctaacgggggatttggtgacgatttgaggagcagctatcagcagataagtagcatgccggcaatagaatggcatagctgtagtctgtagttccatggcaccatctgtgattttttttctttttataaacaattgtgattttttaaagagaccatacgtagtgcataataacatacacctcgagactc

SEQ ID NO: 25118 - protein, 505 aa, Panicum virgatum
  misc_feature: Ceres CLONE 1862105
  misc_feature: SWISSPROT Homolog: EC 3.1.2.2 Palmitoyl-CoA hydrolase
TATSLLSRTLRRGATSRIPPRPFAPLGLDPSAGAPRSQSRPSYSTASGDPGQEPPPGMDSPIKVVSHLGNGGGAGSGEGGGAAIDAGKSARRPLSLWPGMYHSPVTNALWEARSSIFERMMDAGNAADATDAGEQRAPTELLVKTPAQSRTSIVYKFVTDDILREQYRDPWNEVRIGKLLEDLDALAGTIAVKHCSDEDSTTRPLLVVTASVDKMELKKPIRVDTDLKIAGAVTYVGRSSIDIQIEVTQVDQDGDNQSDPFALTANFTFVARDSKTGKSAPVNRLSPETEREKQLFSERDARDKMRKRKREEQKGGLANGIHKLRAEAERLNALLAEGRVFSDLPALADRDSILLKDSRLENSLVCQPQQRNLHGRIFGGFLMHRAFELAFSTAYAFVGQRPCFLEVDHVDFLKPVDVGDFLRFKSCVLYTQLDNPEQPLVNVEVVAHVTRPELRKSEISNTFHFTFTVCSDLLKKGLKIRNVVPSTEEEARRILERMEAEGLCN

SEQ ID NO: 25119 - DNA, 2523 bp, Panicum virgatum
  misc_feature: Ceres CLONE 1862153
  misc_feature: Encodes the peptide sequence at SEQ ID NO. 25120
acggagtggacggacgccaccccccgctgccggcctcctcctcctggctcctccctcctctcctttcctccgccttctcttctcgccccccgtttccttccttgccgtgctcacccgcccacccgcgcatccccacatcaccccccccgcacagctcacgagcgtggcgttattgcgcgccgcctcgttgcgttagcttcggacgctttggcgtggggctacctgcgtaacggtcccggtgccgtgccgctcacgagggaggcactgactctagagagctcttctgcgtgctctggagagaggagggggggtcaggggggaggtgacaggcgaggggagccatggggatggacggcggcggcggcggcggcggcgggaagctgccgtacagctacgccggcgtcggccaccaggacggcaagctcgtcaagagcttcagccgcgtggagccgcgcaagttcgggatggggctcgtcgccggcttcctcctcgtcacctgcgcctacttctctaccgccaagttcgacgccatccacatcgccatggtcagccccatttccacggacgcggctgggattggctcgctggcgaccgccgccgccgacacctccaagcagcaattagatttgggcgtgcaggaccggaacgcgctgtcgaaggaggggagcagggccgaggtgctcgagaaagacgacggcaatgcttcctcctcgggaccagattccggccgcaatgcgccgctggaggacacgaggagagacgagacctttgtggggggcagcggtgacgcgggcgccggcgttgatgcgtcctccgcggcggccacgaatcctgccggcgagggtgaggttcctgccaaggacgatgatgccacggccgccgttcttcctcccgtgtcgttagaggaagccgcgaacggcacgcaagaatcaggtgttcttgaggacgcggagctgcaatttcaggaagctgttgctgagcttccatccaagaagagcaacgactccgccgccgccgccgctgcaagcggcaatggcagcaactcccccactgtggttcactctgatcctgctatcctccctgctccagttcagcagattcctcctgctattcaagaggtcaaggctcttgctgatcagcagattccagctgttccagaggttaagcaagcagattcggagacgccggcgcgggagtggaagccgctgtgcgacctcacgtcgaaccgccgcatcgactggtgcgagctcgacggcgacgtccgcgtgctcggcgccaacgccagcgtcaccctggtggcgccgcccgccgccgacgcccgcaccttccgggaggagtcgtggcgcatcaagccgtacccgcgcaaggccgacccgaacgccatgcgcaacgtccgcgtggtgacggtgcggtcggtgtccgccggtgcgccggcgtgcacggaccggcacgacgacgtgccggcgctggtgttctcggaccgcgggtacacgggcaactacttccacgcgtacacggacgtgatcctgccgctgttcctgacggcgcggcggtacgccggcgaggtgctgctgctggtgacggacctccagatgtggtgggtgggcaagttcctgcccgtgttcaagagcatctccaactacgagccggtcgacctggaccacgacccgcgcgtgcactgcttccggcacgtccaggtcgggctcaccaaccacgacgacttcagcatcgacccgcgccgcgcgcccaacggctactccatgctcgacttcaccaagttcatgcgcaccacctacgggctcccgcgcgacgtcgcctggcccgccgccgccaacgcgacggccggccggagccgcccccggctgctgctgatcgcgcgcgcgcggacgcggcggttcgtgaacacggatgagatcgtgcgcggcgcggagaaggtcgggttcgaggtggcggtgtcggagggggagcacgaggtggcgccgttcgcggagctggccaacagctgcgacgccatcatgggcgtgcacggcgcggggctgaccaacatggtgttcgtgccgacgggcggggtggtgatccaggtggtgccgctgggcgggctggagttcgtggccggctacttccggggcccctccagggacatgggcctgcgctacctcgagtaccggatcacgccggaggagagcacgctgatcgaccagtacccgcgcgaccacgtcatcttcaccgacccggagggcgtcaagaacaagggctgggagtccctcaaggacgcctacctcgacaagcaggacgtgcggctggacatgaggaggttccggccgacgctgaagaaggccatggcgcacctcaggaaggccaaagccgacgacgccaactaagctgccgtcgcagtgcatgtgttcatcaatcctctttgttctcttttcttcgttttggattatgtcggtgtacgtagcaaacagaaatcggccgaccaaggtgtatgatatggcaggagaaaaagaaatttagagcagcttg

SEQ ID NO: 25120 - protein, 679 aa, Panicum virgatum
  misc_feature: Ceres CLONE 1862153
  misc_feature: Useful for making plants with altered carbohydrate content
MGMDGGGGGGGGKLPYSYAGVGHQDGKLVKSFSRVEPRKFGMGLVAGFLLVTCAYFSTAKFDAIHIAMVSPISTDAAGIGSLATAAADTSKQQLDLGVQDRNALSKEGSRAEVLEKDDGNASSSGPDSGRNAPLEDTRRDETFVGGSGDAGAGVDASSAAATNPAGEGEVPAKDDDATAAVLPPVSLEEAANGTQESGVLEDAELQFQEAVAELPSKKSNDSAAAAAASGNGSNSPTVVHSDPAILPAPVQQIPPAIQEVKALADQQIPAVPEVKQADSETPAREWKPLCDLTSNRRIDWCELDGDVRVLGANASVTLVAPPAADARTFREESWRIKPYPRKADPNAMRNVRVVTVRSVSAGAPACTDRHDDVPALVFSDRGYTGNYFHAYTDVILPLFLTARRYAGEVLLLVTDLQMWWVGKFLPVFKSISNYEPVDLDHDPRVHCFRHVQVGLTNHDDFSIDPRRAPNGYSMLDFTKFMRTTYGLPRDVAWPAAANATAGRSRPRLLLIARARTRRFVNTDEIVRGAEKVGFEVAVSEGEHEVAPFAELANSCDAIMGVHGAGLTNMVFVPTGGVVIQVVPLGGLEFVAGYFRGPSRDMGLRYLEYRITPEESTLIDQYPRDHVIFTDPEGVKNKGWESLKDAYLDKQDVRLDMRRFRPTLKKAMAHLRKAKADDAN

SEQ ID NO: 25121 - DNA, 2050 bp, Panicum virgatum
  misc_feature: Ceres CLONE 1862157
  misc_feature: Encodes the peptide sequence at SEQ ID NO. 25122
aagctcgagctcctccccactgcgaaagtgtgtatccgcccaaaactctgcgctctctgccccctcctctctccgactctccccccgagatcccatccatgggggtctccgcggctcgcctccgggtctgagcccgtccagctaccacgggatcctcttctgacgcttccgctccgctgtccgacggccgcacggttctttgccgtccaagattcgccgctcagtttcttggggtcggtatagtgggtggtcggtagttgtccgtggccctgccatggattgttgaaagggtctttgatgccagcggtgggcacccgcactctgctgtagccgccgccgccatgtggaagcagtttcttggcaagatctcacagaagtcgcccaaatccggcagcggcggccgaggctcgccgccgcagaagtccccgccgtcgtgtggagccaatggggctgaagcggagctgagagcgtcgcctccgccgcaggcgtcggccgtcgccgtggcgcctgggtcggagaccagggaggacgtgttcctccgcaagctcaacatctgctgcgtggtgttcgacttcgccgccgagcgggggagggactcgccggagttggagaggaagcggcaggtgctcgtgtccctcgtcgactgcgtctccgtggccgaggagcccctcacggaggcaatgatctcggcctgcgtccgcatgttcgccatcaacctcttcagggtcttcccgcccaagctccactccggcggcgccactgatgaggacgagccattctttgacccctcctggtaccacctgcaggtcgtgtatgagctgctgctccggtttgtgatgtcaccggttgttgatgtgaaggtcgctaggaagtacatggacaactcattcatctctaggcttctggacctgttcgattctgatgaccctagggagagggaatgcttgaagacagtcttgcacaggatatacggaaaattcatgggcaataggccatttatccgcaaggcggtgagcaacatcttctacaggtttgtgtttgagacggatcattacaatgggattgctgagctgttggaggtgtttgggagcgtgattagtggtttcgcaaagccgctgaaggaggagcataagttgtttctgtggaaggcgttgattccgcttcacaagccaaagacagttggggtgtatttgccacagttgacatactgcattacacagtttattgagaaggaaccaaagctcacagggattgttattagaggcctcctgaagtactggccggtgacaaacagtcagaaggagatgatgttcttgggagagttggaggaggtgctggaattgacagaaatggctgatttccagaagtgtgccgttcccttgtttcgcaggattgcacaatgcctgaatagctctcattttcaggttgctgaaagggccttattcctgtggaataataaacatttgtttgacctgatttcccaaaaccgacaagttatcctgccaatcatatatcctgctctggaaaggaatgctcgttggcactggaatcagtcagttctaaatgtaacaatgaatgtgaggaaaatgttctttgacatggatgagagattgcttctgtcttgtgagaccaatttccaagaggaggaaaagaggcaagctgcatctgaggaacaaagaaggcttgtatgggagcgcctcgaaaggaatgccacatttcaatcattaaccggagacataggctttgcagtttctcctacatctgctcctctggtagctgctgctatgacatgaatagtgatggactcagatataattcataattcattctgcttgatgttagctagctatgggtatttggtgttgcgcaaggaattttgttgcctttgtaagacccttgtgccaaagtctgtaattaatagttgcttgtttgacaacaaatgattggtccttcggtgtactctcaagttatggacatatctgtctgtctcaagatattgtccagttctacttgactggtgggggtgtgaaagtgatttattttcttggcg

SEQ ID NO: 25122 - protein, 483 aa, Panicum virgatum
  misc_feature: Ceres CLONE 1862157
  misc_feature (48)..(458): Pfam Name: B56 Pfam Description: Protein phosphatase 2A regulatory B subunit (B56 family)
MWKQFLGKISQKSPKSGSGGRGSPPQKSPPSCGANGAEAELRASPPPQASAVAVAPGSETREDVFLRKLNICCVVFDFAAERGRDSPELERKRQVLVSLVDCVSVAEEPLTEAMISACVRMFAINLFRVFPPKLHSGGATDEDEPFFDPSWYHLQVVYELLLRFVMSPVVDVKVARKYMDNSFISRLLDLFDSDDPRERECLKTVLHRIYGKFMGNRPFIRKAVSNIFYRFVFETDHYNGIAELLEVFGSVISGFAKPLKEEHKLFLWKALIPLHKPKTVGVYLPQLTYCITQFIEKEPKLTGIVIRGLLKYWPVTNSQKEMMFLGELEEVLELTEMADFQKCAVPLFRRIAQCLNSSHFQVAERALFLWNNKHLFDLISQNRQVILPIIYPALERNARWHWNQSVLNVTMNVRKMFFDMDERLLLSCETNFQEEEKRQAASEEQRRLVWERLERNATFQSLTGDIGFAVSPTSAPLVAAAMT

SEQ ID NO: 25123 - DNA, 473 bp, Panicum virgatum
  misc_feature: Ceres CLONE 1862158
  misc_feature: Encodes the peptide sequence at SEQ ID NO. 25124
tgaagtaacaccattgacccagagcagtgccggcgctccaccatctcggctcctcttttattcgcagccatgtcgggcagcgcaaatggtgcctccgcaggcgctgctcacgtcgtgatgctcccgtggctcgccttcgggcacatcaccccgttcgagcagctggcacgcaaactggtctccgccgaccgcggcggcgtccgcgtgacgttcctgacggccgccgggaacgtgccgcgcgtcgaggccatgctggcgccgtcggccgcgggcgcggtggtggttgtgccgctccacctgccccacgtcccggggctggacgcgggggcctccagcgcggcgaagctctccgccgactgactcaagcttctcaaggtcgccctggacggcacccggccgcaggtcgcggcgctgctcaccgagctccgcgacggtcgccgtgatcatggacttcaccacgccgtgggtctacg

SEQ ID NO: 25124 - protein, 96 aa, Panicum virgatum
  misc_feature: Ceres CLONE 1862158
  misc_feature: SWISSPROT Homolog: EC 2.4.1.115 Anthocyanidin 3-O-glucosyltransferase
MSGSANGASAGAAHVVMLPWLAFGHITPFEQLARKLVSADRGGVRVTFLTAAGNVPRVEAMLAPSAAGAVVVVPLHLPHVPGLDAGASSAAKLSAD

SEQ ID NO: 25125 - DNA, 497 bp, Panicum virgatum
  misc_feature: Ceres CLONE 1862162
  misc_feature: Encodes the peptide sequence at SEQ ID NO. 25126
aaacaaaatagattagactcgtcgatccatccacgccgcgggacaggtcgtttgatcgatcgatctcgcgccggatttcccgtctccacgctcgctcgtggactcgtgaggaaggacgaagggcgcggcaatggcggggagggccaacgttccgaccaacagctctgctctgatcgccatcatcgccgatgaggacacggtgactggctttttgttggctggagtcggcaatgtagatctgaggaagaaaacaaattatcttattgttgataacagtaattccttgaacctgttaatatgcaaagtctttttggtcaatatctgctagtttgaacttgcctaacttttgacttcacatggtaatgctgttaactgtgaacaatggtcataagtatcatgtcccttgttccatattaatgatataaacttaaatgttcaaactgatgaatcttttgaaagctatgcaatattgtgcgctcacaagaatatggcatcta

SEQ ID NO: 25126 - protein, 65 aa, Panicum virgatum
  misc_feature: Ceres CLONE 1862162
  misc_feature: SWISSPROT Homolog: EC 3.6.3.14 H(+)-transporting two-sector ATPase
MAGRANVPTNSSALIAIIADEDTVTGFLLAGVGNVDLRKKTNYLIVDNSNSLNLLICKVFLVNIC

SEQ ID NO: 25127 - DNA, 1833 bp, Panicum virgatum
  misc_feature: Ceres CLONE 1862169
  misc_feature: Encodes the peptide sequence at SEQ ID NO. 25128
tcgatcgaatcggccggtctcctcctccactctccctccccaccgcacccgcggttagcacagcaccatcctctccacccaccaacccaccacgcactccaccacctcttctctcctctctctctctctctctctctctctctctctctcttcccccaccacgcttaggcttagcttacctccgatccgtctccattctccagcgagagctagctcgctgctcgatcggcccagatccacaaccaacagcgctgcaacaatgccgggtccggggagcgtgcccctggcgctgggcctggacacggcgggcgtgcaggtgccctggtacttccgctgccccatctccctggagctcatggccgaccccgtcaccgtgtccacgggccagacctacgaccgcgccagcatcgagtcctgggtcgccaccggcaacaccacctgccccgtcacccgcgccccgctcgccgacttcaccctcatccccaaccacaccctccgccgcctcatccaggagtggtgcgtcgcgcaccgctccatgggcgtcgagcgcatccccacgcccaagcagcccgccgacccggacctcatccgctccctcgtcgcccagggcccgggcctccccgcgctccgcaggctccgggcgctcgccagggagtccgacaagaacaggctcgtcatggccacgcgcgagaccagggccgcgctcctcgacgccgccttcgcctccggggccgccgacgagctccaggccgaggccatggccgtgctcgcgctcgtcggcctcggggaggccgaggccgccgaggtcgtggcccgggaggaccgggtcgccaggctcggcaagctcctcgccgccgccggcccgctcgaggccagggttaacgcgggcgccgtcgtcgaggccgccgcgtcggcgtcgggcgcggaggcccgggcggtgctcggcgccgccgagggggtcatggagggactggtggcgctggtggaggagaaggcccacgcgcgcgccgtccgcgtcgggatccggggcctcttcgcgctctgcctggccaaggagaaccggccccgcgcggtggccgccggcgccgcgtccgcgctcgcccggcgcgtggcggagggcggcgccgccggggagcccgagcgcgcgctggcggccgtggagcggctgtgccgcgccgagggcggccgcgacgccgtggtcgccggggccgggggcgggccggcggcggtggcggcgctggtgcgcgccatgtccgggcgcgcggcggagcacgcggcgggcgcgctggtgggcgtggtgggcgggtcggaggcgctgcaggtggaggcggtccgggcgggcgccatgagccagctgctgctcatggtgcagggcgggtgctcggagcgcgccaagcgcaaggcgcagcaccacctcaagctgctccgctccgcctggccgaccaccgactgcatcgccaactccgacgacttcctgcagccgtactgaccatcatcatcgctcgcccgcccatgtctcggtgggtggattccgttccccaagggcgaagtgaggaagatcactcactcactcgccagtcgccgcaaacgcaaggaaagggagaagctgccggcttgtatggcctggccgtgcgagcaacgcaacggccgcggcgtccggcacgccggcgccggcggcgtgtatgtaatgaatggtggaggaacgcggtagaatttttttccctaatgtttgtccagttttgtacgtacgtaatgttggcagggaggggaggaggatgggttcttggcccatgtttagttacaaaattcaaaattccaattttttttccggcg

SEQ ID NO: 25128 - protein, 409 aa, Panicum virgatum
  misc_feature: Ceres CLONE 1862169
  misc_feature (19)..(93): Pfam Name: U-box Pfam Description: U-box domain
MPGPGSVPLALGLDTAGVQVPWYFRCPISLELMADPVTVSTGQTYDRASIESWVATGNTTCPVTRAPLADFTLIPNHTLRRLIQEWCVAHRSMGVERIPTPKQPADPDLIRSLVAQGPGLPALRRLRALARESDKNRLVMATRETRAALLDAAFASGAADELQAEAMAVLALVGLGEAEAAEVVAREDRVARLGKLLAAAGPLEARVNAGAVVEAAASASGAEARAVLGAAEGVMEGLVALVEEKAHARAVRVGIRGLFALCLAKENRPRAVAAGAASALARRVAEGGAAGEPERALAAVERLCRAEGGRDAVVAGAGGGPAAVAALVRAMSGRAAEHAAGALVGVVGGSEALQVEAVRAGAMSQLLLMVQGGCSERAKRKAQHHLKLLRSAWPTTDCIANSDDFLQPY

SEQ ID NO: 25129 - DNA, 1124 bp, Panicum virgatum
  misc_feature: Ceres CLONE 1862182
  misc_feature: Encodes the peptide sequence at SEQ ID NO. 25130
atcatccgaattttcctttaggctccgcgtggagattgcgcaagcggagaccgggacggcaaggtaggaacacgagcaggagcatctcttctccggagcagagcagccggctcaatcactcaatggacggcggctccccgcggccgccccgccgcccggagcgggaggggagctacaactgcgacatcgagagcatggacggctccgtggccgggggcgggccgccgtggcggtcgcagaatggctccgccgaggccctgctccgctacgacgacggcggtgccggcgaccgcgggagcacgcgcgagccgctgctgcggaagcgcaccatgaacaccacgtcccagatcgccatcgtcggcgccaacgtctgccccatcgagagcttggattacgaagttgtggagaacgaccttttcaagcaagattggcgatcaagaaagaagaagcagatatttcagtacattgttctcaagtggagcttggtgcttcttattggcttgttaactggacttgttggcttcttcaacaaccttgcggttgaaaacattgctggactcaagttgctgcacacgagtcgtctgatgctcaaggagagatatttcmaagcattttttgtgtatggaggttgcaatttagtcttggcggcatctgcagcagcaatctgtgcttatgttgcacctgctgctgctggatccggtattcctgaagttaaagcatatcttaacggggttgatgcttattctatattggctcctagtacactctttgttaagatatttggttcaatacttggagtttcagctggatttgtactaggaaaggaaggccctatggtacacacaggagcatgtattgccaacttgcttggtcagggaggatcacgcaagtatcatcttacatgcaactggctaagatactttaagaacgacagggataggagagacttaattacatgtggatctgcagctggagtggcagctgccttccgtgcacctgttggcggtgttctgtttgctcttgaaaaagcagcatcatggtggcgaagtgcacatttgtggagaacattctttacaactgctgtcgttgctgtggtatttgaggggactgattgaattctgtcg

SEQ ID NO: 25130 - protein, 330 aa, Panicum virgatum
  misc_feature: Ceres CLONE 1862182
  misc_feature (173)..(330): Pfam Name: Voltage_CLC Pfam Description: Voltage gated chloride channel
  misc_feature (162)..(162): Xaa is any aa, unknown, or other
MDGGSPRPPRRPEREGSYNCDIESMDGSVAGGGPPWRSQNGSAEALLRYDDGGAGDRGSTREPLLRKRTMNTTSQIAIVGANVCPIESLDYEVVENDLFKQDWRSRKKKQIFQYIVLKWSLVLLIGLLTGLVGFFNNLAVENIAGLKLLHTSRLMLKERYFXAFFVYGGCNLVLAASAAAICAYVAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEKAASWWRSAHLWRTFFTTAVVAVVFEGTD

SEQ ID NO: 25131 - DNA, 486 bp, Panicum virgatum
  misc_feature: Ceres CLONE 1862192
  misc_feature: Encodes the peptide sequence at SEQ ID NO. 25132
atccgctcccccggacaccgcaccaacgggctcgctcgctccagcctccgccccctcgccgcacacctccgtaaaacccacccgattccgcctaaaccccccaccgcgatcctcgacaattcagcggccgcgatgcagggtctcgccccgcccacctctgtttccatacaccggcgcccgccggccgggtccagggcggaccggggccccagctcggtgaggttggcgccgcacgcggtcatctacgagctgcgggccgcgcccgacgggtgcctgccggacggggtcgtgtcggaccacgaggagaaggcgcccaacatcgtctaccgcgccacagtcttcaccgcccgcggcaccgtccccatcaagcgcttcaggcacaccgactggcctgactcccgccaggtcctggaggaggcgagggaagttgggcagctgggcattgggcggctggtcaacctgattggttgctgctgggagagcagg

SEQ ID NO: 25132 - protein, 117 aa, Panicum virgatum
  misc_feature: Ceres CLONE 1862192
  misc_feature: SWISSPROT Homolog: EC 1.13.11.51 9-cis-epoxycarotenoid dioxygenase
MQGLAPPTSVSIHRRPPAGSRADRGPSSVRLAPHAVIYELRAAPDGCLPDGVVSDHEEKAPNIVYRATVFTARGTVPIKRFRHTDWPDSRQVLEEAREVGQLGIGRLVNLIGCCWES

SEQ ID NO: 25133 - DNA, 1536 bp, Panicum virgatum
  misc_feature: Ceres CLONE 1862193
  misc_feature: Encodes the peptide sequence at SEQ ID NO. 25134
gaagaggatggcggcagcgccggagaaggtgttcgtcgccctgccggcagagttcaaggtggggcggtcctcgctatcgtgggttctcagccatttcggcggcagcggagccactatcgtgatcacacatgtgcatgttccgccgcagatgattccagtgatgggagtcaaatttcattctagtaaattgagcccggagcaagtgaaactattcagaaggattgagcgtgaaaaggtgaacaaacagctagacagctatgttcatcaatgctcgagaatgaaggtaaaatgtgagaaactagtttttgagaaggaagatgtagtagccggtctagttgaactcattgtcctgcatagagtcactaggctagttatttcagctgccgcagacagacaatactcaagaaaaatggacaaacctaagtctacgaaggcaacagaaatcatgcagagagctgatccagcatgcaagatttggtttatttgcaagggacgtctagtatgtaccaggggtaaggaagtggacacttcaccatcagctacacctttgctccctgattttgatcaccaaactctgcagttagtaccttaccagaaagagaacaacattcagtcagaattgggattatatgatgaactcaaggaggcatgcatagcagctgagaacttgatgaagagagctctaaacgaatcttccaggcgccaaaaggcagacgaggaagtggttttagctattcagaaagcaaatgaataccaggagttgtacttggaggaagcgagaaagcgccaagagcttgaagaagctctcgcaagagcaaaccgggaaatcgctcagttaagacaagcaaaccacctgcccgtggatgagcaaaacacatcccccgacgacctccaagaggcaatttcagaagaatcgacctttgaacggcacatcgtcgacatggatgccatcctcgcaacagctggtcaagtgactgagccgcagaaggagcatgtccacatacagattgatcttgacactggtggcaaagaactgcaggcgctgctcagccaatgcaagccgaccgcgttctcgtcaccgtcgtctgtcattcagtcaccgtacgacgaagactgcatcccttcctacttcctctgccccatcctccaggagcccatgagggaccctcacgtcgcggcggacgggtccacgtacgaggccgacgccatcagaggctggctcgacggcgggagcgacgcgtcccccgtgaccgggcagccgctcgcgcaccgcgagctcgcgccgaatttcgcgcttggcgccgtgatccaagactacacgatgaggcggcggcagcagcaccggttctcttgagatgccctgcttccgcttcagtttctgttttcctctccggtgaaccggcacttccagcttcagttttcgtggcgcagccctatcgcgggctcgtgtacttcactactttgacattttgtgtgtgtacgaggtgagctgttagtattacgatggaaatggaataactgattaagaggagcatt

SEQ ID NO: 25134 - protein, 448 aa, Panicum virgatum
  misc_feature: Ceres CLONE 1862193
  misc_feature (371)..(444): Pfam Name: U-box Pfam Description: U-box domain
MAAAPEKVFVALPAEFKVGRSSLSWVLSHFGGSGATIVITHVHVPPQMIPVMGVKFHSSKLSPEQVKLFRRIEREKVNKQLDSYVHQCSRMKVKCEKLVFEKEDVVAGLVELIVLHRVTRLVISAAADRQYSRKMDKPKSTKATEIMQRADPACKIWFICKGRLVCTRGKEVDTSPSATPLLPDFDHQTLQLVPYQKENNIQSELGLYDELKEACIAAENLMKRALNESSRRQKADEEVVLAIQKANEYQELYLEEARKRQELEEALARANREIAQLRQANHLPVDEQNTSPDDLQEAISEESTFERHIVDMDAILATAGQVTEPQKEHVHIQIDLDTGGKELQALLSQCKPTAFSSPSSVIQSPYDEDCIPSYFLCPILQEPMRDPHVAADGSTYEADAIRGWLDGGSDASPVTGQPLAHRELAPNFALGAVIQDYTMRRRQQHRFS

SEQ ID NO: 25135 - DNA, 603 bp, Panicum virgatum
  misc_feature: Ceres CLONE 1862224
  misc_feature: Encodes the peptide sequence at SEQ ID NO. 25136
gcgcccaccgaggacggccggcccccggccccaggccgacgccgcgtataaaagcgtccgccccgcgcggccggcggcgcgcgcttggactttggctcaagctgggcacgatggggaaggcgctcgggggcgctgctctcctcctccacctcctcgtcctgccggccgcgctcgcggaggcgctcacccgggacgacttccccccggggttcgtcttcggagtcggctcctccgcctaccaggttgaaggtgcagttgcaaaggatggaaggaagcctagcatctgggacacattcacccatggaggctattctattgacaatgcgacaggtgatgtaactgcagaccagtaccgcaagtacaaggaagatgtacaacttttgcatgagatgggtgtcgaagcatacaggatgtcaattgcctggcctcgacttattcctgatggtcggggagctgtcagtccgagaggactggagtactacaacgatctgatagaggaactccttagttacggaatacatcctcatgtaacgatctatccttgccattttcctcacgctcttcacgatgagtacaacggattgcttagtcctagattcatag

SEQ ID NO: 25136 - protein, 164 aa, Panicum virgatum
  misc_feature: Ceres CLONE 1862224
  misc_feature (26)..(164): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
MGKALGGAALLLHLLVLPAALAEALTRDDFPPGFVFGVGSSAYQVEGAVAKDGRKPSIWDTFTHGGYSIDNATGDVTADQYRKYKEDVQLLHEMGVEAYRMSIAWPRLIPDGRGAVSPRGLEYYNDLIEELLSYGIHPHVTIYPCHFPHALHDEYNGLLSPRFI

SEQ ID NO: 25137 - DNA, 2217 bp, Panicum virgatum
  misc_feature: Ceres CLONE 1862226
  misc_feature: Encodes the peptide sequence at SEQ ID NO. 25138
atgctccttcactccgccacaatccacaatggccgcctccaccaccaccaccactacggtcacggaaccggacaatgctgaaccgtccccgtcgtctccaccgctcaagaaggtcgcctacgagctcgccgccaggaacatctactacgccaagccggcgcccgcgccgaggtcgctcgcccggctcgtcgccaggccgtgcggcgcggctccggcgccgccggactacatcctccgcgacgtgtcgctcacggtgaaggccggcgagatcctggccgtcgtggggcccagcggcgccggcaagtccacgctgctcgacatcgtcgccgcgcgcaccgcgccgacgcacgggaggctgctgctcaactccgcgccgctccggccgtcgtccttccgccggctctcggcgcacgtgccgcaggcggacgtcgcgctcacgctgctcaccgtctccgagaccttcgccttctccgcgtcgctgctgcacccggagtcggcgcccgcggcgtcggccgcggtcgccgcgctcctcgcggacctccggctggcgcacgtcgcgcacacgcgggtctcccccgcgcgcttgtccggcggggagcggcggcgcgtgtccatcgggctcgccctcctgcgcaaccccggcgtgctcctcctcgacgagccgacctccggcctcgactcctcctcggcgcacgtggtcgtcagctgcctccgcgccgtcgcggccgcccggggcacgacggtggtgctcaccatccaccagccgagcgcgcgcctcctctccgcggtggattcgctcctcctcctctcgcgcggcaccgtcctgcaccacggctccctcgcctccctcgacgccgccctcctctcccatggcctcgtcgtcccggcgcagctcaaccctcttgagttcgccctggaggtcctcgaccagatccctcatccctccccctccacccctgagcccaagtcgacccatgaactcacttcgacgtcggaccaccgcaaggcggccgcggcgacgtcgtcgactgcctcgccgtcgtcgaggctgcacgagctggtggtgctgtacaagagggcgtggaaggtggtgttccgcagcaagcagctgctgctgaccaacttcctggaagcggtcctcgtgggcacgctgctggggaccatctacatccacgccggctacggcgaggccggcgcgcacaagcggctgggcctgttcgccttcacgctgaccttcctgctgacctcgacgacggagacgctgccgacgttcgtgtcggagcggccgatcgtgctcgcggagacggctgcggggctgtaccggctgtcgtcgcacgcggcggcggcgacgctggtgttcctcccgtacctcctggcggtggcgctgctctactccgcgtgcgtctacttcctggtggggctgtgcgcgtcggcgggcgcgttcgcggcgttcgtgctggtggtgtgggcggtggtgctgacggccaactcgttcgtgctgttcgtgagctcgttcgcgccggactacatcgcggggatgtcgctggtgtcggtgtccctggcggggttcttcctcttctccggctacttcctgccgcgcgggagcatgccgccctactgggtgttcatgcactacgcgtcgccgtacaagtacgcgctggacgcgctgctggcgaacgagtactcgtgcgcggcggaccggtgcttcggcgtcgggggcggcggcggcgagtgctcggagacggggcgcgacgtgctggcggagaaggggctcacggcggaggagcggtggaccggcgtgcaggtgctgttcggcttcttcctcctctaccgggtgctctactgggtggtgctcagccggcgagcggccagggctaagagatgatgtgatgatgaggaggattgggacatggccggctgcccggcgagctcggcagatcttgggaggaagcgcacgtctgtacgtgcgtgtgaacgggtgcatgcaaacaagcagcctagctagcaggtacgtcgaattggctgtcaacttgggagagagaaattaaagaggggggggggggggcagaagaggtgattattaaccggtaattacgctgtcatatactgatgtaaattgtgaagatacgactcctttataagtcataagtttgtgtgtgaattgtgatatgatgaaggatgaagttggatgggtgaataataacgcgtcgttaactt

SEQ ID NO: 25138 - protein, 618 aa, Panicum virgatum
  misc_feature: Ceres CLONE 1862226
  misc_feature (342)..(552): Pfam Name: ABC2_membrane Pfam Description: ABC-2 type transporter
  misc_feature (79)..(263): Pfam Name: ABC_tran Pfam Description: ABC transporter
  misc_feature: SWISSPROT Homolog: EC 3.6.3.36 Taurine-transporting ATPase
MAASTTTTTTVTEPDNAEPSPSSPPLKKVAYELAARNIYYAKPAPAPRSLARLVARPCGAAPAPPDYILRDVSLTVKAGEILAVVGPSGAGKSTLLDIVAARTAPTHGRLLLNSAPLRPSSFRRLSAHVPQADVALTLLTVSETFAFSASLLHPESAPAASAAVAALLADLRLAHVAHTRVSPARLSGGERRRVSIGLALLRNPGVLLLDEPTSGLDSSSAHVVVSCLRAVAAARGTTVVLTIHQPSARLLSAVDSLLLLSRGTVLHHGSLASLDAALLSHGLVVPAQLNPLEFALEVLDQIPHPSPSTPEPKSTHELTSTSDHRKAAAATSSTASPSSRLHELVVLYKRAWKVVFRSKQLLLTNFLEAVLVGTLLGTIYIHAGYGEAGAHKRLGLFAFTLTFLLTSTTETLPTFVSERPIVLAETAAGLYRLSSHAAAATLVFLPYLLAVALLYSACVYFLVGLCASAGAFAAFVLVVWAVVLTANSFVLFVSSFAPDYIAGMSLVSVSLAGFFLFSGYFLPRGSMPPYWVFMHYASPYKYALDALLANEYSCAADRCFGVGGGGGECSETGRDVLAEKGLTAEERWTGVQVLFGFFLLYRVLYWVVLSRRAARAKR

SEQ ID NO: 25139 - DNA, 734 bp, Panicum virgatum
  misc_feature: Ceres CLONE 1862230
  misc_feature: Encodes the peptide sequence at SEQ ID NO. 25140
gccccctcctcccccgcctaccctgcgtgacgtaacctagccgcgccgcgccgcgcctcctccggtcggacgcctcgcgccgccgctcgaatccatggacgccgaggccggcgtcgtcggcgccgaccagctgccgcggaggcagtactacatgaatttattactcttagcttaccagagctttggcgttgtttatgaggaccttagcacatcacctctctacgtttataaaagtacattcgctggaaagctccgtcaataccaagatgaggagacagtattcggtgtgctttccctcatcttttggacattcactcttattcctttgctcaagtatgtcactattgtcttgagtgctgatgataatggcgaaggtggaccgtttgcattgtattcgctcctttgtaggcatgcaaaacttagcttgcttccaaatcaacaagcagctgatgaggaactatcgacatactacagaaatgggtttgcccctcgcaatggatctgcgccttggctaagaaggtttctagagaagcacaaaaaaatgcgaaccgtgcttcttctcatagttctgtgtggcgctagcatggtgattggtgatggtatccttaccccagcaatctcagttctgtcatctatgtctggattgcaagttcgagctactggtttagagcatcgttctgtagttctcctttcgtgcattgtattggttggtctatttgcctttgcacatcgag

SEQ ID NO: 25140 - protein, 213 aa, Panicum virgatum
  misc_feature: Ceres CLONE 1862230
  misc_feature (24)..(213): Pfam Name: K_trans Pfam Description: K+ potassium transporter
  misc_feature: Useful for making plants with modulated biomass
MDAEAGVVGADQLPRRQYYMNLLLLAYQSFGVVYEDLSTSPLYVYKSTFAGKLRQYQDEETVFGVLSLIFWTFTLIPLLKYVTIVLSADDNGEGGPFALYSLLCRHAKLSLLPNQQAADEELSTYYRNGFAPRNGSAPWLRRFLEKHKKMRTVLLLIVLCGASMVIGDGILTPAISVLSSMSGLQVRATGLEHRSVVLLSCIVLVGLFAFAHR

SEQ ID NO: 25141 - DNA, 1930 bp, Panicum virgatum
  misc_feature: Ceres CLONE 1862236
  misc_feature: Encodes the peptide sequence at SEQ ID NO. 25142
acacatcgatcaactgctcagcagcactcacaactcactcagagctcatgaacaagatgaagatgatcatcgtcttgttcaacatggtcatgatcaccaccgcggccgccttggcgttgccgcttcagcgattccaccacgggcaccttggccggcatgggcatcggcattcctctcccccttcccctcccccgcccccgccgactcccgcacaaccgcaatgcggctgttgcgagctgtgtctgctggggcctcaccgggagttcttgccggctcccggagccggagggtcgacgacgacggcgccggccaactgcgtcacttcactgtccgtcctgtcgagctgcagcggtttcctcacagacgtcgctcagccagctccaacgccgcacagcccatgctgccgcggcctggcgcagttcctggacggcgcaacagcggcggcaggaccctgcggtgcatgtgcccgctcatcactggcggggcactgaatgcaatgctgcccaagccagttgatcccatccggatgattacttatctgcccatcgcctgcggcgtcgtgcttcctcgagacctgatcccgctctgcctcaacaacgccacaacctcgtcggtcaagggggtgaattgaccgtcgtcgacacatactaactaggacgacgaaagcaaagcaagctgctgctgctactactacctactactactactacatactacacaaggaagtctacaacgaactcgatccctcctcatcaacatgttaactcgatcgtactacatattacatcgagctggttatggtcttacaggaatataaccttgtatttgtttatgctccatcaatagaaacgtactccttgatatgtttgactttttttttctgttactcttggctggtgaaccctaagcgtgcgtggcacggcaggactccaaatccaatccaatccggcacgcatcgccaacccagccaagctgacagggattgaatattcgtagcaagcagcctccggcccccgcccctttttagttcctttgctgctcctcgatttgattgcttgcgttcatcctcgacctcgattgattcctccctgaggcgaaggcaggcaggcaggctggtcaccatgggatctaaggcacctttcttcctcttgctcctcttgctgctcgtcgcccgggcacctgcacaagccagggatcctgctgtgtgttgaattgatggactcctatgcaactctgctgtttgccaagatttcggagatcaagccagaagagttctgcaaacagtatggcctgtgcagggataccacctttttctctggtgtgggtagtgacagcacttgtgtgttttgccaccaccttcttgatgaaattatgtccaaactgaaagatccagatgcggagtttgagataattcaaattctcatcaaggagtgcaacaagatcgaaggtcatgtccagcagtgcaagagattggtcctgcaatacattcccctgatcatggtaaatggcgagaagttccttgagaagaatgatgtgtgcgcactcgtacaagcgtgtccagctagtcaaaagactacaatcagctcattcttggacgatggattggtgagcgatgcatgaagattggaagattacaaaaatcgccgtggattggtgagtgatgcatgaagattggaagattacaaaaagcgcacggcgatggtgaaaatagtattattccttgtacataaggcgataaaccaagggcttctgtattgtgcccatgtacttatattgtggatgcaattgttttacgatacaacaacaacatagccttttgtcccaagcaagttgggataggctaaattgttttaagatagcaatctgttaataatctgttaatattctgggagctgaaagaaatatcatgtgctaggctacggatgctgtc

SEQ ID NO: 25142 - protein, 134 aa, Panicum virgatum
  misc_feature: Ceres CLONE 1862236
  misc_feature (80)..(114): Pfam Name: SapB_2 Pfam Description: Saposin-like type B, region 2
  misc_feature (39)..(77): Pfam Name: SapB_1 Pfam Description: Saposin-like type B, region 1
MDSYATLLFAKISEIKPEEFCKQYGLCRDTTFFSGVGSDSTCVFCHHLLDEIMSKLKDPDAEFEIIQILIKECNKIEGHVQQCKRLVLQYIPLIMVNGEKFLEKNDVCALVQACPASQKTTISSFLDDGLVSDA

SEQ ID NO: 25143 - DNA, 611 bp, Panicum virgatum
  misc_feature: Ceres CLONE 1862238
  misc_feature: Encodes the peptide sequence at SEQ ID NO. 25144
ccatatactaagtcagtttgtctctgctcccactcaactccactatacccaccttctccgtgttcttcggtatcttcgcggcaccatttctcgacggttattcttccctcgctctagccctctccaccttcaggcgtactctgatgcgacctgggctagtgaccactctgatcgtcgttctctctctgcctattgtgtctttcttggatcctccttgattgcttggaaaaccaagaagcagacagcaatttcccgttcgagtgctaaggctgagttgagagctatggcggctgtgacagctgagatcacttggctccgatggctccttgaggattttggtgtgacagttttcacaccaactcctctatcttctgacagcactggtgcgatcagcattgctcgtgatccggtcaagcatgaacttaccaagcacatcggggttgatgcttcctacgtgcgatcgcaagtccatgatgcgattgtcgcccttcgctatgtcccttcagagttccagttggcagatttcttcacgaaggctcaaacaagggcgcaacatgattacttcctctccaaactcagtgttgtagaccctccatgagtttgagtggggg

SEQ ID NO: 25144 - protein, 198 aa, Panicum virgatum
  misc_feature: Ceres CLONE 1862238
  misc_feature: SWISSPROT Homolog: EC 2.7.7.49 RNA-directed DNA polymerase
HILSQFVSAPTQLHYTHLLRVLRYLRGTISRRLFFPRSSPLHLQAYSDATWASDHSDRRSLSAYCVFLGSSLIAWKTKKQTAISRSSAKAELRAMAAVTAEITWLRWLLEDFGVTVFTPTPLSSDSTGAISIARDPVKHELTKHIGVDASYVRSQVHDAIVALRYVPSEFQLADFFTKAQTRAQHDYFLSKLSVVDPP

SEQ ID NO: 25145 - DNA, 1212 bp, Panicum virgatum
  misc_feature: Ceres CLONE 1862241
  misc_feature: Encodes the peptide sequence at SEQ ID NO. 25146
cttatcccccgtcttttttatccgcttctgcggctgctcccacccttccccttctctctttcgctcgctctcgtcagacgccgctgtccctagcttgcttccatcacaagcactcgggcggagcgaaccagccggcgacgaccggtggttgccgccgcggccatcgccgccaccccgcgccttttatgctcgcggctgctcggttcgtgggctccggtagtgcgctgcgatcctctcggccacggacctttctgcgggagcgaagattccggtatggaggtggaggcgacgcccacggcggccgtgtcgtcttccggcggggccgcgcagctgccgccgcccggcccgcccgccaagaagaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagctccaccgccggggccacaacctaccgtggaagctccggcagcggagcggcaaggagccccggaagcgggtgtacgtgtgcccggaacccagctgcgttcaccacgacccgtcgcgcgcgctcggcgacctcaccggcatcaagaagcacttctgccgcaagcacggcgagaagaagtggaagtgcgacaagtgctccaagaagtacgccgtgcagtcggactggaaggcgcacgtcaagacctgcggctcccgggagtaccgctgcgactgcggcaccctcttctccaggagggacagcttcatcactcaccgcgccttctgcgacgcgctcgccgaggagagcgccaaggcgcgcgcggaggcgcctcccgccgaggacgacgggggctcggctgccgccgtcggtccgccaccggccgccccgccaactcaggcgccagtacctgccgcgccggggccgctgaggcagcaaccgcccccgccgccgcctgctcctcctcaccgtgcggaccaacgtaatgagccggagaccaaggcgcctgagcccactcagtttgcgccgccgctgccctctccggcggcggcggtgccggtgctttcgcataattcggtcacagctgcgaatgtcagcgccagcagcagcagcagcgtcgcggggacatcgcagggcctgatcggcggcatgttcgcaccgtcgtcgatggccccagcgccccat

SEQ ID NO: 25146 - protein, 312 aa, Panicum virgatum
  misc_feature: Ceres CLONE 1862241
  misc_feature (57)..(79): Pfam Name: zf-C2H2 Pfam Description: Zinc finger, C2H2 type
  misc_feature: Useful for making plants with modulated biomass
  misc_feature: The sequence is a functional homolog of SEQ ID NO 214 in the 10/225,066 US patent application
  misc_feature: The sequence is a functional homolog of SEQ ID NO 2450 in the 10/374,780 US patent application
  misc_feature: The sequence is a functional homolog of SEQ ID NO 604 in the 10/412,699 US patent application
  misc_feature: Useful for making plants with altered lignin content
  misc_feature: The sequence is a functional homolog of SEQ ID NO 960 in the 11/435,388 US patent application
MEVEATPTAAVSSSGGAAQLPPPGPPAKKKRALPGMPDPDAEVIALSPKTLLATNRFVCEICNKGFQRDQNLQLHRRGHNLPWKLRQRSGKEPRKRVYVCPEPSCVHHDPSRALGDLTGIKKHFCRKHGEKKWKCDKCSKKYAVQSDWKAHVKTCGSREYRCDCGTLFSRRDSFITHRAFCDALAEESAKARAEAPPAEDDGGSAAAVGPPPAAPPTQAPVPAAPGPLRQQPPPPPPAPPHRADQRNEPETKAPEPTQFAPPLPSPAAAVPVLSHNSVTAANVSASSSSSVAGTSQGLIGGMFAPSSMAPAP

SEQ ID NO: 25147 - DNA, 678 bp, Panicum virgatum
  misc_feature: Ceres CLONE 1862241-R
cctccgagggctgggcctcgacgcatcctcgtcatcgccgggggcctcgtcgtccggccagcagcactaccacgacgccatgcaagtgtcgctcgcggagacgtcgctgcagcaatggcccccgcggctggaacaggagccggcgccggtgctgtcggccgggctcggcctcagcctgccgtacgactccaccggcgcgccggtgtgcctgccggagctcatgatgggccagacgtcgctgttcggcggcaagccggctaccctggacttcctggggctaggggtgagcccaaccggcgcgtcggcaagcagagggctccccgcgttcatgcagcccatcggcggcgccgtcgagatagccggtaccggcgccggcgccgccgagacgttcgtcgccggccgtggcccgcaggcgacgccgtgggagaggaatccgagcacctcgcccatcctgtagcaacactagctagcaggtagtgaaccactgaaccccaacccccaagcgctgtgattttgggcaaaaggatggaaggattgtcggaggaaacaaacagtagacgccaggttcgattagcagctagagtttcccgctgtctgttctcgctgttcttttgtttttttagatttgggagcatgttacagcaagtaagctgaaagggatcatatcagttctttcag

SEQ ID NO: 25148 - DNA, 336 bp, Panicum virgatum
  misc_feature: Ceres CLONE 1862258
  misc_feature: Encodes the peptide sequence at SEQ ID NO. 25149
gtgctctctccgaggtgggttggcttctcctccccctccacgttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctccagtccaagatcatcctcgatcgggagacccacaggtcccgcggcttccgcttcgtcaccttctcgagcgagcaggcgatgcgcgacgccatcgaggggatgaacatcgggggggctctggccgccgcga

SEQ ID NO: 25149 - protein, 78 aa, Panicum virgatum
  misc_feature: Ceres CLONE 1862258
  misc_feature (10)..(78): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLQSKIILDRETHRSRGFRFVTFSSEQAMRDAIEGMNIGGALAAA

SEQ ID NO: 25150 - DNA, 1703 bp, Panicum virgatum
  misc_feature: Ceres CLONE 1862278
  misc_feature: Encodes the peptide sequence at SEQ ID NO. 25151
aattgccatctgtttctgaaccatggatccatttcttctctccatcctcttgtgcttatggatctttattgtagtgtattggagaaggatgaacagcatgaggctaaggcttccacctggacctccaacatggccaatctttggtaaccttctccagttgagccctcttccacacaaagactttgctcgattctgcaccaaatatggcccccttgtctatctccgcctaggaaccatcgatgccatcaccaccgatgatcctgaagtcatccgtgaaatactcatccggcaagatgaggtctttgcttcacggcctcggacactggctgctgtccatcttgcctatgggtgcggcgatgtggcactagctccactggggccaaactggaaaaggatgaggagagtttgcatggagcacttgctgacaaccaggcggctcgagtccttcgctgcgcaccgagctcaggaggctgagcacctctgtcagtttgtatgggctaaagctcagtccgggaagcccgtgaacctcagagaggttcttggtgccttctctatgaacaacgtcacgaggatgctgctggggaagcagtactttgggatccagtctgcaggacccggtgaagcgatggagttcatgcacatcacccatgagctgttcttcctgctgggcctgatctatctcggggactacttgccggcctggaggtgggtcgacccgtacgggtgtgagaagaagatgagggaggtcgagaagaaggtggacgatttccaccagaagataattgatgagcacaggagggctcgggaggccaagaagagtgctgcctcctcttatgacgatgataccaaagaagagatggacttcgtcgatgtgctgctgtctttgcctggtgagaacgggaaggagcacatggacgatgtcgagatcaaagctttgatgcaggacatgatcgctgctgctacggacacttcatcagtgaccaacgagtgggtgatggcggaggtgatcaagaacccgcgcgtgctccggcgtatccaggaggagctggacgcggtggtcggccgcgaccggatggtggcggagtcggacctcccctacctccactacctccggtgcgtggtccgcgagtccttccggatgcacccggcggggccgttcctgatcccgcacgagtccctgaagccgacgacgatcatggggtaccccatcccggcgcgcacgcgcgtgttcatcaatacgcacgcgctgggccggaacccgcgcgtgtgggacgccgttggcgagttccggccggagcggctcctgccggcggaggcgggcgcccgggtggagatcagccacctgccggacttcaagatcctgcccttcagcgccgggaagcgcaagtgccccggcgcgccgctgggcgcggcgctggtgctcatggcgctcgccaggctcttccactgcttcgactggtccccgcccgacggcctccgccccgaggacatcgacactcgggaggtgtacggaatgaccatgcccaaggcggcgccgctcgtcgccgtcgccacgccgcgcctgccgccgcacatgtacgccgcggccgcctctgtagtctgacgctagctagcaagctcctcgcactccaggtcaatgtaagccaagccatggctaatggtaacggagaactgatcctatacacgcacataaacaaacgatg

SEQ ID NO: 25151 - protein, 526 aa, Panicum virgatum
  misc_feature: Ceres CLONE 1862278
  misc_feature (31)..(507): Pfam Name: p450 Pfam Description: Cytochrome P450
  misc_feature: SWISSPROT Homolog: EC 1.14.13.21 Flavonoid 3'-monooxygenase
MDPFLLSILLCLWIFIVVYWRRMNSMRLRLPPGPPTWPIFGNLLQLSPLPHKDFARFCTKYGPLVYLRLGTIDAITTDDPEVIREILIRQDEVFASRPRTLAAVHLAYGCGDVALAPLGPNWKRMRRVCMEHLLTTRRLESFAAHRAQEAEHLCQFVWAKAQSGKPVNLREVLGAFSMNNVTRMLLGKQYFGIQSAGPGEAMEFMHITHELFFLLGLIYLGDYLPAWRWVDPYGCEKKMREVEKKVDDFHQKIIDEHRRAREAKKSAASSYDDDTKEEMDFVDVLLSLPGENGKEHMDDVEIKALMQDMIAAATDTSSVTNEWVMAEVIKNPRVLRRIQEELDAVVGRDRMVAESDLPYLHYLRCVVRESFRMHPAGPFLIPHESLKPTTIMGYPIPARTRVFINTHALGRNPRVWDAVGEFRPERLLPAEAGARVEISHLPDFKILPFSAGKRKCPGAPLGAALVLMALARLFHCFDWSPPDGLRPEDIDTREVYGMTMPKAAPLVAVATPRLPPHMYAAAASVV

SEQ ID NO: 25152 - DNA, 2082 bp, Panicum virgatum
  misc_feature: Ceres CLONE 1862286
  misc_feature: Encodes the peptide sequence at SEQ ID NO. 25153
gtcgccctctccctctccccgtcggcggaccactggtttggaaaccctcgcattccagaagcatatgccgctggcgccctagaccctctagattcatttgccacgataattaggagcgagcagcggaggagggggcactcgccatccgccgatccaccgaggagagaagaggaggaagggggaagaggggacccgccgtctccgagcacccgcacgcgtcgcctccccccggatctgacccggagcgccggcgagcgaggatgcattcgacgaacctgctgctcgaggagcccatccggatggcctccatcctggagccatccaagacgagcttcttccccgcgatgacgaagatcgtcgggacgctggggcccaagtcgcgttccgtcgacaccatctccgcctgcctcaaggccggcatgtctgttgcgcggttcgatttctcgtggggggacgccgcataccaccaggagacgctcgagaacctcaagctcgccatcaagtccaccaagaagctatgcgccgtcatgctcgataccgttggcccggagctgcaggtggtgaacaagagcgagaccacgctttcccttgaggagaacgggactgttgttctcacgcctcatcacggccaagaagcctcctccagcttgctgcccatcaacttctctgggctcgccaaggctgtgacaccaggtgcaacaatatttgtggggcaatacttgttcaccggcagtgagactacttcagtttggttagaggtttctgaagttaaaggagatgatgtggtttgtataatcaagaacacagctaccttggctgggtcactgttcacactacattgctcccagattcatattgacttacccacgctgtctgatgaggataaggatgttatcagaaaatggggtgctccaaataagattgacttcctctctttgtcttacacaaggcatgcagaagatgtgcggcaggcacgggatttcctctcgaaattgggtgatcttagccagactcagatctttgccaaaattgagaatgttgagggcctgaatcattttgacgaaatactggctgaggcggatggtatcattctatcaagaggaaaccttggaattgatcttccaccagagaaggtctttttgtttcaaaagtctgctctgcacaagtgcaacatggctggaaagcctgctgttgtcactcgtgttgtggatagtatgaccgacaacctcaggcctactcgtgcagaggcaactgacgttgcaaatgctgttcttgatgggagtgatgccattctccttggtgctgagactctccgtggtttatatccagttgagactatttcaacagtgggaagaatttgtgctgaggctgagaaagtctttaatcaagatttatactacaagcgaactgtgaaatatgttggggagcctatgacccacttggagtccattgcttcttctgcggtacgggctgctatcaaagttaaagcatctgtcatcatttgcttcacctcttctggacgtgctgcaaggttaatctccaagtacaggccctccatgcctgttctatctgtggtcattccccgtctaaagacaaaccaactgaggtggagtttcactggtgcatttgaagcaagacaatcactcatagttagagatctctttccaatgcttgccgatccacgccatccagctgaatctaccagtgctacaaatgagtcagttctaaaggttgctcttgaccacggcaaagcttctggtgtaatcaagtcccatgatcgtgttgtggtttgccagaagatgggagattcgtcggttgtgaagattatagagctggacgattagacaagcagcctatgtgcctatgcttgtctactaagggcatgttttactgatttttgagtgggcctaaacttgttggcttttgtataatcctatagctttgcaaaatgagcagtttttcctatggtgtcatcataggatttgctttgcaatttaaaactcgtgcagtttggaagttgtcggattattataccacctaaatggcagatggaataatgaaatcatactgtactttagttgg

SEQ ID NO: 25153 - protein, 527 aa, Panicum virgatum
  misc_feature: Ceres CLONE 1862286
  misc_feature (30)..(379): Pfam Name: PK Pfam Description: Pyruvate kinase, barrel domain
  misc_feature (394)..(524): Pfam Name: PK_C Pfam Description: Pyruvate kinase, alpha/beta domain
  misc_feature: SWISSPROT Homolog: EC 2.7.1.40 Pyruvate kinase
MHSTNLLLEEPIRMASILEPSKTSFFPAMTKIVGTLGPKSRSVDTISACLKAGMSVARFDFSWGDAAYHQETLENLKLAIKSTKKLCAVMLDTVGPELQVVNKSETTLSLEENGTVVLTPHHGQEASSSLLPINFSGLAKAVTPGATIFVGQYLFTGSETTSVWLEVSEVKGDDVVCIIKNTATLAGSLFTLHCSQIHIDLPTLSDEDKDVIRKWGAPNKIDFLSLSYTRHAEDVRQARDFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLISKYRPSMPVLSVVIPRLKTNQLRWSFTGAFEARQSLIVRDLFPMLADPRHPAESTSATNESVLKVALDHGKASGVIKSHDRVVVCQKMGDSSVVKIIELDD

SEQ ID NO: 25154 - DNA, 1558 bp, Panicum virgatum
  misc_feature: Ceres CLONE 1862353
  misc_feature: Encodes the peptide sequence at SEQ ID NO. 25155
  misc_feature (589)..(589): n is a, c, t, g, unknown, or other
gtggcctctcccccctctcctatccgtcctctgctcctgcccttctgcggttcaccaaggaagaagagggacaccacaccaccacctgttcatctttagagcacgacttacgaagagtaccccggccgtcgccgccgaccaccaaaagggccggaaaggacggcctctcgcttgagcgtgcagctcggcgccggccatcctgctttccaactctccccctggccccgtctcgtaatttgtaattccaaatccttccttagctgctcaaagtgccgaccagaaatgaagaggcaatccaagaggcccgccagcagccatgaatccacagaagaaggggagaagctggcgttcgcggaggacgaggccctagcggcgcgcaacatggagcacgaggaggccgagcccgagctggacgacgcggacgacgacgaagacgagctggccagcggccgcgcggggcggtcgccgggcgggctgggcgagaagaaacggcgcctggcggtggatcaggtgcgcgcgctggagcggtgcttcgagacggacaacaagctggacccggaccgcaagtcccgcatcgcgcgcgacctgngcctgcagccgcgccaggtcgctgtctggttccagaaccgccgcgcccgctggaagaccaagacgctcgagcgcgacttcgccgcactgcgcgctcgccacgaggccctccgcgccgactgcgacgcgctccgccgcgacaaggacgcactcgccgccgagatacgggagttgaggcagaagctgtccaagccggagacggcggcgaagcttgaggcggcggccaatgacgccgccgcggaggagcgccaggcgacggccggcgcgtcggccgcggcggtctgcaaggacggctcctcggacagcgactccagcgtggtgttcaacgacgtcgaggcgtcgccctactccggcgcggcgttcgagcagccggccttcgccgggttcggggcaccgttcttggacacgtcggcggcggtgacgacaggctgctcgtccctctccatgttcgagaccaagtggcagctggcgccggcatgcccatacgactcgtacaagagcagcggcggcgtctatggcttcacggaggaatggttcgccagctcggacgtgatcggcagcggcgactgcgcggctagcttcttctctgaggagcacgcctccagcctcaacttcggctggtgcgcgagcggcaccgaggcctgggagtgagcgaggctttgatctccccggttagtgtgaacaaaacaagcagcaatgttacgcaaggccggaacattggaagtttggaacaagtgcagttgccagtaacaataacggtgaattttaggcaggctaaatgtaaatgtgaaaaaatgtaaaaagagaccgtcctgctccaccgccgtctgtccgttttgcggtgtactgcttggatgcaaatgcaacgagtcggcaacggtagcgtgctagggggaaatgggaaatgataagcagagtgcgatttaggatttttatgatgtctaatgaaataaaacatagtactatctct

SEQ ID NO: 25155 - protein, 318 aa, Panicum virgatum
  misc_feature: Ceres CLONE 1862353
  misc_feature (68)..(122): Pfam Name: Homeobox Pfam Description: Homeobox domain
  misc_feature (123)..(167): Pfam Name: HALZ Pfam Description: Homeobox associated leucine zipper
  misc_feature (103)..(103): Xaa is any aa, unknown, or other
MKRQSKRPASSHESTEEGEKLAFAEDEALAARNMEHEEAEPELDDADDDEDELASGRAGRSPGGLGEKKRRLAVDQVRALERCFETDNKLDPDRKSRIARDLXLQPRQVAVWFQNRRARWKTKTLERDFAALRARHEALRADCDALRRDKDALAAEIRELRQKLSKPETAAKLEAAANDAAAEERQATAGASAAAVCKDGSSDSDSSVVFNDVEASPYSGAAFEQPAFAGFGAPFLDTSAAVTTGCSSLSMFETKWQLAPACPYDSYKSSGGVYGFTEEWFASSDVIGSGDCAASFFSEEHASSLNFGWCASGTEAWE

SEQ ID NO: 25156 - DNA, 734 bp, Panicum virgatum
  misc_feature: Ceres CLONE 1862367
  misc_feature: Encodes the peptide sequence at SEQ ID NO. 25157
atcttctaccccgggccggcctctctgggctctggctttcccccgtttccggcattgctcgacctcgcgcaactccggcttggttgtggcgtgctgctccggctggccgtgttgattttctgggggggtccccacggtcacatggggatggggatgaaactgctggcccgagtccggaggcgcctcgtcccgctccttcgccggcacaggatggcgctgctcacggcgccggcggtggccgcgctgctgctgctcttctggtccgcggcgtacggtgacgcccagctgccgtacaaggaccccagcctgcccgtgaaggcccgcgtcaaggacctcctcggccggatgacgctcgccgagaagatcgggcagatgacgcagatcgagcggaaggtcgcgtcgccgcaggtgctcaaggacaacttcatcggcagcctgctcagcggcggcgggagcgtgccgcggctgcaggcgacggcggcggagtgggtgagcatgatcagcgacttccagaaggcgtgcctgtccacgcggctgggcatcccgatgatctacggcatcgacgccgtccacggccacaacaatgtctacggcgcaaccatcttccctcacaatgtcgcgctcggagccaccaatgatcctgatctggtgaagaggatcggtgccgcgaccgcgctcgaagtgcgagccaccggcatccagtacgcgttcgcgccatgcattgcggtgtgtcg

SEQ ID NO: 25157 - protein, 197 aa, Panicum virgatum
  misc_feature: Ceres CLONE 1862367
  misc_feature: SWISSPROT Homolog: EC 3.2.1.21 Beta-glucosidase
MGMGMKLLARVRRRLVPLLRRHRMALLTAPAVAALLLLFWSAAYGDAQLPYKDPSLPVKARVKDLLGRMTLAEKIGQMTQIERKVASPQVLKDNFIGSLLSGGGSVPRLQATAAEWVSMISDFQKACLSTRLGIPMIYGIDAVHGHNNVYGATIFPHNVALGATNDPDLVKRIGAATALEVRATGIQYAFAPCIAVC

SEQ ID NO: 25158 - DNA, 2151 bp, Panicum virgatum
  misc_feature: Ceres CLONE 1862378
  misc_feature: Encodes the peptide sequence at SEQ ID NO. 25159
ggccgcgtgcgcttctcatcccctcgcgccgccgccgctcctaaacccctcgcgccgccgccgctgaatccatcctcggccgccgccgccgcctcctcccatgtcccgccgccccggctccctcattcccctgctccgccgccgcggcctccacgactccccaacccaccggtccttcgcctccgtctccgtcccacccgacgcgatcccctccacctcctcgccgtggccgccgcactccccacctcctactccgccgccgaccgatcccgacgggacgcggtggtccgcgtcttggtcccccgcctcgccgccgctcccgcccttcactgccgctcagctccgctctgccgtctcttcgatcgccgcctccctcctcgccctcccggagcctgatccaaacccggcgcccgacctccacgcccactccttcccgaccctcctcgccgtctcaccgctcgcatcgctcgagcttctctcgctgctccggcccaggccgcggctcggcctcgcggtgttctcatttcgccgcgagctctccccggcccccacactcggcgagttcgccctcgctatctcgctcgcgagctgcgcccgcgaccccgccgcggctgctgcgctctttgccgacgccgctgccgctcactccccggaccaggcgctgtacaacgccctcatggcggcgtacatgcacagcggcctcctggacagctgcctcgaggccttccatgcgctggaacgcgacccgcggtgcgggccgcctaatgtggactcgtacaacatcctcatcgccctcttcggtcgctccctcctcgttgaccacatggaggccacgctcaggtcgctggatgcttctgggcatccccgcacgattggtacgtataatgcaatcatcgccggataccttactgcgtggatgtgggacaaaatggaagcagtgttccaggaaatgttgtcgggtcatattgttcctgatactactacgcatctgttgatgctgagaggatatgcgcatgctgggatgatatacaaaatggagcgagcttatgagcgtgcttacaagcatgctggaaaagttgacaatgtgcatatacgtgcaatgctaagcgcatactgcaagtttgaccatgtagataggattcaaaagatcgaggagttgttgcagaggttgggtcctgatgactacaggccatggctatatgtgttgttaattagggtgtatgctcaggaggggttgcttgaagggatggagctgcggatcgccgaggcactggaacgcaatgtcattgtcaccaccgtacaggtgatgcggtccatcatatcaagctattttcattccgatgcggtcgacaaactcgcatgttttgtccggcaggcggaggaggctgggtggaagctgtgccggagcttgtaccactgcaaaatggtgatgtatgggaagcaccagcggctggaagagatgcatggggttttggatgagatggaatgttttaaatttgacaggacaaagaagacattttggatcatgcacaaggcatatgttagttgtgggcgaaggactgaggcaaatactatactcggcatgatgtggaagcacggatttggacttcctaagaatgtatctgttcaacaacatgtgagttgatactccgtttggaatcccttaacggattctctaattctatgcaccttctcttttatataatgtattgttcgctgcaatcatagcatttgacatgtgattcgacaagcgcgtacctaaattttcaacttgttacttcttcatttgccgtgtagaaggaaaaataaggatctgtttagaagtaccacataaatattcaacattgtgatcaatttctaaagtacgactgcactaaatgttatcataaataaacctttttcttttgtaatggtgctgaagaatctgaggttctcaagcaatctttggcttgcaagactatctgacgccttgagaatttcatggttaaaattatggctgggcctaactgttgtgatggttctcccaagtgatatctgctgtagatcttatcatccaatacaaattatctcggcaatattagtattatcaccattaatcccatcaatattgttaccaagttaaatgcatattagagcatcgcctagatgtac

SEQ ID NO: 25159 - protein, 322 aa, Panicum virgatum
  misc_feature: Ceres CLONE 1862378
  misc_feature (67)..(101): Pfam Name: PPR Pfam Description: PPR repeat
MAAYMHSGLLDSCLEAFHALERDPRCGPPNVDSYNILIALFGRSLLVDHMEATLRSLDASGHPRTIGTYNAIIAGYLTAWMWDKMEAVFQEMLSGHIVPDTTTHLLMLRGYAHAGMIYKMERAYERAYKHAGKVDNVHIRAMLSAYCKFDHVDRIQKIEELLQRLGPDDYRPWLYVLLIRVYAQEGLLEGMELRIAEALERNVIVTTVQVMRSIISSYFHSDAVDKLACFVRQAEEAGWKLCRSLYHCKMVMYGKHQRLEEMHGVLDEMECFKFDRTKKTFWIMHKAYVSCGRRTEANTILGMMWKHGFGLPKNVSVQQHVS

SEQ ID NO: 25160 - DNA, 745 bp, Panicum virgatum
  misc_feature: Ceres CLONE 1862389
  misc_feature: Encodes the peptide sequence at SEQ ID NO. 25161
ataccactgtgctcatggcatggtgttacatgctcaccagatcgatcacgtatatgggcccttagggtaccaggggctggtttgattggtacaattccagctaatactcttggcaggcttgtgtccctccaagttttaagcctgaggtctaatcgtctgagtggaagtcttccatcggatgttgcctcacttccttctttacaagccatatttcttcagcacaacgaactgtcgggagacttgccttcatttttctctccaagcctcaacaccctcgatctctcttacaactcctttacaggacaaatcccattaggtttgcagaatcttacccaattatctgccctgaatttagcaggaaattccttgtctgggccaatccctgacctcaaacttccaagcctaagacagctaaatctgagcagcaatgaactaaatggttcgatccctccctttctccaaatattctcaaatagctccttcttagacaaccctggattgtgtgggccgcctctagctgtatgctcctttctatcttcacctacaccatcacaagtgcctttacttccatcatcgccacatcatgagaagaagacatgcaatagcatgataattgcggctgttgttgggggctttgtcatatttctgctagctgctgtgatgttcactatgtgcttttcaaagagaaaggacgagaaagatgaggtggcttacaacgcccaggtgactgatggtgcaaggattg

SEQ ID NO: 25161 - protein, 248 aa, Panicum virgatum
  misc_feature: Ceres CLONE 1862389
  misc_feature: SWISSPROT Homolog: EC 2.7.11.1 Non-specific serine/threonine protein kinase
IPLCSWHGVTCSPDRSRIWALRVPGAGLIGTIPANTLGRLVSLQVLSLRSNRLSGSLPSDVASLPSLQAIFLQHNELSGDLPSFFSPSLNTLDLSYNSFTGQIPLGLQNLTQLSALNLAGNSLSGPIPDLKLPSLRQLNLSSNELNGSIPPFLQIFSNSSFLDNPGLCGPPLAVCSFLSSPTPSQVPLLPSSPHHEKKTCNSMIIAAVVGGFVIFLLAAVMFTMCFSKRKDEKDEVAYNAQVTDGARI

SEQ ID NO: 25162 - DNA, 698 bp, Panicum virgatum
  misc_feature: Ceres CLONE 1862392-R
  misc_feature: Encodes the peptide sequence at SEQ ID NO. 25163
ctttcaacgggagaagttcgatgtctcgtcacacagctccagaaaatcgattttattttctttctttcttttgattctagaggaccttcataaggatttagatgtttatccgtgatttttacgcatactctgtgcaggctctgcccaggagtttctgatgccttgaacgtatgattttgcaggcatgtgttgagaagaagtatggaggaattgcacccaagaagcctttgatatccaaggaccacgagcgcgcgtacttcgattcagcagactgggtgctcggcaagcaagctgcaaatagcagcacacggactgctgttgagtctctgaagcccaagctgaagcgaacgcctcaccaccagcttccccctcgcaagccgacctgcgcttccagctgagacgcacggtgagctggctgacctccaatccaaaagcctgcagcacttagctcgtagtagcatcacgcgcagcaatgtgcaaaagcgccgcaagaaatgaccacccctctgtgttcatgcagtgcagctgctggagggagtgctgggaggtaaggatagggctcggataaatgtttggccgctggtccgaaatcgtagggatggatcagaagcctgaggggcaatctggctacttgtcaattgcagcctctactatgtctgtcatcaagaacggattagatggtacttgtggttgaacgg

SEQ ID NO: 25163 - protein, 75 aa, Panicum virgatum
  misc_feature: Ceres CLONE 1862392-R
  misc_feature (8)..(75): Pfam Name: Lg106 Pfam Description: Lg106-like protein
  misc_feature: Useful for biocontainment applications
MILQACVEKKYGGIAPKKPLISKDHERAYFDSADWVLGKQAANSSTRTAVESLKPKLKRTPHHQLPPRKPTCASS

SEQ ID NO: 25164 - DNA, 1396 bp, Panicum virgatum
  misc_feature: Ceres CLONE 1862392
gcgcttcgttcctccacgtccctcggcatcgcctcctctccgtctccctgcagagagagcgccgcaaggcactgaaactcgcggcggcgtgttgtttgcttgcttgctggcaagagggagaaaaggaggaggaagagagcaggagatggcaggctgcgatggagccaagtcgccggcctccaaggaggaagaggtaattctgcatgatttcagcggattggtttctcgcacaaaacatgcattgtctatacatgccctgtttgttccactacctggttgcttgcatcagttcttaccttgcttagagcttccgagtttattgatcacaaaacgatgtttctttttcccggaagagcttctgagttattgatcaatgatcaaaaaatgtttttttcgcccggaactatggggatcttaacaacgtgctgtagtagagagatcgacatagttcagatttcgcagggagtgatgcttggttcgatttcgaaacacatgaaggccaatgattcgttttgaatagattttgtgtgtgttgaggtatttcaactctgaatgctgctgggtttgctcatgaaggtgttctcaaactatcctaaagttcctgaaccatgtccatccaacttcccaagatagctgcagtagcgtttcctaactcctttcttgccagaaaatgtataaccgacaagcagttgaagaaatcagaggataaagggacaacatgaggttaccctgtctgcccatttcggcgttcagtttctttaacaaaataaatatcttgccttcggtgctaactgcaaagactcgaaacttgctagtgaggaagtttcttcagttttttttcccctttttgataccatggtgatgttttctttgctggcctaaattgcgcattaaacacaaacaatcaggtttagccactaaaaaaaggtaattacaggacatcacctaacgtgtgtgtagattgattaaggtgcacttatcctcagcacctctacttactagcaaacttgccatgcccaacgcatttaaagattctgcactatcttaatactaatacagacagctatagattacgcccaagaaactgcttttgttgaccgcagccaccaaagatttagtttaatataccgtgaaggaatgaatgaaggatctaaagcaaactaaactttacgcaacctgttgttcaaccaaggccatgtttagtttccaaaaatatttgcacactaccagtcacatcgaatcttcgaacacatacatgaagcattaaatgtagttgaaaaaataactaattacatagtctaattgattaccacgagatggatcttttaagtctaattaatccatgatttaaatattatttgttaaataacaatgaaatgtgctacagtatcaaaac

SEQ ID NO: 25165 - DNA, 698 bp, Panicum virgatum
  misc_feature: Ceres CLONE 1862400
  misc_feature: Encodes the peptide sequence at SEQ ID NO. 25166
tcctctccctcttcctccctccctctccgtgcgctcgagcgaattcccgagcgggattctccgcggtagaggaaccctagcgctccccggatccggccgcggggtgcaatggccgccccggcgttcctgcccgagctggccacgcaggtggtggtgcccgtcgcggccgtggtgggcatcgccttcgcggtgctgcagtgggtgctggtctccaaggtgaagctctcccccgagccgcggcgcgcggacgggtcctcagcgaagagcggcgccggcgccagcgagtacctcatcgaggaggaggaggggctcaacgagcacaacgtcgttgtcaagtgcgccgagatccataacgccatctccgaaggagccacatctttccttttcgctgaatacaagtatgttggactattcatgggcatttttgctgtcctgatcttcctcttccttggctctgttgaggggttcagtaccaagagtcagccttgccactacagcaagggcaagacgtgcaagcctgcccttgccaatgctcttttcagcaccattgcctttgtgcttggtgcagtcacctcacttgtttctgggtttcttggaatgaagattgcgacctatggcaatgccgggacgactcttgaggtaaggaagggtgttcggaaaggcattcattccccccttccccccctgggggtgtgatg

SEQ ID NO: 25166 - protein, 195 aa, Panicum virgatum
  misc_feature: Ceres CLONE 1862400
  misc_feature: SWISSPROT Homolog: EC 3.6.1.1 Inorganic diphosphatase
  misc_feature: Useful for making plants with modulated water use efficiency
MAAPAFLPELATQVVVPVAAVVGIAFAVLQWVLVSKVKLSPEPRRADGSSAKSGAGASEYLIEEEEGLNEHNVVVKCAEIHNAISEGATSFLFAEYKYVGLFMGIFAVLIFLFLGSVEGFSTKSQPCHYSKGKTCKPALANALFSTIAFVLGAVTSLVSGFLGMKIATYGNAGTTLEVRKGVRKGIHSPLPPLGV

SEQ ID NO: 25167 - DNA, 2330 bp, Panicum virgatum
  misc_feature: Ceres CLONE 1862407
  misc_feature: Encodes the peptide sequence at SEQ ID NO. 25168
tctcctttttccaacaattgcacaccacttttaagccttcactcttagccatgccgatcaaaccgtggcactcttatgcagttcagctgctcacatgttgcactctgatgctggtcctcgctcaccctgttgcaccgtcttctcgtggcgccatggtccctgctccagctacacctactgttcagtctccagctcaagctccacccactcttcagtctccagcagctccagctaccactcctcccccagctccggttccagctacccctactaccccagctcggcatgtctggaacgtcgagtacatactgtgggcaccagactgcaagcaacacgggatgatcgggatcaatggcgcgttccccggcccgacgatcaccgccaacgccggggaccttatcagagtggaggtgaacaacaagctgcacaccgagggggtcgtcatccactggcatggaatcaaacagattgatacgccatgggcggacggaaccgcgtcgatatcgcagtgccccatcaacccgggggagacgttcacctacgagttcaaggctgacaagcccgggacgtacttctaccacggccacttcgggatgcagcgggcggccgggctgtacgggtcgctgatcgtgctcgacggggacgacccgttcaagaaggaccccatgtacgccggcgagctcagcatgctgctcagcgactggtaccacgagcccgtctacgcgcaggcggccgggctcgagcgcaaggacgaccacttccagtggatcggcgagccgcagacgctgctgatcaacgggaaggggcagttcgggtgcacgctgggcgacgtcgtcggcgagcccaagtgcgaccggaaggatggggagcgcgtggaggcggcgtgcgacaagcgttgcggggatggggggaaggagtcggaggcggagaagaaggtggtgtgcgaggacgagaaggcggcaagctgcgccgtgatccggcgaagcgagtgcgggcccttctgcaacgagacccagtgcggccccgtggtgttcgacgtggtgcccggcaggacgtaccggctcaggatcgccagcaccacctccctctccgccctcaacgtgcaggtccaagggcacaagctgacggtggtggaggccgacggcaacttggtggagccgttcgacgtcaacagcatcgacatctactccggcgagagctactccgtcctcctcaacaccgcagcggcggaacagggggcgtcgccagtctcctactggatctccgtcggcgtgattgggcggaagcccaggacgccgccggccctggcggtcctgcggtatgccggcagcggacccgatgagctgccgacgggagcgcctccggcgaccccggcctgggaggacgtgggacgcagcaaggagttcgcgaaaagactcaaagcccgagcaggacacggctaccagcagccgccggagacgacgggcgcgcaccggcaccggacgatcgccatgctcaacacgcaggagctcgtcgacggccggatcaagtgggcgatcaacaacgtctccctgtcgctcccgttcaccccgtacctcggcgcctacgcctacggcatcccgggccaggtgttcaacaccacccccgcgccggccgccttcggcagcaagtacgacgtcgcgaagccgccgcaggagcaggatccggcggccgtcctgccggcggcggtgaccgaccaggtgcacagcctcgcgcacggcgaggtcgtcgacgtcgtgctgcagaacgcggacatgaggagggacgacgtgagcgagtcgcacccgtggcacctccacgggcacgacttctgggtgctcggctacggcgaggggccctaccgcggggacgccgccgacgaggcgcggctcaacctctgggacccgccgctgcggaacacggcggtgctgttcccgcatgggtggacggcgctccggttcgtggcggacaacccgggcgtgtgggcgttccactgccacatcgagccgcacctccacatgggcatgggcgtcgtcttcgccgaagggatggaggaggaagagaggctgcgggaactgaggctcaaggtccccagggaggccatcatgtgcggcaagaccgcgctcgcggccacgtcgccgtcgccttccccgtgacacagaaatgtctcgcacacagtttcctcctcgcatgcccgttccccaagtgtgacgcgtatatcattatatcgttgtagtatctgctatggcaagagtaaaccccaccgtaagttgtgattcttttctaggatcgtcaagtgggcactcgctctacaaggtttacaatgttttctc

SEQ ID NO: 25168 - protein, 700 aa, Panicum virgatum
  misc_feature: Ceres CLONE 1862407
  misc_feature (82)..(199): Pfam Name: Cu-oxidase_3 Pfam Description: Multicopper oxidase
  misc_feature (209)..(427): Pfam Name: Cu-oxidase Pfam Description: Multicopper oxidase
  misc_feature (534)..(668): Pfam Name: Cu-oxidase_2 Pfam Description: Multicopper oxidase
  misc_feature (401)..(700): SWISSPROT Homolog: EC 1.10.3.3 L-ascorbate oxidase
  misc_feature (101)..(299): SWISSPROT Homolog: EC 1.7.2.1 Nitrite reductase (NO-forming)
MPIKPWHSYAVQLLTCCTLMLVLAHPVAPSSRGAMVPAPATPTVQSPAQAPPTLQSPAAPATTPPPAPVPATPTTPARHVWNVEYILWAPDCKQHGMIGINGAFPGPTITANAGDLIRVEVNNKLHTEGVVIHWHGIKQIDTPWADGTASISQCPINPGETFTYEFKADKPGTYFYHGHFGMQRAAGLYGSLIVLDGDDPFKKDPMYAGELSMLLSDWYHEPVYAQAAGLERKDDHFQWIGEPQTLLINGKGQFGCTLGDVVGEPKCDRKDGERVEAACDKRCGDGGKESEAEKKVVCEDEKAASCAVIRRSECGPFCNETQCGPVVFDVVPGRTYRLRIASTTSLSALNVQVQGHKLTVVEADGNLVEPFDVNSIDIYSGESYSVLLNTAAAEQGASPVSYWISVGVIGRKPRTPPALAVLRYAGSGPDELPTGAPPATPAWEDVGRSKEFAKRLKARAGHGYQQPPETTGAHRHRTIAMLNTQELVDGRIKWAINNVSLSLPFTPYLGAYAYGIPGQVFNTTPAPAAFGSKYDVAKPPQEQDPAAVLPAAVTDQVHSLAHGEVVDVVLQNADMRRDDVSESHPWHLHGHDFWVLGYGEGPYRGDAADEARLNLWDPPLRNTAVLFPHGWTALRFVADNPGVWAFHCHIEPHLHMGMGVVFAEGMEEEERLRELRLKVPREAIMCGKTALAATSPSPSP

SEQ ID NO: 25169 - DNA, 1484 bp, Panicum virgatum
  misc_feature: Ceres CLONE 1862414
  misc_feature: Encodes the peptide sequence at SEQ ID NO. 25170
aaataaaacactctcccacgcacaccacccaccactgcgcccctgctcctcctcctcctcctcctcctcagtcccagtccctgctcactagctgagcgaattagactgctcgctcactagctcggctcagctggaaggagttggggtagaggtcgccggggagaaagagacggtaagagggcggcgttcagctcatcagctgagctgagcttgggaggtgagagggacaaggggagcttggaaggaggaggaagagaggagaggagcccaagatgattacggggtcggacttctaccacgtgatgacggccatggtgccgctgtacgtggcgatgatcctggcgtacgggtcggtgcggtggtggcgcatcttcacgccggaccagtgctccggcatcaaccgcttcgtcgcgctcttcgccgtgccgctgctctccttccacttcatctccaccaacaacccctacaccatgaacctgcgcttcatcgccgccgacacgctgcagaagctcatggtgctcgccatgctcaccgcctggagccacctcagccgccggggcagcctcgagtggaccatcacgctcttctccctctccacgctgcccaacacgctcgtcatgggcatcccgctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgccggggccatcgcctccatcgtcgtcgacccggacgtcgtctccctcgacggccggcgggacgccatcgagaccgaggccgaggtcaaggaggacggcaagatacacgtcaccgtgcgccgctccaacgcctcgcgctccgacatctactcgcgccgctccatgggcttctccagcaccacgccgcgccccagcaacctcaccaacgccgagatctactccctgcagtcgtcgcgcaacccgacgccgcggggctccagcttcaaccacaacgacttctactccatggtcggccgcagctccaacttcggcgccgccgacgccttcggcgtccgcaccggcgccacgccgcgcccgtccaactacgaggacgacgcgtccaagaccaagtacccgctgcccgtcgtgaatgcagcgcccgggccgggccactaccccgcgcccaacccggcggtggccgcggcgcccaagggcgccaagaaggccgccaccaacgggcaggccaagggcgaggacctccacatgttcgtctggagctccagcgcgtcgccggtctcggacgtcttcgccggcggcgcgccggactacaacgacgccgccgcggccgtcaagtccccccgcaaaatggatggagcgaaggacagggacgactacgtggagcgcgacgagttcagcttcgggaacaggggcgcgatggacagggacgcg

SEQ ID NO: 25170 - protein, 403 aa, Panicum virgatum
  misc_feature: Ceres CLONE 1862414
  misc_feature (9)..(358): Pfam Name: Mem_trans Pfam Description: Membrane transport protein
MITGSDFYHVMTAMVPLYVAMILAYGSVRWWRIFTPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGVRTGATPRPSNYEDDASKTKYPLPVVNAAPGPGHYPAPNPAVAAAPKGAKKAATNGQAKGEDLHMFVWSSSASPVSDVFAGGAPDYNDAAAAVKSPRKMDGAKDRDDYVERDEFSFGNRGAMDRD

SEQ ID NO: 25171 - DNA, 684 bp, Panicum virgatum
  misc_feature: Ceres CLONE 1862414-R
gcccgtgatggcggccgcgtccttcgccgtgggcctccggggcacgcttctgcacgtcgccatcgtccaggcagctctgccccagggcattgtccccttcgtcttcgcaaaggagtacaacgtgcaccctgacattctcagcactgcagtcatttttggcatgctcatcgccctgcccatcacgctcgtctactacatcctgctcgggctgtgagcgccgaccgccattgctgtaaaaaagactagcaccacccaatatcagatcaggggaggcaaagggaggacagagctgcaacgacactgcttggcgcttgcaaaatgagtgacttgttttttttttcttgttctctttttttcttcttctttttttctactagaagtaggtgtggggattgggagaagggaaagggtggaggtggacaagacgttagctagctaggacgacaatggtgaggcaaaaggcaccaaaagcaggtacaagtacaaagcttgaagggaacaggggatcatccggtttcagcaggtcacgggacttgggggttcggtgaggtttcgcaacgggttcttttggggattttggatggccgcgctgaccgctgtaaaatggacgccatttctgacaagaggtcgatcgatcatgctttgctcatctcatgagtttgatggattgagatggtatttgtc

SEQ ID NO: 25172 - DNA, 2233 bp, Panicum virgatum
  misc_feature: Ceres CLONE 1862421
  misc_feature: Encodes the peptide sequence at SEQ ID NO. 25173
gattgcgattgcgactgcgattgattcctctcctctcctctccgccttctcccgagaaccgcaagcaatcccctcagatcctcctctacacgtcatccaccactggcttggattcgagttcaagcaatagcaatccccggcgaaggtgcggcggcggcgcccggaggtcaggtcggctgtcggcatcgcatcatccccacgatacctgtaactcgcttccttaccgcacaagtaagacaccaaccaaatcccccctcctctcctctcctccctcggagtatggttcagtctctctagtttgtttcccttccgattccaacatctctcctctctgcgttcctgcctgcctgccgattccgttcaatgtattccttctccgggattcaatttactattttgtaataacaacaacaacatacagtaatattctgctctggaggaaggagggaaagctagctcctaatcaatcaatcaatcaatcaatcaatcacagggtctgctgcctccgatgatgatgatgctgtcttgcaattaatttgttttcagacgacaagaagaaaagagattgctaattcttcatccatggttttgtacgatcaagacccagatatcacccgatggggccttcatctcctcctcccaggtggaggtggaggtggaggtgctgttacccacaactctgcccatcatcaaactacgccccttcagcatcccaacgggggggacacccccaattccactgagatcaaggttgagcatgtcgcccgcaccgatgatgccgttgacaatgacgagatcattgcgcaagccctgcaggaggaactgtcccaaatcgcccttgccgaggcatctggagcatcctccgctgacaacaaccactccgctgttctcacgcaacagtggtttcgcccacgcaccatccatgtagcatcagggacatctccagcttctcgacaggcagagagcagcgaggaaccatttagttcatgctcaagccctggagatgacaatgtccaacatgccgaggcatgcttaatcgacctcatggatgacttctctgtcctagacggcgaagttggcaaaagattgaatgacatggttcctgttcctcatgttcctaagacaaatggagagattccttctgttgatgaagccatctcagatcatcaaagactccttgacaggttggtgctgtacggtttggttgagctcaaggttaaaggagatggcaattgtcagtttcaagcattgtcagatcaattttaccgcactcctgaacatcacagatttgttcggcagcaagtggtgaagcagcttgaatcacatcctgagtgttatgcgggatatgtccctatggattacagggaatatctcaaaaagatgtcaaagagtggagagtggggtgaccacgttacgttgcaggctgctgcagactcggtaatcttgatgcatcttgaactgttgttgttgtattagcgaatgtctgaccctgtatatgttgtaaagacaccaagtaactcctctgattttagcaatgggatgcatggctaatggacgtagctgcagcagaacactgtcagaaattgcattgcatggctatggtttaaaaaaataggagcattgttttccttttctttcaattcaataggacaagatatctacttttcagatgagcccaggtgccttatgtgtatgcgtcgcctcttgcagtatggtgtgaaggtcttcatcctgacatcattcaaagatacatgctacattgaaattcttcctgttgttgagaaatcaagaagagttatatgcttgagcttttgggcagaggtgcactacaactcgatatatccggaaggagagttacctgttttggagaacaaaaagaagagttggtggcccttctagcggtagcagttccaggtcgggaagaagattagattagagcagcttccggtgggtggcaggaattgtgtgaggccatgtgacttactccactgacggcgatgtagatgctagtatctgtacagacagagaggtgattagcatgagagggaagggaggtgattagacatattcattcattttctgatttgtagctgggcctttaggatcattcttttgttcttggtcagctcagaaccactacttgtgtgatgataacttgagagagggagcagagctttgattcaccgatctggttaactctttgaataaataaataatacgatgattccatgcc

SEQ ID NO: 25173 - protein, 297 aa, Panicum virgatum
  misc_feature: Ceres CLONE 1862421
  misc_feature (213)..(297): Pfam Name: OTU Pfam Description: OTU-like cysteine protease
MVLYDQDPDITRWGLHLLLPGGGGGGGAVTHNSAHHQTTPLQHPNGGDTPNSTEIKVEHVARTDDAVDNDEIIAQALQEELSQIALAEASGASSADNNHSAVLTQQWFRPRTIHVASGTSPASRQAESSEEPFSSCSSPGDDNVQHAEACLIDLMDDFSVLDGEVGKRLNDMVPVPHVPKTNGEIPSVDEAISDHQRLLDRLVLYGLVELKVKGDGNCQFQALSDQFYRTPEHHRFVRQQVVKQLESHPECYAGYVPMDYREYLKKMSKSGEWGDHVTLQAAADSVILMHLELLLLY

SEQ ID NO: 25174 - DNA, 714 bp, Panicum virgatum
  misc_feature: Ceres CLONE 1862427
  misc_feature: Encodes the peptide sequence at SEQ ID NO. 25175
cagcccaagcatcggcccattcgcccccacacccgtcacactccctccccacctccacccgcgccgccatccgccgcggcattccaccgagcacctcgcgcgcgcgcatggccgccatggccccgcaccacctctcccgccccgccgccgccgcggcatccggcgccgtgtctggtgctctcagcaggcaccgcgccttcccatccacctcctgctcccctctccgcctcccgctcctccgcgccgccgccgccaggcccgcgcgcctctccgccgcggtttccaccgccgccccgaccatggaggccgcggcgatggacgccgtggccaagtgggggctcaccccgctctccgaggccgacccggaggtctacgacctcatcgagcgcgagaagcgccggcagcgcgcgggcatcgagctcatcgcctccgagaacttcacctcgctcgccgtcatggaggcgctcggctccccgctcaccaacaagtactcggagggcatgccgggggcgcgctactacggcggcaacgaggtcatcgacgaggtcgaggagctctgccgcgcccgcgcgctcgccgcgttccacctcgacccggcgcgctggggcgtcaacgtgcagccctactcgggctcgccggccaacttcgccgcctacacggggctgctccagccacacgataggatcatggggctcgacctgccgtcgggtggcc

SEQ ID NO: 25175 - protein, 199 aa, Panicum virgatum
  misc_feature: Ceres CLONE 1862427
  misc_feature (78)..(199): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
MAPHHLSRPAAAAASGAVSGALSRHRAFPSTSCSPLRLPLLRAAAARPARLSAAVSTAAPTMEAAAMDAVAKWGLTPLSEADPEVYDLIEREKRRQRAGIELIASENFTSLAVMEALGSPLTNKYSEGMPGARYYGGNEVIDEVEELCRARALAAFHLDPARWGVNVQPYSGSPANFAAYTGLLQPHDRIMGLDLPSGG

SEQ ID NO: 25176 - DNA, 721 bp, Panicum virgatum
  misc_feature: Ceres CLONE 1862432
  misc_feature: Encodes the peptide sequence at SEQ ID NO. 25177
tatccgcgggagtagagggcaccgccctccgccgccggctcggaactcggaagtgatttcttggcagatccggtatcgtcgtctactcatggggatgttggcgctgaaccgcctcatgtccttgcgccgcgaccggcatcggcgtcgcttgcaaatccgagcccggtgtggacttattacctcatcaaggggtaaaagaaagggatcaccctgtcaagacgatggaatacctcgagatggtaaaataatgaggagtccaatcccagaccttcctgaggaaatattgtttcacatacattccctgatgccaatgcgtgaagctgctcgtgctgcttgtgtatctcgtgcctttttacattcctggagatgtcatccaaatctcatcttcaataaggatacaattggcttgaagataaatgggcatggagagaatttccatcacaaaattggccgcattcttaggaagcactcagggattagcttgaaagcgttcaatcttgactacagcggcatgtgcggttatgatggttctcgttattatgatcgttgggttcagattgctcttaaacccggcattgaaaaacttaccctctggttgcctgcaacaaagaaaatatacaacttcccatgctcagttttatcagatggggttcgaaactcacttcagtaccttaaacttcgttctgttgccctccatcccactgttgaacttggccccttg

SEQ ID NO: 25177 - protein, 210 aa, Panicum virgatum
  misc_feature: Ceres CLONE 1862432
  misc_feature (56)..(103): Pfam Name: F-box Pfam Description: F-box domain
MGMLALNRLMSLRRDRHRRRLQIRARCGLITSSRGKRKGSPCQDDGIPRDGKIMRSPIPDLPEEILFHIHSLMPMREAARAACVSRAFLHSWRCHPNLIFNKDTIGLKINGHGENFHHKIGRILRKHSGISLKAFNLDYSGMCGYDGSRYYDRWVQIALKPGIEKLTLWLPATKKIYNFPCSVLSDGVRNSLQYLKLRSVALHPTVELGP

SEQ ID NO: 25178 - DNA, 2549 bp, Panicum virgatum
  misc_feature: Ceres CLONE 1862435
  misc_feature: Encodes the peptide sequence at SEQ ID NO. 25179
accgcacacgcctcgaaaagcccaagacaccctcttctctcctctgcttcttcctcttccttccttcctcctccatctctccctcctcttgctaggctgctacctgcccttgccggagtagagtatctgcgtcgtccgcgtctcctcccccctcctctggcaagcagcaagcgcgcgtgcaagagcaagacgactcccaacccgcccgaggtgaaggtgagcaccaccctcttctcttttgttcgcttctgcttctgcgccggcgatggtggcgctgccgctgcttcgcttggcccccctctctccctgcttccctcattcatcagcgctgcgctccctcctgatgagtaggagtacgtacggaataaatggctcctctgctgcagcagctgcccacccagtggagtgatttccctttgtcctcttccccgtccccggctgcttgtattttttttttcgcgagctgttccttcctgcttggtgccacctccttggcctttccgttttggcgcttcttcttcttttatccctactactagtacagtaggtactgtatctaagagcttcgttccgttgctcggaaaatcaatccgtccatttttcctctctctaaaaaaaagctggtgcctctgattattggtggattccctgccctgtctccttcctcacaccgtttctctccgcatgcaggtgccgcaggctttgccaggccgcctccgcctactcccactgactttacccgattggattggcttggcgctcccacccagcagcagccatcaattgttcctcagccataccatttccgtcgtataaatccacaagaaacagcgccaaagctccaagcttttgcttctgctcgcttcataaaagtttccggccggggacgacgggcgaataagcaagctggcgaggctcatggtccaggacgacgcctcagcctcagcctccacgtcgtcggtcacgtcctccccgctccacaacttctccagcatgccgctccacccggccgccgccccgacgccgccctggctactgcgggagctccgctccgacgagcgcggcctctgcctcatccacctcctcctcaactgcgccgccgccgccgccgccgaccgcctcgacgccgccaacgccgcgctcgagcacatcgcctcgctcgccgcccccgacggcgacgccatgcagcgcgtcgccgcggccttcgcggaggccctggcgcgccgcgcgctccgggcctggccgggcctctgccgggcgctgctcctgccccgcgccgcgcccaccgccgccgagctcgccgccgcgcgccgccacttcctcgacctctgcccgttcctccgcctcgcgggcgccgccgccaaccagtccatcctggaggccatggagtcggagaagatcgtgcacgtcgtcgacctcggcggcgccgacggcacccagtggctcgagctcctccacctcctggccgcgcgccccgagggcccgccgcacctccgcctcacggccgtccacgagcacaaggacgtgctcacccagacggccatggtgctcaccaaggaggccgagtgcctggacgtgcccttccagttcaaccccgtggtgtcccgcctcgaggcgctggacgtggagtccctccgcgtgaagaccggcgaggcgctggccatcacctccagcctgcagctgcactgcctgctcgcctccgacgacgactccggcggcggcaaggacacgggcaaggagggcaagcgcagcagccccgagtccggggtgtccccgtcgacgtcgcgcgcggacgcgttcctgggcgcgctgtggggcctgtctcccaaggtgatggtggtgacggagcaggaggcgagccacaacgcggcggcgctgacggagcggttcgtggaggcgctcaactactacgcggcgctgttcgactgcctggaggtggtggcggcgcgcgggtcggtggagcgcgcgcgcgtcgagcggtggctcctctgcgaggagatcaagaacatcgtggcgtgcgacggcggcgagcggcgggagcggcacgagcggctggagcggtgggcggcgcggatggagggcgccggcttcggccgcgtggcgctgagctactacgcgctgctgcaggcgcggcgggcggcgcagggcctttgctgcgacggtttcaaggtgcgcgaggagaagggctccttcttcctctgctggcaggaccgcgccatcttctccgtctccgcctggcgcggccgccgcttcgactgactcccagacgccgtcggcggcggcgccgctgcccttcccgtattttgtgggaaggagacgtagattcgctcgtggtactcgcgtcacgtagtatttgttttggaccgtgttaatcttagggtgggtggtgtcctggtcgctgcagttggggtggctgactttgagccactccatgtggggcccactagcgctgggcccgctggcagtgacccaatgtcagcagccccaacgtcagctgatccggttctgtcgtggtcagctcaggcgaagtcggttgtcctgtgttgttc

SEQ ID NO: 25179 - protein, 421 aa, Panicum virgatum
  misc_feature: Ceres CLONE 1862435
  misc_feature (1)..(325): Pfam Name: GRAS Pfam Description: GRAS family transcription factor
  misc_feature: The sequence is a functional homolog of SEQ ID NO 1257 in the 10/374,780 US patent application
  misc_feature: The sequence is a functional homolog of SEQ ID NO 216 in the 10/714,887 US patent application
  misc_feature: The sequence is a functional homolog of SEQ ID NO 216 in the 11/435,388 US patent application
  misc_feature: The sequence is a functional homolog of SEQ ID NO 1255 in the 10/374,780 US patent application
  misc_feature: The sequence is a functional homolog of SEQ ID NO 212 in the 10/714,887 US patent application
  misc_feature: The sequence is a functional homolog of SEQ ID NO 212 in the 11/435,388 US patent application
  misc_feature: The sequence is a functional homolog of SEQ ID NO 110 in the 10/225,068 US patent application
  misc_feature: The sequence is a functional homolog of SEQ ID NO 190 in the 10/374,780 US patent application
  misc_feature: The sequence is a functional homolog of SEQ ID NO 220 in the 10/225,066 US patent application
  misc_feature: The sequence is a functional homolog of SEQ ID NO 4 in the 10/714,887 US patent application
  misc_feature: The sequence is a functional homolog of SEQ ID NO 4 in the 11/435,388 US patent application
MPLHPAAAPTPPWLLRELRSDERGLCLIHLLLNCAAAAAADRLDAANAALEHIASLAAPDGDAMQRVAAAFAEALARRALRAWPGLCRALLLPRAAPTAAELAAARRHFLDLCPFLRLAGAAANQSILEAMESEKIVHVVDLGGADGTQWLELLHLLAARPEGPPHLRLTAVHEHKDVLTQTAMVLTKEAECLDVPFQFNPVVSRLEALDVESLRVKTGEALAITSSLQLHCLLASDDDSGGGKDTGKEGKRSSPESGVSPSTSRADAFLGALWGLSPKVMVVTEQEASHNAAALTERFVEALNYYAALFDCLEVVAARGSVERARVERWLLCEEIKNIVACDGGERRERHERLERWAARMEGAGFGRVALSYYALLQARRAAQGLCCDGFKVREEKGSFFLCWQDRAIFSVSAWRGRRFD

SEQ ID NO: 25180 - DNA, 651 bp, Panicum virgatum
  misc_feature: Ceres CLONE 1862440
  misc_feature: Encodes the peptide sequence at SEQ ID NO. 25181
aaactcgccgttccgccagcgactcctgaccaccaccaccagccagtccccggatccggcgagggagcggagcagctagcgacgaggtgaactgatcgatcgatcggcatggggctgaggaagcgcctgttgcggtgcttcgggtgcggcggcaagcaggcgccggaggagaagcgggaggagcagggggcgggcaataagcgccccggcggcggcggcggggggaagccgaagctgcggcggctgagcacggcgaacctgcggtcgctgtcgctgcaggacctgtcgcggaagctggagaccaccaggctgcacgccttcacactggacgagctcaaggcggccaccaagaacttctccaccaccaacttcctcggcgagggcggcttcggccccgtctacaagggcttcgtcgacgcccgcctccgcccgggcctcgacccgcagcacgtcgccgtcaaatacctcgacctcgagagcgacggcgtccaggggcaccgcgagtggctggtttgaatcttgcctctgaatttgtttcgaaaaaaggaaaggaaatcctgtccctgaaatctgaatttgaatctgatttggttctggtgatcgatcaggcggaggtggtgtacctcgggatgctgagccacccgcatctgg

SEQ ID NO: 25181 - protein, 135 aa, Panicum virgatum
  misc_feature: Ceres CLONE 1862440
  misc_feature: SWISSPROT Homolog: EC 2.7.11.1 Non-specific serine/threonine protein kinase
MGLRKRLLRCFGCGGKQAPEEKREEQGAGNKRPGGGGGGKPKLRRLSTANLRSLSLQDLSRKLETTRLHAFTLDELKAATKNFSTTNFLGEGGFGPVYKGFVDARLRPGLDPQHVAVKYLDLESDGVQGHREWLV

SEQ ID NO: 25182 - DNA, 700 bp, Panicum virgatum
  misc_feature: Ceres CLONE 1862444
  misc_feature: Encodes the peptide sequence at SEQ ID NO. 25183
ctactccccggaagcggaagaagggcaaacgagccgtcccctcccccgcgccgcccacagaagcgcccgccacggcagccccagccgccatggaggccgaagcggacgccgccactacgacctacgtctacgacgccctcccggggctgaccctggccttctcgccggaggaggccctcgaagacggcgccgagccccggccggcccccgccgccgcggggcaggacgaggatgatgccaccgcgacctatgccgtcttccgcaatgagataacggcggctggggatgctctcgtggacatccccgcggcggacttcttctcgctcgacgtctccgcctctgcttccgtcgaggccccggcgtctgcggcggcggcgacgccttcgagctcccgcgctgcggaggagcagccagcgcaggggtctgagcgcgcgtggttcaggggagggaggcggttcaggagccccatgctgcagctacacaaggagattctcgacttctgcgattttatctcaccttctactgaagagcaatcttcacggacagctgctgtgcaagctgtctcagatgttatcaaacatatatggcctcagtgcaaggtggaagtctttggatctttcagaacagggctctatctacccacaagtgatatcgatgttgtaatattcgagtccggagttaaaactcctcagtttggcct

SEQ ID NO: 25183 - protein, 203 aa, Panicum virgatum
  misc_feature: Ceres CLONE 1862444
  misc_feature: SWISSPROT Homolog: EC 2.7.7.19 Polynucleotide adenylyltransferase
MEAEADAATTTYVYDALPGLTLAFSPEEALEDGAEPRPAPAAAGQDEDDATATYAVFRNEITAAGDALVDIPAADFFSLDVSASASVEAPASAAAATPSSSRAAEEQPAQGSERAWFRGGRRFRSPMLQLHKEILDFCDFISPSTEEQSSRTAAVQAVSDVIKHIWPQCKVEVFGSFRTGLYLPTSDIDVVIFESGVKTPQFG

SEQ ID NO: 25184 - DNA, 644 bp, Panicum virgatum
  misc_feature: Ceres CLONE 1862451
  misc_feature: Encodes the peptide sequence at SEQ ID NO. 25185
gagataaattcggagcaccaccgccggctcagtttcgtctggctggctggcttggcatcggccatcggcacccggcaggcggcgggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtccttctccgacgtgctcggtgcgcagctcgtcgccagggccaccggagagaacgcggtgagggcgcccgctgaggccaagctcaaggtggcgatcaacgggttcggccgcatcggccggaacttcctccggtgctggcacggccgcaaggactccccgctcgatgtcgtcgtcgtcaacgacagcggaggcgtcaagaacgcgtctcacctcctcaagtacgactcgatgctcggcaccttcaaggccgacgtcaagatcgtcgacgacaccaccatcagcgtcgacggcaagctcatcaccgtcgtctccaacagggacccgctcaagctcccatgggccgagctcggcatcgacattgtcatcgagtgcgtgaagggtaccggagtcttc

SEQ ID NO: 25185 - protein, 180 aa, Panicum virgatum
  misc_feature: Ceres CLONE 1862451
  misc_feature (78)..(180): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPTGTRLHSRAASRQRVDFADFSGLRPGSCSVSTAAREASFSDVLGAQLVARATGENAVRAPAEAKLKVAINGFGRIGRNFLRCWHGRKDSPLDVVVVNDSGGVKNASHLLKYDSMLGTFKADVKIVDDTTISVDGKLITVVSNRDPLKLPWAELGIDIVIECVKGTGV

SEQ ID NO: 25186 - DNA, 2079 bp, Panicum virgatum
  misc_feature: Ceres CLONE 1862472
  misc_feature: Encodes the peptide sequence at SEQ ID NO. 25187
gtataccctagccgccgcgccaccgtgattagacgattcgaccgcctccatcgctcgcctcgccgtcacctccgctcccctcgcccgtgctcagcatcagctcgccgacgtagcgcgtcccgctgcttcccaccgcctgccgcggcctcgcacactcggtcgccgtccacgcgtcaagacgccgtcgccgccacccccgtcccgcgctggactccgaagctagcggggatcctcggcgctgctcaccgcggtgctcgatctctcgtcagcgccgccctcctcgtgtctttcgccgtgctttccttgcgcatagctccgggaccgggcgcgttgttgtgcattgggggagggagtgatggccaacagcgagtaactatgagtatgtcaagagggaattcgagttcgaccgccgcctccctccatccaactggatcgttgttcgcatagacggttgccacttccacagattctcgaagatacatgcctttgagaaaccaaacgatgagaatgttctaatattgatggacacttgtgccactgctatgcttaagaaattccctgacatagtctttgcttatggtgttagtgatgagtacagttttgttttcagagaggagaccgaattctatcacagacgagaaagcaaaattctctcgttatgtgtttcctacttcacttctgtgtacgtgatgaagtggaaagaaatctttcctaacaaagagttgaaggagccaccatattttgatgcgagagctgtatgctatccaaatttgaagactattcgtgattatttggcatggagacaagtggactgtcatataaataatcagtacaacacctgcttctggatgttggttaaatctggaaaaagtgaacaggaggcccaactatcgttgaagggaacatcttcgaaggacaagaatgagttgcttgctcagcaattccaaatgaactatgatgatgaactggctatgttccgcaaaggatccagtgtttaccgagagaaggtagaaacagttgtgaaggatgattatggggaccccataaaaagaacacgaccgatacttacagtagcgcatgttgatatcatagggtctgagttttggcagaatcatcagcacatcctccgtgaagtaaaatgtaggcatgagtttatgaagcagtttgacatcaaccacatgcttccaccctgtaattgggttgttgttcgcatcaatgcctgtcaatttaatcaattcacaacaattcattcatttgacaagccaaatgatgctgttgctctaagcttgatgaatgaatctgcttctttgatgatggagcaatatcctgacatcgcctttggctatggttttggcagcgagtatagctttgtgttccatgagaagactgacttatatcggagacaggagagcttaatcctttcttcctgttcgtcatatttgacttctctttacatgaagaaatggaaaaagttctttccccacaaggaattaatgccaccgccacgttttgaggcagaagctctgtgttgtccaaagctaaaaatcctatgtgaatacttgtcatggagacaagaggaatgtcacactggcaaccaatacaacacatgcttttggatgttagtgaaatctggaagaagtgaaaaggaagctcacgagacattgaaggggacattatcaaaagataaaaacgagttgctttttcagcaatttcaaatgaactacaacaatgaacctgcaatgtttcgaaagggctcgtgttctccggcaaaaggtgcatggcagcgacaatggcgtgacgatagaacggtgggatgtgaaagtggaccacgttgacatcggagctgggttttggcgaaagcacccgtggatccttggtgaatgattacgcctaagacctaacctggcattccgggtatctcttcaggagttcaactttagctcattagttttaaaaaaaattgtcataacaatatcaattaaaacaaaaagggtaaattccccgaaacagtgtgttgcttcatttgcttgcatatgttgttctacggtacaaaaaacatttgtcttttcttatccgacc

SEQ ID NO: 25187 - protein, 437 aa, Panicum virgatum
  misc_feature: Ceres CLONE 1862472
  misc_feature (1)..(200): Pfam Name: Thg1 Pfam Description: tRNAHis guanylyltransferase
  misc_feature (206)..(437): Pfam Name: Thg1 Pfam Description: tRNAHis guanylyltransferase
MDTCATAMLKKFPDIVFAYGVSDEYSFVFREETEFYHRRESKILSLCVSYFTSVYVMKWKEIFPNKELKEPPYFDARAVCYPNLKTIRDYLAWRQVDCHINNQYNTCFWMLVKSGKSEQEAQLSLKGTSSKDKNELLAQQFQMNYDDELAMFRKGSSVYREKVETVVKDDYGDPIKRTRPILTVAHVDIIGSEFWQNHQHILREVKCRHEFMKQFDINHMLPPCNWVVVRINACQFNQFTTIHSFDKPNDAVALSLMNESASLMMEQYPDIAFGYGFGSEYSFVFHEKTDLYRRQESLILSSCSSYLTSLYMKKWKKFFPHKELMPPPRFEAEALCCPKLKILCEYLSWRQEECHTGNQYNTCFWMLVKSGRSEKEAHETLKGTLSKDKNELLFQQFQMNYNNEPAMFRKGSCSPAKGAWQRQWRDDRTVGCESGPR

SEQ ID NO: 25188 - DNA, 718 bp, Panicum virgatum
  misc_feature: Ceres CLONE 1862480
  misc_feature: Encodes the peptide sequence at SEQ ID NO. 25189
gacgcgcgaaaaaaagaaaaaaccgcagccgccggccggattaattcgtgctgcttaagcaaggaccggaggcaaaggcaaggagatagatggaagcgcgaggaaggagatggtcatcggccggggcagcgcggctgcgggtggttctggtgccggtactgctgctgctgctggcggcggcggcggggtcgcgggcgcagctgcaggtggggttctacgacacgctgtgcccggcggcggagatcatcgtgcaggaggaggtcagcaaggcggtgtccgggaaccccggcgtcgccgccagcctcgtccgcctccacttccacgactgcttcgtcaggggctgcgacgcgtccgttctgctggactcgacgccgggcaacacggcggagaaggacgcgcccccgaacacgagcctccgcggcttcgaggtcatcgacagcgccaagacgcggctggagcaggcctgcttcggcgtcgtctcctgcgccgacgtgctcgccttcgccgccagggacgccctcgcgctggtcggaggcaacgcgtaccaggtgcccgcggggcgacgggacggcaacatctcggtggcgcaggagaccaacggcaacctgcctcccccgacggcgagcgtgagccagctgaaccagatcttcggcagcaagggcctcacccaggccgacatggtcgccctctccggcgcgcacaccatcggggacgcgcg

SEQ ID NO: 25189 - protein, 209 aa, Panicum virgatum
  misc_feature: Ceres CLONE 1862480
  misc_feature (54)..(209): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MEARGRRWSSAGAARLRVVLVPVLLLLLAAAAGSRAQLQVGFYDTLCPAAEIIVQEEVSKAVSGNPGVAASLVRLHFHDCFVRGCDASVLLDSTPGNTAEKDAPPNTSLRGFEVIDSAKTRLEQACFGVVSCADVLAFAARDALALVGGNAYQVPAGRRDGNISVAQETNGNLPPPTASVSQLNQIFGSKGLTQADMVALSGAHTIGDA

SEQ ID NO: 25190 - DNA, 720 bp, Panicum virgatum
  misc_feature: Ceres CLONE 1862481
  misc_feature: Encodes the peptide sequence at SEQ ID NO. 25191
aaccaaatgcggcgtcctgctggtgtggtctagcgagccgcgtggtgcttgggctccgttcgttccgttgaggctcgcgtcgatctagcgatggagccccggtgctccgtgatggtcctggccctcgccgccgcgctatccgtcgcagtggcttacgacccgctggacccgaacgggaacattaccatcaaatgggacatcatgtcgtggacgcctgacggctatgtcgcggtggtgacgatcaacaacttccagatgtaccggcagatcatggcgccggggtggacggtggggtggacgtgggccaagaaggaggtgatctggtccatggtgggcgcgcaggccacggagcagggcgactgctcccgcttcaagggcaacatcccgcactgctgcaagcgcacccccgccgtcgtggacctgctgcccggcgtgccctacaaccagcagatcgccaactgctgccggggcggcgtcatcagcgcctacggccaggaccccggcgccgccgtcgccgcgttccaggtcagcgtcggccaggccggcaccaccaaccgcaccgtcaaggtgcccaagaacttcacgctgctcggccccggccctgggtacacctgcggccccgccaaggtcgtcccctccaccgtcttcctcacgcccgaccgccgccgcaagacccaggcactcagtgcgttaattggcgctctcgctgcgcttctcttc

SEQ ID NO: 25191 - protein, 209 aa, Panicum virgatum
  misc_feature: Ceres CLONE 1862481
  misc_feature (45)..(204): Pfam Name: Phytochel_synth Pfam Description: Phytochelatin synthetase-like conserved region
  misc_feature: Useful for making plants with altered carbohydrate content
  misc_feature: Useful for making plants with altered cell wall content and/or composition
  misc_feature: The sequence is a functional homolog of SEQ ID NO 4 in US patent 7109001
  misc_feature: Useful for making plants with altered lignin content
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALSALIGALAALL

SEQ ID NO: 25192 - DNA, 700 bp, Panicum virgatum
  misc_feature: Ceres CLONE 1862494
  misc_feature: Encodes the peptide sequence at SEQ ID NO. 25193
tcaccaccacccgctgctcctcctccgacctcgctacttatcgtgtctgcgctgctcctgctcctgctccggcgccatagagacgtgcatgcgcgcacgtagattggtcggagccgccgatcgagctcgagggtggggtaggtagtagtggagcaggaggtggtggcagactgactggctggtgagttgaagcttgagcgggaggaggaggtgcggactttgcctccggcgggccgcggatcggagatggtgctggatctcaatgtggcgtcgccggaggagtcgggtacgtcgagctcgtccgtcctcaactccggggacggcggcttccggttcggcctgctcgggagccccgtcgacgacgacgactgctccggcgagatggcgccgggcgcctcctcgggattcacgacgaggcagctcttcccgcccccgaccccgccggccgagccggagcgggcggcggcgccggtgccggtgccggtgtggcagccacgccgcgccgaggatctcggcgccgcgcagaggccggtggcggccgcgaagaagacgcggcgcgggccgaggtcgcgtagctcgcagtacaggggcgtcaccttctacaggaggacgggccgctgggagtcgcacatctgggattgcgggaagcaagtctacctaggtggctttgacactgcgcacgcagctgcgagggcgtacg

SEQ ID NO: 25193 - protein, 151 aa, Panicum virgatum
  misc_feature: Ceres CLONE 1862494
  misc_feature (111)..(151): Pfam Name: AP2 Pfam Description: AP2 domain
  misc_feature: Useful for making plants with modulated biomass
  misc_feature: Useful for biocontainment applications
  misc_feature: The sequence is a functional homolog of SEQ ID NO 1114 in the 10/225,066 US patent application
  misc_feature: The sequence is a functional homolog of SEQ ID NO 196 in the 10/374,780 US patent application
  misc_feature: The sequence is a functional homolog of SEQ ID NO 434 in the 11/435,388 US patent application
  misc_feature: The sequence is a functional homolog of SEQ ID NO 640 in the 10/412,699 US patent application
MVLDLNVASPEESGTSSSSVLNSGDGGFRFGLLGSPVDDDDCSGEMAPGASSGFTTRQLFPPPTPPAEPERAAAPVPVPVWQPRRAEDLGAAQRPVAAAKKTRRGPRSRSSQYRGVTFYRRTGRWESHIWDCGKQVYLGGFDTAHAAARAY

SEQ ID NO: 25194 - DNA, 656 bp, Panicum virgatum
  misc_feature: Ceres CLONE 1862494-R
  misc_feature: Encodes the peptide sequence at SEQ ID NO. 25195
agctcatcgtccccgtggcctatgtatcaccaaagccaagcagtaccatctcacgatcagcgcttgtactcatcagcttgtgctggcttctttccgaaccatcaggaaaggaccatgatggagcgaaggcctgagctgggcgcccagcagccgttccccccctgggcatggcaaatgcagggctcccctcacatgccgttgcaccactctgcagcatcatcaggattctctaccgcctccggcggcgcgagcggcggcgtgccgttgccgtctcgccctccggcgacgcagttcccgaaccaccaccaattcttcttcccctaggccgcttgacacttgacagcctgctgctccggctcaattccttgggccaatgggacggcaggagctgatcttgtgcagcttgcttcccggtaacggttgtttattattgggaggaaagcgagagccagaagacgcagtatggctcgtctccctccctggtacggtatgttatggtatggtgcccttgctaaaatatgggctatagctacaatgccttggatttgtcatggttgagatttttctacccatgcatcagtgtatttcttcttctaccggatcatggatgtacacaagctgcttcaggagtttgactccttttgttttaaatttgc

SEQ ID NO: 25195 - protein, 107 aa, Panicum virgatum
  misc_feature: Ceres CLONE 1862494-R
  misc_feature: Useful for making plants with modulated biomass
  misc_feature: Useful for biocontainment applications
SSSSPWPMYHQSQAVPSHDQRLYSSACAGFFPNHQERTMMERRPELGAQQPFPPWAWQMQGSPHMPLHHSAASSGFSTASGGASGGVPLPSRPPATQFPNHHQFFFP

SEQ ID NO: 25196 - DNA, 2505 bp, Panicum virgatum
  misc_feature: Ceres CLONE 1862521
  misc_feature: Encodes the peptide sequence at SEQ ID NO. 25197
aaaaacaaagacagcagccagccgcggcggcaagcaaagcgcgcccctgccctgtccaagccaagcgcggcttcttcgccgcgcccgcaacatcctgccgtgtttgactagcaaagaagcgatgaggcgctccgctcgccggccagcaaaggagtaggagtagtagcaaaagcttctccttcggtgggggatgcagaccgcggcggcggcggccgcggcggcgctgctgctcctcctcctgccgtgggtgcttctgccggcgcatgcggcagccgcgggcaacgggagctgcgcgcggagctgcgggggcttgacggtgcggtacccgttcggcttctcccccggctgcgagatacagctcgtgtgcaacgaccaggccgcgaacggcgccgcgtggctcggggcgcgcgagctgggcctgctcgtgagcaacgtcacggcgcgcgccctcgtcctcaccctgcccccggactgctcccgccggctcgacgcctccgtcaaggcgctcttctcgggcaactacgcgcccggtccccagaacacgctcctcgtgagctcgtgcaaccgcgccgcgcgccccggcaactgcagcgtctcgcccgcaacctacctcaacagctcgtcccactgcttccacggcgctaacgccgagaacttcagctgcgtctcgccgccgctgccgcccagaggcaaccgtttcttcaacgaaaccaagatacgggcgctcggctcggaatgcacaggactggtgtcggcggcggcgagctactgggacgcgccggcgccggcggtcctgctgggcgtgatggaactggagtggtggatgggcgggccgtgcagatgcgcgcccaatgccaactgcacccccatcaccacgccggccgctgggcaggggttccggtgcgagtgccgggaggggttcgagggcgacggcttcgccgccggcaccggctgccggagagtttcagctcccaagtgtaatccttcaaaaaacctagcagaaggctgtggcaggacgatccaaatcgcccttcttgtggcaggaatcgtgtttggtgcccttgtgacgggcgtgacctgcgtggtgtaccagctgctgaagcgccggtcggcgtccatccggacgaagcggagcacgaagcggctcctgtccgaggcctcctgcgccgtgcccctgtactcgtaccgcgagatcgagcgcgccaccgacggcttctccgacgccaagcgcctgggcacgggcgcctacggcaccgtgtacgccgggcggctcggcgacagccgcctcgtcgccgtgaagcggatccggcagcgcgacaacgccgggctcgagcgcgtcatgaacgaagtgaagctggtgtcgtgcgtgtgccactgcaacctggtccgcctcctcggctgctgcatcgagcaggggcagcagatcctggtgtacgagttcatgcccaacggcacgctggcgcagcacctgcagcgggagcgcggccccgccgcggtgccgtggacggtgcgcctccgcatcgccgccgagactgccaaggccatcgcgtacctgcactcggaggtggacccgcccatctaccaccgcgacgtcaagtccagcaacatcctgctcgactacgagtacaactccaaggtcgccgacttcgggctgtcgcggctgggcaaggcgcctctgggggactcctcccacatctccacggcgccgcagggcacgccggggtacgtggacccgcagtaccaccagaacttccacctctccgaccggagcgacgtctacagcttcggcgtcgtgctcgtggagatcatcactgccatgaaggccgtcgacctcacccggccgcccagcgatgtgaacctggcgcagctcgccgtggaccggatcggcaggggccgcgtggacgacatcgtggacccgtgcctggacccgcaccgggacgcgtggacgctctcctccatccacaaggtggccgagctggcgttccggtgcctggcgttccacagcgagatgaggccgtccatggccgaggtcgccgacgagctggaccagatacagcgcagcgggtgggcgccgtcggcggacgacgacgcctacatgtccacgtcgtcgtcgatctgctcgtccgcggcgtcgacgcgcggcacggaccggtcgtcgtggggcgccggcaggagccggacggacagggagagggccgcgcaagaggcggccaggggcggcgtggcggagtctcccgtgtccgtgcaggagaggtggttcagcgaccggagctccccttcctccaacagcttgctgggcagtcgccccctgcactgaactgaaccacgacattgctcgatctactcctgtatgtgtactcaacacgtatcagctaactagtttagttgcacaaaacattgtgcatgattagttgggtgggaacagtgagatcgaattagagacgattatattagttcggttgcaacattgagatcgaaatttcataaaaaaaaatcattgtgatt

SEQ ID NO: 25197 - protein, 708 aa, Panicum virgatum
  misc_feature: Ceres CLONE 1862521
  misc_feature (342)..(618): Pfam Name: Pkinase Pfam Description: Protein kinase domain
  misc_feature: SWISSPROT Homolog: EC 2.7.11.1 Non-specific serine/threonine protein kinase
MQTAAAAAAAALLLLLLPWVLLPAHAAAAGNGSCARSCGGLTVRYPFGFSPGCEIQLVCNDQAANGAAWLGARELGLLVSNVTARALVLTLPPDCSRRLDASVKALFSGNYAPGPQNTLLVSSCNRAARPGNCSVSPATYLNSSSHCFHGANAENFSCVSPPLPPRGNRFFNETKIRALGSECTGLVSAAASYWDAPAPAVLLGVMELEWWMGGPCRCAPNANCTPITTPAAGQGFRCECREGFEGDGFAAGTGCRRVSAPKCNPSKNLAEGCGRTIQIALLVAGIVFGALVTGVTCVVYQLLKRRSASIRTKRSTKRLLSEASCAVPLYSYREIERATDGFSDAKRLGTGAYGTVYAGRLGDSRLVAVKRIRQRDNAGLERVMNEVKLVSCVCHCNLVRLLGCCIEQGQQILVYEFMPNGTLAQHLQRERGPAAVPWTVRLRIAAETAKAIAYLHSEVDPPIYHRDVKSSNILLDYEYNSKVADFGLSRLGKAPLGDSSHISTAPQGTPGYVDPQYHQNFHLSDRSDVYSFGVVLVEIITAMKAVDLTRPPSDVNLAQLAVDRIGRGRVDDIVDPCLDPHRDAWTLSSIHKVAELAFRCLAFHSEMRPSMAEVADELDQIQRSGWAPSADDDAYMSTSSSICSSAASTRGTDRSSWGAGRSRTDRERAAQEAARGGVAESPVSVQERWFSDRSSPSSNSLLGSRPLH

SEQ ID NO: 25198 - DNA, 484 bp, Panicum virgatum
  misc_feature: Ceres CLONE 1862522
  misc_feature: Encodes the peptide sequence at SEQ ID NO. 25199
atttagctctcctagcagaaatggtggtggatatcctcgagtcatgcatggtgacgccgggcgaggcggcaactcccaagcatggcgtgtgcctctccaacctcgacctcctcgtggtcagcaccctcactcccaccgtctacgtctaccggcccagccccggcccggccttcttctcccctgacgtcctcaaagccgccctgtccaaggtgctcgtccccttctaccccctcggcggtcggatctgtcgggacggcgctggccgcccggagatccactgcaccggcgacggcctgctcttcgtcactgctcgcgccgactctacactcttagatctaggcggcttcgtcccgtcggacgagcagtggaggatgcttgtcccctcggccgacggcggcgacgaccgcgcctgcattctggccatgtaccatgtgacgttttttaattgatgcggcgtgtgcatcggccacgctatccatcactc

SEQ ID NO: 25199 - protein, 142 aa, Panicum virgatum
  misc_feature: Ceres CLONE 1862522
  misc_feature: SWISSPROT Homolog: EC 2.3.1.144 Anthranilate N-benzoyltransferase
  misc_feature: Useful for making plants with altered carbohydrate content
MVVDILESCMVTPGEAATPKHGVCLSNLDLLVVSTLTPTVYVYRPSPGPAFFSPDVLKAALSKVLVPFYPLGGRICRDGAGRPEIHCTGDGLLFVTARADSTLLDLGGFVPSDEQWRMLVPSADGGDDRACILAMYHVTFFN

SEQ ID NO: 25200 - DNA, 2122 bp, Panicum virgatum
  misc_feature: Ceres CLONE 1862525
  misc_feature: Encodes the peptide sequence at SEQ ID NO. 25201
atttttcctgccgaattccacacgctctccctcccacgagcacaaatcgaaactcccttctctctctctctctctctggaccaacaggccaagaacacacatacagaggcccagagacaagctgttgctgcagactgtttcttcttcccaattcattgcattcatcatccatgccatcataggaagatagcttatcaccaccagagatcagaggccacttcttagctagtacctcactgtgtccgccccacatggcgctcctgcacaggctcctcaagtgccggcacaatgccgccgccgccgcggcgagcgcctccttcctggtgctcgtgctcgtcttctccgtcctcctggccgccacgaggcacgagcacggcgattcccccgcgatcgcggcgccttccttgctgggcgaagaggaggagccgggggccggctgcgaggcggcgctgcggccgctgccggaccacgcggcgcggtgccggtacctgtcgtcgccggggcggcgcccgccgtgcgcgccggccgggtacgtcgactacctgcgcctcttctactgcggcttcgggcgcgcgccgtggctgggcggcgcggcgctggcgctgtggctgctcgtgctcttctacctcctcggcgacacggcgtcgcactacttctgcgcgtcgctcgaggggctctcggaggcgctgcggctgccgccgtccatcgccggcgtcacgctcctgtctctcgggaacggcgcgcccgacgtgctctccagcgtcgtcgcgttcgcggccggcggcgccgagagcgacgccggggacgtcgggctcagcagcgtgcttggcggcgcgctgttcgtgtccacggtggtggccggcgtggtcgtcatcgtcgcggcggggaggcgagggaacgccgccggcgtgacgatcgagcggcgcgggttcgtgcgcgacgtgtgcttcctcctggtggcgctgtgctacctcgtggccgtgctgctcaccggcaccgtcaccgtctgggccgccgcgtcgttcctctccctctacgccgcctacgtcctcctcgtctggacctcccactgctgcgcggccgccgcggaggaggacgaagatctgggagacggcagcaagaagcccgctgctcataattccgacttcgccgcccctctcctcctcgacggcgacgcgccgtctccgctccccgtctcctgcaaggctaccacgccgccgccgaaaaccttctcccagcgcgccctggacgcgctccactcgccgctgtacctcccgcgccggctgacgatcccggacatcgcggcgcaccggtggtctaagcgctacgccgtggcctcggcgctcctcgcgccgctcctcctggccgccatctcctgcccctccagccccgccgtcctgctcgccgcggcggtggcggggaccgtcctcgcggccgcggcggcccgcgccacggcctccgccgtcccgccggagacccggtgcggccgcctcccgtggctcgccggcgggttcctgatgtccgtgctctggtcgtacatgctggcgcgcgagctggtggccctgctggtggcgatcgggctggtcgccggcgtgaaggcgagcctgctgggcgcgacggtgctggcgtggggcaactcgctgggggacctggtggcggacgtggccctggccgtgcacggcggcgcggctggcgcccagacggcggtgtcgggctgctacgcggggccggcgttcaacacggtggtggggctggggctgtcgctgacgctggcggccggggcccggtacccgcggccgtacgcgatcccggcggacgcgtcggcgtacgaggcggcggggttcctcgcggcggcgctggcgtgggcgctggtggtgctgccggcgcgcgggatgcggctggacagggtgctcggggtgggcctgctcgtcgtctacctcgggttcctcggcgtcaggctgggctccatcagagcatggggatgaatggatgattatatcgttgtcattgggtaatttgggtggccatacccatagtcgattatacatattgattgattgggatgccaattaattcttggataagttaattacatgcatgcacagagatcgtttactgttac

SEQ ID NO: 25201 - protein, 577 aa, Panicum virgatum
  misc_feature: Ceres CLONE 1862525
  misc_feature (126)..(269): Pfam Name: Na_Ca_ex Pfam Description: Sodium/calcium exchanger protein
  misc_feature (426)..(569): Pfam Name: Na_Ca_ex Pfam Description: Sodium/calcium exchanger protein
MALLHRLLKCRHNAAAAAASASFLVLVLVFSVLLAATRHEHGDSPAIAAPSLLGEEEEPGAGCEAALRPLPDHAARCRYLSSPGRRPPCAPAGYVDYLRLFYCGFGRAPWLGGAALALWLLVLFYLLGDTASHYFCASLEGLSEALRLPPSIAGVTLLSLGNGAPDVLSSVVAFAAGGAESDAGDVGLSSVLGGALFVSTVVAGVVVIVAAGRRGNAAGVTIERRGFVRDVCFLLVALCYLVAVLLTGTVTVWAAASFLSLYAAYVLLVWTSHCCAAAAEEDEDLGDGSKKPAAHNSDFAAPLLLDGDAPSPLPVSCKATTPPPKTFSQRALDALHSPLYLPRRLTIPDIAAHRWSKRYAVASALLAPLLLAAISCPSSPAVLLAAAVAGTVLAAAAARATASAVPPETRCGRLPWLAGGFLMSVLWSYMLARELVALLVAIGLVAGVKASLLGATVLAWGNSLGDLVADVALAVHGGAAGAQTAVSGCYAGPAFNTVVGLGLSLTLAAGARYPRPYAIPADASAYEAAGFLAAALAWALVVLPARGMRLDRVLGVGLLVVYLGFLGVRLGSIRAWG

SEQ ID NO: 25202 - DNA, 1175 bp, Panicum virgatum
  misc_feature: Ceres CLONE 1862535
  misc_feature: Encodes the peptide sequence at SEQ ID NO. 25203
gtgtcactgaccatcctgctcctcccctcgcatccctcccgaatccgcctcgccggcggccaggtcgtctccccggcacccgccatcgccggccgagccctcttcgccaagatcgcacagcgcgtccagcacagcgtcgagcgcccactccgcagcttcaggcgatgcctctggtggaaccgcggcctcgtcgctgaccgcagccatggagcagagtagcggtgggatgccaaggcagcgaagggatgtcagctcaacaagtcactcgggcaactcggatgcggttgctgaagacatgagtggtattccacatgaaactgcgaaacattaccaagacgtggaatcagagaagacaggggtcccaccttgcaagaagagttaccacagcttcaatgagtgcagtagtttaaaaaatcttgaaaggaccaaatgcagatggtcaccagaggaagatgagctactcactcaattggtaaacaaacatgggaccaaaaactggcaaactattgcatgtgctttacctgaccgaaatgcacatgcatgcttatcaagatggaaatacattctagacccagcaataaacaaagaggcttggtcgcaacaagaggagctaagattgattcgtgcacatcaaatatacggaaacaagtggtgcaaaatggccaaacatttcccagggaggacaaataatgcactcaaagaacactggaggggttctatgaaaagaaaactggattcatatttaacctcaggattgctcgaacaagttcccgaccttcatgaaaatctatcaattccacagagcaatcagtcagatattccaaaggacagcaaagtttcatctgatagaattcgattttcatcaattatatcgacaaggtccaaatttaaacaaaagatcagagaactaagtgaagatgctgatgcttcagtaggagaaagctctgacttcatctatgctaaagcatttgatgcccattcaaccagagtctctgaaaatataatagctaaaccgcagcagtgtgcgacagcgagaaagaaactggatttggtgtcaagcccagtgaagctcaagagtgatgtaccacctgaaactgtcaaacaacattgtcaagaaattgaatcagaaaagacagagggcccaccatgcaagataaatggctactgcttcaagc

SEQ ID NO: 25203 - protein, 323 aa, Panicum virgatum
  misc_feature: Ceres CLONE 1862535
  misc_feature (75)..(121): Pfam Name: Myb_DNA-binding Pfam Description: Myb-like DNA-binding domain
  misc_feature (127)..(172): Pfam Name: Myb_DNA-binding Pfam Description: Myb-like DNA-binding domain
MEQSSGGMPRQRRDVSSTSHSGNSDAVAEDMSGIPHETAKHYQDVESEKTGVPPCKKSYHSFNECSSLKNLERTKCRWSPEEDELLTQLVNKHGTKNWQTIACALPDRNAHACLSRWKYILDPAINKEAWSQQEELRLIRAHQIYGNKWCKMAKHFPGRTNNALKEHWRGSMKRKLDSYLTSGLLEQVPDLHENLSIPQSNQSDIPKDSKVSSDRIRFSSIISTRSKFKQKIRELSEDADASVGESSDFIYAKAFDAHSTRVSENIIAKPQQCATARKKLDLVSSPVKLKSDVPPETVKQHCQEIESEKTEGPPCKINGYCFK

SEQ ID NO: 25204 - DNA, 2268 bp, Panicum virgatum
  misc_feature: Ceres CLONE 1862543
  misc_feature: Encodes the peptide sequence at SEQ ID NO. 25205
gcggacggccttcctcgatcgatctccctctccctccccgaccccacttcctcttcctcctgattccttcctataactaactacaagccgccggtttcttcgggaccgtgagaaagaggaaacccttcccaagtcccaacccccacgaatcgagactcctccgctcttcccgacccgccgacgccggtcctcctcctcctcctcctggttcgccgccatgttggaggagctgctcatcttcacgcggggcggcctcatcctctggtcctcgtgccgggcgctcggcgccgccgccctcaagggctcgcccatcgacgccctcatccgatcctgtctcctcgaggaccgctccgccgacgccagcttctcccaggacaactacgccctcaagtggaccttccacaacgacctcggccttgtctttgtcgccgtctaccagaagattctccatctcctctacgtcgatgatctcctcgccgccgtccgcaaggacttctcccagatttatgatcccaagcgcaccaactatgacgacttcaccgacatattccgccagctccatctcgaggcccaagcgcgtgccgaggacatgaacaagtacaagcaggccatttcgtcccgtccgctgccagccgtctcccacaagactgctcccaaggctcgcggcgctggcacccgtgctacgaccaagggtggcgcctctaggaaggatgactctgatggggaatcatccggcaaggaccaccacactctggcaaatggtagccacgagaatgctgctcccaaggacagctctcatacccgccctgctgttgttaagggcaaggagaacgggggccccaaagacaacggggccttcgatgtaactaaactacagaggttgcgaaagaatgataggaaaaacactggtgctgacaacggaaccaagaagctgaccaaacctgacacaaagaagaaagggaagcaagacagggtgtgggatgacaaaccttccaacaagaagttggatttcacagacccagccgatgagagaggggatgaggtgacagaacatgtggcactcaaccagggagatagcatgatggataaggatgagaacctcagcagcgacagcgaggaggaagtggtcgaagatggaccgaagaagaaaggctggttctcctcaatgtttcagagtattgctggtaacaatgtattggagaagtctgatttgcaacctgctctcaaggctctcaaagatagactgatgacaaagaatgtggcagaggaaattgctgagaagctttgtgaatctgttgcagctagccttgagggcaagaagctaggatcattcacaagaatatcatctacagtccagacagctatggaggaggctcttcttcgcattttgaccccaaggcggtctattgacatactgagggatgtacacgctgccaaggagcgtgggaagccatatgtcattgtttttattggggtgaatggagttggcaaatcaaccaatcttgcgaaggttgcttattggcttcttcagcataacctcagtgtaacgcttgcagcatgtgacaccttcagatctggtgctgttgagcagctgcggactcatgcacgcaggcttcagatacctattttcgagaagggttatgaaaaagatccagcagttgtagcgagggaagctattcaggaagcaagccgaaacaaatcagacgttgttcttgttgatactgctggacgtatgcaggataatgagccactcatgagggcgctctccaagctcatcaatcttaacagcccagatttagttttgtttgttggagaagcattggttgggaatgatgctgtcgatcagctcactaagttcaaccagaaattagcagacctgtctgctgttcctactgctagattaattgatggtatcctgctcaccaagtttgacaccattgacgacaaggttggggcagcgctttccatggtgtatatatctggagctccggtcatgttcgtcggttgtggccagtcctacacggacctgaagaagctgaatgtgaaatccatcgttaagaccctcctgaagtgaaggaaatgcattgtgttgagctgtaccgcacaattctgttccatctttatatccccagtgaccttgtcatgttcatgttggacgtcgtggatctgtgatactgctgtacttgtgtatgagtaactcttgtcatgtgtacttgtgtttacttggtcgtcttgcttcaataatacaacgtatgagttcaaatgggt

SEQ ID NO: 25205 - protein, 618 aa, Panicum virgatum
  misc_feature: Ceres CLONE 1862543
  misc_feature (411)..(618): Pfam Name: SRP54 Pfam Description: SRP54-type protein, GTPase domain
  misc_feature (27)..(308): Pfam Name: SRP-alpha_N Pfam Description: Signal recognition particle, alpha subunit, N-terminal
MLEELLIFTRGGLILWSSCRALGAAALKGSPIDALIRSCLLEDRSADASFSQDNYALKWTFHNDLGLVFVAVYQKILHLLYVDDLLAAVRKDFSQIYDPKRTNYDDFTDIFRQLHLEAQARAEDMNKYKQAISSRPLPAVSHKTAPKARGAGTRATTKGGASRKDDSDGESSGKDHHTLANGSHENAAPKDSSHTRPAVVKGKENGGPKDNGAFDVTKLQRLRKNDRKNTGADNGTKKLTKPDTKKKGKQDRVWDDKPSNKKLDFTDPADERGDEVTEHVALNQGDSMMDKDENLSSDSEEEVVEDGPKKKGWFSSMFQSIAGNNVLEKSDLQPALKALKDRLMTKNVAEEIAEKLCESVAASLEGKKLGSFTRISSTVQTAMEEALLRILTPRRSIDILRDVHAAKERGKPYVIVFIGVNGVGKSTNLAKVAYWLLQHNLSVTLAACDTFRSGAVEQLRTHARRLQIPIFEKGYEKDPAVVAREAIQEASRNKSDVVLVDTAGRMQDNEPLMRALSKLINLNSPDLVLFVGEALVGNDAVDQLTKFNQKLADLSAVPTARLIDGILLTKFDTIDDKVGAALSMVYISGAPVMFVGCGQSYTDLKKLNVKSIVKTLLK

SEQ ID NO: 25206 - DNA, 2565 bp, Panicum virgatum
  misc_feature: Ceres CLONE 1862546
  misc_feature: Encodes the peptide sequence at SEQ ID NO. 25207
atctctgcctttctgctctttcccctccacccctgctccccacatcgactccattgctgccttcccaccaaatcccatcccccccaccccaccgaattccctagtctcccgccggattcgcccagttcgtcagcttcggagctcgattcgtccccgaagctgcggcctgggctgccaatttgctcggtttgtggtctttcttattcgcgtcagtatttttttttttcactggaatatttcggtgattcgcgccgtatgagctcgtattggtggtggtgtttctgattcttgcttgccggagctggaggcccgagggcatgtgggtttctctggtgtggatccggggctgcgtgggagtcacgttcgtcgatttccagagcgggaggggagctgactagatctctcggcacctgaggttgctgctctccttcaaagagcccgagaggctagctgcgatcggaggttcatcaagggttttggcaggtgagcgcggacatggaggccgccaggctcggcgcgcagagcagccacttgtacggcagcgggctgggtgagcttgacctgaacaggcgtgagaacagggtgtttggatgggacctcaacgactggaactgggacagtgagcgctttgttgccacgccggtgccaactgctgcggcgaatggctcaggattgaacagctcgccatcatcatccgaggaagccgaggcagaggtggctaggaatggtggccatagaggcgactctgataagaggaaaagggtagtggtaattgatgatgatgatagggaggatcaggacatgattgtgaacggtggcgggtcgttgagcttgagaattgggggtagtgctgttggtgtcggagtgatggagagcagtgatgtaaacgaggatgacagaaatggaaagaagatccgggtgcaagggggcagctcaaatgggcccgcatgccaggttgagggctgtggggctgatctgtctgcagctaaggattaccaccgccggcacaaggtctgtgagatgcatgctaaggccagcaccgctgttgtcgggaacaccgtccagaggttctgccagcaatgtagtagatttcaccttcttcaagaatttgatgaagggaagcgaagttgccggcgacgtttagcaggccacaatagacggaggaggaaaacccgccctgatatcgcaattggtgggactgcttcaattgaggacaaagttagcaattatctattgttgagtcttattgggatttgtgctaatttgaactctgacagtgttcagcattcaaacagccaggagctgctatccactcttttaaagaacctagggtctgttgccaaatcactggagccaaaagaactctgtaaactcctggaggcatatcaaagcctgcaaaatggatcaaatgctggaacctctggaacaactaatgctgcagaagaggctgcagggccatctaactctaagttgcctttcgggaatggtagtcatcgtggacaggcatcatcatctgttgtgccagtacaatcgaaggctactgtggtggtaactccagagcctgcatcatgcaagctcaaggattttgatctgaatgacacttgcaacgatatggaaggctttgaggatgggcaagaaggttcacctacacctgcttttaaggcagctgattctcctaattgtgcatcatggatgcagcaagattctactcaaagtccaccacaaactagtggcaattcagattcaacatcaacacaatcattgtcaagctcaaatggagatgctcagtgccggactgataagattgtcttcaagcttttcaacaaagttcccagtgatttacctccagttttgcggtcacagattcttggttggttgtcaagtagccctaccgatatagagagctatattagacctggctgtattattctaacagtataccttcggctagttgagtctgcatggagagagctttctggtaatatgagcctgcacctggacaagcttttgaatagctccactgacaacttttgggcatcaggcttggtgtttgtgatggttcgacaacagttagcttttatgcacaatggtcaaattatgttggacagaccactggcacccagttctcaccaatactgcaagattttacgtgtcagaccagttgctgcaccttattccgcaacaataaatttcagagtagaaggttttaatctactcagtacttcctcgagggtaatttgttcatacgaaggatgttgtatattccaggaagacacagataccgtagcagacgatgctgaggacatcgaatgcctcagtttttgttgttccgtccctggttcaaggggaagaggatttatagaggtcgaagatagtggatttagcaatggcttcttcccctttataattgctgagaaggatgtatgctctgaggtttctgagctggagagcatatttgagtcctccagtaacgaatatgcagttgttgatgataatgccagggaccaagccttggagtttctaaatgagttgggttggcttcttcatagagcgaacagaatgtct

SEQ ID NO: 25207 - protein, 689 aa, Panicum virgatum
  misc_feature: Ceres CLONE 1862546
  misc_feature (151)..(229): Pfam Name: SBP Pfam Description: SBP domain
  misc_feature: Useful for making plants with altered terpenoid content
  misc_feature: Useful for making plants with modulated flowering time
MEAARLGAQSSHLYGSGLGELDLNRRENRVFGWDLNDWNWDSERFVATPVPTAAANGSGLNSSPSSSEEAEAEVARNGGHRGDSDKRKRVVVIDDDDREDQDMIVNGGGSLSLRIGGSAVGVGVMESSDVNEDDRNGKKIRVQGGSSNGPACQVEGCGADLSAAKDYHRRHKVCEMHAKASTAVVGNTVQRFCQQCSRFHLLQEFDEGKRSCRRRLAGHNRRRRKTRPDIAIGGTASIEDKVSNYLLLSLIGICANLNSDSVQHSNSQELLSTLLKNLGSVAKSLEPKELCKLLEAYQSLQNGSNAGTSGTTNAAEEAAGPSNSKLPFGNGSHRGQASSSVVPVQSKATVVVTPEPASCKLKDFDLNDTCNDMEGFEDGQEGSPTPAFKAADSPNCASWMQQDSTQSPPQTSGNSDSTSTQSLSSSNGDAQCRTDKIVFKLFNKVPSDLPPVLRSQILGWLSSSPTDIESYIRPGCIILTVYLRLVESAWRELSGNMSLHLDKLLNSSTDNFWASGLVFVMVRQQLAFMHNGQIMLDRPLAPSSHQYCKILRVRPVAAPYSATINFRVEGFNLLSTSSRVICSYEGCCIFQEDTDTVADDAEDIECLSFCCSVPGSRGRGFIEVEDSGFSNGFFPFIIAEKDVCSEVSELESIFESSSNEYAVVDDNARDQALEFLNELGWLLHRANRM

SEQ ID NO: 25208 - DNA, 708 bp, Panicum virgatum
  misc_feature: Ceres CLONE 1862557
  misc_feature: Encodes the peptide sequence at SEQ ID NO. 25209
acctttagctttcctccctccctccctccggtccttccctctcctctcctcttccattcctctaactagtcctagccattcagatcctaagttgctggccttgctgcttcttgttggagaaagatttgttggttccaagttggaagtatcatgagtccaccgagtgtgatggggcaatttggagacacaacctataccaaggttttcgttgggggactcgcatgggaaacccagaaggagaccatgaggaagtacttcgagcagtttggggagatcctggaggccgttgtcatcacagacaagaataccggcagatccaagggctacggatttgttaccttccgggacccggatgcggcgatgagagcttgtgttgatcctgcgccggtgatagacgggaggagggctaactgtaatctggcttcacttggggttcaaagatctaggcctccaacaccccagcatggaggagctaggagcttcagggtgatgaaatccttcagccagcaggcagggatccaaggtggactgggcgcagcttttccttcccatgccaccttccctcattataccatcccacaaggcctcccctaccatgtctatgggtactctccctatactccagactatggctatccaacaaacttctacaatatctatggaggagcccagtacccattttatggaggagcagcagctggcatggtg

SEQ ID NO: 25209 - protein, 179 aa, Panicum virgatum
  misc_feature: Ceres CLONE 1862557
  misc_feature (12)..(82): Pfam Name: RRM_1 Pfam Description: RNA recognition motif. (a.k.a. RRM, RBD, or RNP domain)
  misc_feature: Useful for making plants with modulated biomass
MGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARSFRVMKSFSQQAGIQGGLGAAFPSHATFPHYTIPQGLPYHVYGYSPYTPDYGYPTNFYNIYGGAQYPFYGGAAAGM

SEQ ID NO: 25210 - DNA, 712 bp, Panicum virgatum
  misc_feature: Ceres CLONE 1862566
  misc_feature: Encodes the peptide sequence at SEQ ID NO. 25211
ctcgcctgagtcgccccgcctccgatcgaatcgaaccgggtgggcttgcttcgcctcgtttcgtctcgtctcggctctcagcctctcaggaaaccgcaacgagattcctcgcgcgcgcggctcagcagatcgcgcgagcgcgagagggaggagcatgggatcggagggacggggctggaacggcgctggcgacggcgccaggggcggggaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcatcgctggacagctcgtgcttctccatcgagacggtgtctggcggcatcacgaatctattgctgaaggtatctgtaaaagaagaaactggaaatgagttttctgttactgttcgtttgtatgggccaaatacagacttggtgattgatcggaaaagggaattgcaggtaagaatttgaattgaaccagattatgtgtgttgcagtcatattatatttacctacatcctataaatattcctccttgattctagcattagtccttctgttgttgctgtagttttgttgtggtacatattcgatttctttgatagagagtaatcttggttttgtagtagcatttattctattaagttc

SEQ ID NO: 25211 - protein, 126 aa, Panicum virgatum
  misc_feature: Ceres CLONE 1862566
  misc_feature: SWISSPROT Homolog: EC 2.7.1.32 Choline kinase
MGSEGRGWNGAGDGARGGEEKPTTTAAVAAGAPADVPTSAASVDISLPLPEMTPHIIGLCKGSVKGWSSLDSSCFSIETVSGGITNLLLKVSVKEETGNEFSVTVRLYGPNTDLVIDRKRELQVRI

SEQ ID NO: 25212 - DNA, 734 bp, Panicum virgatum
  misc_feature: Ceres CLONE 1862580
  misc_feature: Encodes the peptide sequence at SEQ ID NO. 25213
acgagcagttgtcgagcaccccgcgactcccaagcggagcttgactcttcaatccccttccccgcgcacgctttcttcggaccatccgccgccgccgacgccgccctcgtgccctcaccgtgccactcccgccggcgccagcctcctctcctccctctctgccgcgcgtcgcatcgcgcggctgccgtcgtcctggcgaagcgcgggggcggctccggcccgatcagaggcgcccggtgaggcggcgcggggccgaccgtgggggaggcgcacggcggtggggcggcccgtgtagagaatgatctacacggcgattgacaccttctacctgacggacgagcagctgcgggactcgccgtcgcggaaggatgggatcagcgaggccaccgagaccgcgctccgcgtctacggatgcggcctcatccaggagagcggcatcctcctcaggctaccacaagcagtgatggccacagcacaagtattgtttcatcgcttttactgcaagaaatcatttgttcgatttagtgcaaagagagttgctgctagctgtgtttggctggcagggaagttggaggagagtcctagaaaatcgaagcatattatatttgtattccatagaatggaatgtaggagagaaaatttgccaattgcatatttagatgtcttctcaaagaaatactcagaactgaggcatcatctgataaggacagaacggcatctgttgaaagagatgg

SEQ ID NO: 25213 - protein, 145 aa, Panicum virgatum
  misc_feature: Ceres CLONE 1862580
  misc_feature (5)..(131): Pfam Name: Cyclin_N Pfam Description: Cyclin, N-terminal domain
MIYTAIDTFYLTDEQLRDSPSRKDGISEATETALRVYGCGLIQESGILLRLPQAVMATAQVLFHRFYCKKSFVRFSAKRVAASCVWLAGKLEESPRKSKHIIFVFHRMECRRENLPIAYLDVFSKKYSELRHHLIRTERHLLKEM

SEQ ID NO: 25214 - DNA, 617 bp, Panicum virgatum
  misc_feature: Ceres CLONE 1862582
  misc_feature: Encodes the peptide sequence at SEQ ID NO. 25215
accaagggagcagtacccgcgcatgtttacctgcttcgccgggcgcgcctcctccaccgcatcgagcatcgtcgccagcagcctcgccgcccgccgcaggctcatcatgagcaagcccgtcttcgccgcccacagcgccgtcgcgggcatggacgccgtcgagcgcttgaagagcgggttcgagcagttcaagacccaggtctatgacaagaagccggagctgttcgagccgctcaaggccggccaatcccccaggtacatggttttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggaga

SEQ ID NO: 25215 - protein, 198 aa, Panicum virgatum
  misc_feature: Ceres CLONE 1862582
  misc_feature (72)..(198): Pfam Name: Pro_CA Pfam Description: Carbonic anhydrase
  misc_feature: SWISSPROT Homolog: EC 4.2.1.1 Carbonate dehydratase
MFTCFAGRASSTASSIVASSLAARRRLIMSKPVFAAHSAVAGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILE

SEQ ID NO: 25216 - DNA, 638 bp, Panicum virgatum
  misc_feature: Ceres CLONE 1862613-R
  misc_feature: Encodes the peptide sequence at SEQ ID NO. 25217
ttcgaggtcgtggggcacgcggccaccgacgacgaggtgtcgcgcatgatggaggaggccgacgcggacggcgacggcgccatcagcctgcccgagttcgccgcgctcgtgcgctccgccgacgccgacgccggcgccgtcgaggaggacctgcgccacgccttcatggtcttcgacgccgacggcaacggcctcatcacgcccgccgagctcgcgcgcgtcctgcgcggcctcggcgaggccgccaccgtcgcgcagtgccgccgcatgatccagggcgtcgaccgcaacggcgacggcctcgtctccttcgacgagttcaagctcatgatggccgccggcggaggcttcggcagggtgtcctcctcttcgttttcttagggaacacgcactgccctcggctgctctgctcgcctcggctctcacaaattgggttccttcgttgaattgctctgtacatacgtaacagcgagatccaagagatcatcgtcaccaaagtaatcactactaggaggcccacatcacacggacaaaaccacataaacaaatagcacgattggttttgtatatatacatacctatattgcccgtgtgcatccgttgtatggatgttgaatgatttgttctggtttcggttc

SEQ ID NO: 25217 - protein, 126 aa, Panicum virgatum
  misc_feature: Ceres CLONE 1862613-R
  misc_feature (86)..(114): Pfam Name: efhand Pfam Description: EF hand
  misc_feature (12)..(40): Pfam Name: efhand Pfam Description: EF hand
  misc_feature (50)..(78): Pfam Name: efhand Pfam Description: EF hand
  misc_feature: SWISSPROT Homolog: EC 2.7.11.1 Non-specific serine/threonine protein kinase
FEVVGHAATDDEVSRMMEEADADGDGAISLPEFAALVRSADADAGAVEEDLRHAFMVFDADGNGLITPAELARVLRGLGEAATVAQCRRMIQGVDRNGDGLVSFDEFKLMMAAGGGFGRVSSSSFS

SEQ ID NO: 25218 - DNA, 1398 bp, Panicum virgatum
  misc_feature: Ceres CLONE 1862613
gtccatgagttctcagtcaggtctcttcatttcattctcatcccccctctctctcctctctagggttcctttctctcctctcgcattcagcggcgacgctcgcgtccccggcggcggcgtgcactcctggatcctgcaccccccctccccccgtgcggtgttatagggatgggcggcgcagattaggccctgcaagcacatgtgggatccggcgagggcatccgctgtggttggaggagggactaatgattcagacaggtttttgggagatcaggggagggggatttcactctcacgcactaaatgctgtgaatcgtggcacacaccagtcctttgcattggaggtcctggcattcagggtgcgcctggtgccagcgctagtgcagcaagaacccgtgctcgggtttatgttcggtgtatggctgcagtgcagagtttcactgatcgaggtggatagcagcagctcgtcttttggctctgacgaagagatgagcttagttgaagaagaaattgaagagagtacgagtctgtgcaatcagctgctgcctagtgatcgcagattcagacactaacacatctgacttctccagattattaatctgttctttgatcaactaagaactgagtaatgtgagggaaggaggctgcccaaacaatttgtgaacatctaaaggacaaaccatggtttacattactctgcaagaagatgcagatgcaacaagatatgaatgagctcatacaatgctttgacagtcaaaacaagtgatgcttcactttacacgcttcaacaaaaaggaccggtgggggtgaggcttgaccaacagcgtgcatgtgaagaatttggccaaacaactttgtagatctagcaattctactaggggcagttgaataagcaaaggtggttcagattgtgtccttcggcagtgaggctggtgggaggaggaagcctaaaatcgcacaatttttttgggtttgtacatttacaaaattgcttcagagtttattacgatatgctttcaactttcaacaaaagtgatttttaggtctgcatgagaaaaaatatcatcgaaaaatattgaagtgagattttgttttgatggttttgttgagggcaactcaatggtgcaatcagattttaattttgaagctcaggggtgaagttatggacccttcatcacccatcaatcgagcacctcctccaatcttcaaggcatccatcgatcaccagcagcgcgtgccgtgtagagagacagagagagagtcaccggagaagggaggaatcgccaccgccaccgccatgggcaaggtccgctccttcttctcccgcagcggcaagcgctgcgccggctcgtcctcgccgtcctcctccgcggcgggcagcgcgccgtcgtccccgtc

SEQ ID NO: 25219 - DNA, 2029 bp, Panicum virgatum
  misc_feature: Ceres CLONE 1862626
  misc_feature: Encodes the peptide sequence at SEQ ID NO. 25220
aacgcggcacgcaaccggccaggagcgatccaatccggcaagtaaaaggaaagaaaagggaggtaaagagcagccgcgacaccgcggcggcggtggcatcgatcctcacctgcggaagggaaggaaggaaggaagccaagacagggacgcaagccgagctggaaagttgggccttttcttggcaggcggagggagatattattatcctgtatcaccaacccgcgccgaccttcgcctataagaagaccggaggtgggaggagggagctccttcttctttacaagcacaagttgttctctacttctctttggttctgtgtgctccgctaggtgagtcaaacaaatggggattgggaatggatcatcaagcgatgtgctgttcacatcacacaaggtgatgcaagatgagaccacgccgcttctcccaattaaagctgaagaggatgcaattcacgaattcaacggagcttctttctctggtgcagtgttcaatctgtcaacgaccatagtaggggctggaatcatggctctgccagcgagtatcaagatgctaggcctcatccctggtattctgatgattgtccttgtggcattgctcactgaggcatccattgacatgctggttaggtgcagccaccagggcaagattacatcctacgggtggttgatgggtgacacttttgggcagtgggggaggattgcactgcaggtgtctgtggtgataaacaatattggcgtgttgatcgtatacatgattataattggggatgtcctatcaggaacatcaacaactggtgttcatcacagtggcatctttgaggggtggtttggacctcatgtatggaattctcgccctgttgttctccttgccacaactcttcttgtgtttgctccattggtgagcttcaagcgtttggattcattgagatacacatctgcgctatcagttgctcttgctgtggtttttgttgtcatcactgctggagttgcaattgtcagactcatcgaaggaactgtggagatccccaaactctttcctgagatagatggaattagttctgtctggaaactgttcacagctgtgcctgttcttgttactgcctacatctgccactacaatgttcacagcattgacaatgagctagaggacaagactcaaattaaaccaattgtgcaaacttcactaggactctgctcaagtgtttacattgcaacaagcttcttcgcatatctcctctttggtgaggctaccctggctgatgtgctcgccaattttgattccgatcttcgcattccgttcagcgctgtgttcaacgatatagtgagagtgarctatgtggtccacatcatgctcgtctttcctatagtcttctttgcccttaggcttaacttggatgggctgctctttcccactgcaaggcacatttctcgtgacaaccaaaggttcaccatcatcacaatttccctccttgctgtgatttatcttgcttccatcttcataccgagcatctgggacgcgttccaattcactggcgcgacagctgctgtgcttatcggtttcatctttcctgccatgattatactcagggacccttatggtgtttcaaccaagcgtgacaagattttggctgtaaccatgattgttcttgctgtggtctcaaactctgtggccctgtacagcgacacgcttaacatcttctataggaaacaggaggcctagaatccatacctcgatggaaacagaagttctctgtacagttaagagtgattgttgagctcaagttacaactacgcagcggagctgaggtgatttcattgtggtcaataatttttgttttggttgctttgagatgatccggtttgccgcatttgtctattttgctgaacatatgccacttgtgatatgatcagccgtgcttgtattgatgccactgaaaggaacacttttgtttcctgtggttgtttattcagtcatcttgtaatggatggcctgaaaaaacctgtttatataaaataatgcaattacaact

SEQ ID NO: 25220 - protein, 458 aa, Panicum virgatum
  misc_feature: Ceres CLONE 1862626
  misc_feature (40)..(446): Pfam Name: Aa_trans Pfam Description: Transmembrane amino acid transporter protein
  misc_feature (330)..(330): Xaa is any aa, unknown, or other
MGIGNGSSSDVLFTSHKVMQDETTPLLPIKAEEDAIHEFNGASFSGAVFNLSTTIVGAGIMALPASIKMLGLIPGILMIVLVALLTEASIDMLVRCSHQGKITSYGWLMGDTFGQWGRIALQVSVVINNIGVLIVYMIIIGDVLSGTSTTGVHHSGIFEGWFGPHVWNSRPVVLLATTLLVFAPLVSFKRLDSLRYTSALSVALAVVFVVITAGVAIVRLIEGTVEIPKLFPEIDGISSVWKLFTAVPVLVTAYICHYNVHSIDNELEDKTQIKPIVQTSLGLCSSVYIATSFFAYLLFGEATLADVLANFDSDLRIPFSAVFNDIVRVXYVVHIMLVFPIVFFALRLNLDGLLFPTARHISRDNQRFTIITISLLAVIYLASIFIPSIWDAFQFTGATAAVLIGFIFPAMIILRDPYGVSTKRDKILAVTMIVLAVVSNSVALYSDTLNIFYRKQEA

SEQ ID NO: 25221 - DNA, 1320 bp, Panicum virgatum
  misc_feature: Ceres CLONE 1862663
  misc_feature: Encodes the peptide sequence at SEQ ID NO. 25222
gaagctggtactgggctcctggcggtcgccgcccttgcctccagcaacacccaccaatccacggcgatctacggcctactcgctcctcccgaaaccctagcccacgcatccaccctacgtcgtcgccgtccgcctccgccctcgcccttgtcttgccgcctccacaccccaaaccctagacccttgctggtgtggccgatgggcaaacgcgaccgcgaggaggtggacgagctcgccgatgggggcgccgccgagaagcgcccgcgcgcggagggcgcgtcgctgctagggctcgcgagttacgaggatgacgaagatgaggaagcggccaggggccaggcaaaaggccatcgcgctgaggggaacggggaggagggcgaggacgaggacgacgaggaggacgatgtgaggagggctccggagaggcggccgaggcaggtggagctgcgccgtgactgcccttacctcgacaccgtgaacagacaggtccttgattttgattttgagaagttctgttcaatatccttgtcaaatttgaatgtgtatgcgtgcttggtttgtggaaagtatttccaaggaagaggcttgaaatctcatgcttatacgcacagtcttgaagcaggccatcatgtgttcattaatcttcaaaccgagagggcttactgtcttcctgatggatatgagataaatgatccatcactagaagatattcgccatgttctgaacccaaggttcacgaaagagcaggttctaaatctcgacaagaacaagcagtggtctagagcacttgatggttccaattatgtacccggaatggtcggtcttaacaacatcaaggagacagattttgtgaatgtcacaatacagtcattaatgagagttactcctctgagaaatttctttcttatccctgaaaattatcaacatagcaaatcaccattggttcatcgttttggggaactgacacgcaagatttggcatgctaggaacttcaaggggcaggttagtccccacgagtttctgcaagctgttatgaaggccagcaacaagcggtttcagattggtgtacagtcagatcctgtggaatttatgtcatggctcttgaatacactgcatgcaaaattaaaaagttcaaagaagaaaaacagaagcataatacatgattgctttcagggagaacttgaagttgttaaggaagttcacaggaagcatataatggaaaaaaaagaagatggtgctgagctcaatggtgatgcaggttcagcggttggagcagcagatggtactgtcacggaaacatctaaggtcccattcttgatg

SEQ ID NO: 25222 - protein, 373 aa, Panicum virgatum
  misc_feature: Ceres CLONE 1862663
  misc_feature (204)..(373): Pfam Name: UCH Pfam Description: Ubiquitin carboxyl-terminal hydrolase
  misc_feature: SWISSPROT Homolog: EC 3.1.2.15 Ubiquitin thiolesterase
MGKRDREEVDELADGGAAEKRPRAEGASLLGLASYEDDEDEEAARGQAKGHRAEGNGEEGEDEDDEEDDVRRAPERRPRQVELRRDCPYLDTVNRQVLDFDFEKFCSISLSNLNVYACLVCGKYFQGRGLKSHAYTHSLEAGHHVFINLQTERAYCLPDGYEINDPSLEDIRHVLNPRFTKEQVLNLDKNKQWSRALDGSNYVPGMVGLNNIKETDFVNVTIQSLMRVTPLRNFFLIPENYQHSKSPLVHRFGELTRKIWHARNFKGQVSPHEFLQAVMKASNKRFQIGVQSDPVEFMSWLLNTLHAKLKSSKKKNRSIIHDCFQGELEVVKEVHRKHIMEKKEDGAELNGDAGSAVGAADGTVTETSKVPFL

SEQ ID NO: 25223 - DNA, 708 bp, Panicum virgatum
  misc_feature: Ceres CLONE 1862663-R
  misc_feature: Encodes the peptide sequence at SEQ ID NO. 25224
tctagtaaattttcctgtgaagaatttggaattgaaggattacattccattacccaagcccaaagaaaatgacaagctacggtcgaagtatgaccttatagcaaacattgtccatgatgggaagccaggtgaaggatgctacagagtgtttgtacagcggaaatcagaagaggcctggtatgagatgcaggatctccatgttactgaaactcttcctcaaatggtagctctttcagaagcctacatgcaaatatatgagcagcatgaatgagtcgcagtggtcatcgtgtagccttccacagccagtgtttttgcttaacagagatcagaatgttgccatctaatccttatctttggagcaattgctcgtgggaaggatttggtagttcctttgcacatgttcaatcaaacttagctacttgagaagtagagcttgaggaactgtactaggctgctattttgatgtttcggagactgaaacatcatgtatttttttagagctgctttggatgccccgctggtagagggaagtttctctgtctattgtagtgcagcctgtacctgttataatcattttgcttgcaaccgacacagtaccgatagcgtttgaagctggtaaagtaatttttatatgcaaaccgcacagaaaatgattatatgtcacggatgatggtaaaacttttaagataccacatacgtgtatggttg

SEQ ID NO: 25224 - protein, 89 aa, Panicum virgatum
  misc_feature: Ceres CLONE 1862663-R
  misc_feature: SWISSPROT Homolog: EC 3.1.2.15 Ubiquitin thiolesterase
LVNFPVKNLELKDYIPLPKPKENDKLRSKYDLIANIVHDGKPGEGCYRVFVQRKSEEAWYEMQDLHVTETLPQMVALSEAYMQIYEQHE

SEQ ID NO: 25225 - DNA, 1928 bp, Panicum virgatum
  misc_feature: Ceres CLONE 1862665
  misc_feature: Encodes the peptide sequence at SEQ ID NO. 25226
gtaggcctctcccgctctcttctcttcttctgtctgacttcttcctccctccgggagtcagtccagctcaccaggaaggagaagttccatagccttcttggctcatctgcccgcgtccacgctcgaacagttgagtcgttcttcctctcccaatccccccattgttccattgatctccctcccggcgttgtagaaaccggatgtacccgcgctgggcagcaagaagcagcaagcgcgtgacgtttctcccccggcgtcagaggattagaggcggccggggagcgggggtagtggtggtggtggtggcccttgctgggtggaggtggaggcttcgattcgggcggtggattgtggccagacgaatcccggaaaggccgccggaaagggagaacaaaggtaagctaagcaggcagccgtaaagccatggggtgcggggcgtcgagccagaaggacgccgtcggcgggccccggagacggccggggagcgtcggcgacgtggtcgtgttcctcccgggcctccgggtgccgaggagcgtcgacctcgcccaggcgctcggcgggcgcctggacaggagcatcgtggagcggctgtcggctctgagagctcgcgtcgtcgagatggcaatgcaagagtcggcggcggcgctgaagccgaggcggaagatggcggcggcacggcacgggtctagtacagccagtctcctgcaggccctcgaagactacttgccaattctgctaggattggtaaaagaaggtagtacgttgaggcatacagtgcaattcacctggactaaccaagaggataatgctgctgaggagacgaccatggcagatgcctggtacgaggtgctgtctgtgctgcatttgatggccatggtctgcttgcttcaggccaacaccctgcttctccccaggtcatacggcgatggctacgcaccaagagtttccgaagagagcagacgggccactgtcgatgttttcttgaaggcagctggatacttagcctgcgcaattcggcatgtaattccgcagattccacccgaactaaggaggcaacttccagtagacctggttgaaggaaatctcaaagctctaagcctgcaagctctgggtcagggggttgacatgcagcttggtttggctattgatagtccaaaggccactttagcagtaaaacggcgcttagcctgtgaaatggtcaagtattggcaacaagttcaggaaagcattccagatcttcctggctccgatggatgggggaaaaagcaccggctgtttgtcaagtggaaatatgctgaagcaaaggctgcagcatactattttcatggtttgattcttgatgagggaaatacagagaaatcccacggaatggcaatagctgcacttcaagcttcagaagaatttctaaaagaaagcaaaagggtttcagaagccttccatgcaactcctccaacatcgaggagccctactccattcggaacagcaaaatatatgtttgacaagatcccaaaagatgcttcaagcaaggtccgaatcaaccaggacttgtatgctcaagaaaaggtcataggaactccgcctcccttaccggattttgcattggcactaatgccagaagactatgatcttcctccattagatccactttggaacaaagaagacagacgtcagtaggtgtgtatgcaactgaatggattcttcagatagaaagcttggctttggagagaggggagaagaaccaagatctgccatgtcaaagctgaacatggtaacaaatcaagtgtacaaaatatgtttaaacaaaatcctgagtcaaaaaaaaaaagaaccaagcaaaatttaggaatgtctgaagataatctgaagagcattgtacaggcgatttttcttctgacaagggaaatgctttggcaaaggtttgattgacc

SEQ ID NO: 25226 - protein, 416 aa, Panicum virgatum
  misc_feature: Ceres CLONE 1862665
  misc_feature (27)..(413): Pfam Name: BRO1 Pfam Description: BRO1-like domain
MGCGASSQKDAVGGPRRRPGSVGDVVVFLPGLRVPRSVDLAQALGGRLDRSIVERLSALRARVVEMAMQESAAALKPRRKMAAARHGSSTASLLQALEDYLPILLGLVKEGSTLRHTVQFTWTNQEDNAAEETTMADAWYEVLSVLHLMAMVCLLQANTLLLPRSYGDGYAPRVSEESRRATVDVFLKAAGYLACAIRHVIPQIPPELRRQLPVDLVEGNLKALSLQALGQGVDMQLGLAIDSPKATLAVKRRLACEMVKYWQQVQESIPDLPGSDGWGKKHRLFVKWKYAEAKAAAYYFHGLILDEGNTEKSHGMAIAALQASEEFLKESKRVSEAFHATPPTSRSPTPFGTAKYMFDKIPKDASSKVRINQDLYAQEKVIGTPPPLPDFALALMPEDYDLPPLDPLWNKEDRRQ

SEQ ID NO: 25227 - DNA, 2122 bp, Panicum virgatum
  misc_feature: Ceres CLONE 1862666
  misc_feature: Encodes the peptide sequence at SEQ ID NO. 25228
atctctgtccccttcctcctcttcctcccccaccccacacctcacccgctggtgggcccagctgccggcttccgccgttgtgagcgagccggccggcggcattgcggtcgtctggtcggggcgcggcatggcggggtacggggaccggcggtctccgccgctggacggcatcgccgtcgacgggggcggcagggcgcagtcgccgggtgcgggcgcgggggcgggggcggggaggctcccgccgccgccgggcgggttcgcgcgcgggctcatgaagcagccgtcgcggctggcgtccggggtgcggcagttcgcgtcgcgggtgtcgatgaaggtacccgagggggtggccgggatgcggccgggccggatgacgcggatgcagtccagcgcccaggtggggctccgcgggctccggttcctcgacaagacctccggcgggaaggaggggtggaaggccgtcgagcgccgcttcgacgagatgaccaagggcagcggccgactccagaaggagagcttcggcaagtgcatcggcatgggggactccaaggaatttgccggcgagctgtttggggcgctggcgcggcggcggaacctggagccagaggacggcatcaccaaggagcagctcaaggagttctgggaggagatgaccgaccagaacttcgactcgcggctgcgcattttctttgacatgtgcgacaagaacggcgatgggatgctcacggaagacgaagtcaaagaggttattatactcagtgcgtcagcgaacaagctggccaagttgaaggggcacgcggccacctacgcgtcgctgatcatggaggaactcgaccccgatgaccgtggctacatcgagatttggcagctggagacgctgctccgtggcatggtgagcgcgcaggcgcaggagaagctgaagcgaacgacgtcgagcctggcgcggacgatgatcccatcacggtaccggagcccgctgaagcggcacctgtccaagacggtggacttcatccacgagaactggaagcggatatggctcgtcacgctgtggctggtcgtcaatctcgtcctgttcgtgtacaagttcgagcaatacaagcgccggtctgcgttccaggtgatgggctactgcgtctgtgtcgccaagggtgctgccgagaccctcaagctcaacatggcgctcatcctgctacccgtctgccggaacacattgacgacgctcaggtccaccgcgctcagccatgtcataccctttgacgacaacatcaacttccacaagatcatggcgctgtcgattgctatcgccacggcgatccacacgctcgcacacgtcacctgcgacttcccgaggctgatcagctgcccaacggacaagttcatggccaccttggggtccaactttcactacaagcagccaacgtacccggacctgctgcagagcatacccggggtcaccggcatcctcatgatcatcataatgtccttctccttcacgctggcaacgcactccttcaggcggagcgtggtgaaactgccgtcgcccctccaccaccttgccggtttcaatgccttctggtacgcccaccaccttctggtgctcgcgtatatcctgctggtggtgcactcctacttcatattcctcaccagggagtggtacaagaagacgacatggatgtacttgattgttcctgtcctcttctatgcctgtgaaagaactatcagaaaagtccgtgagaacaactatcgcgtgagcattgtgaaggcagcaatttatcctgggaatgtgctctctattcacatgaagaagccacctgggttcaagtacaagagtgggatgtacctgtttgtaaaatgcccagatgtctcgcctttcgaatggcaccccttctctattacttctgcgccaggtgatgactacttgagcgtgcatatccgtacgctgggtgactggacatctgaacttcgtaacctttttggaaaggcttgcgaggcagaagtaacttccaagaaggctaccctaacaagacttgaaactacagttgtggcagacgcccggatagaggacaccaggtttccaagggtttatatagatggtccttatggtgcaccagcacaaaattac

SEQ ID NO: 25228 - protein, 664 aa, Panicum virgatum
  misc_feature: Ceres CLONE 1862666
  misc_feature (81)..(182): Pfam Name: NADPH_Ox Pfam Description: Respiratory burst NADPH oxidase
  misc_feature (538)..(662): Pfam Name: FAD_binding_8 Pfam Description: FAD-binding domain
  misc_feature (340)..(497): Pfam Name: Ferric_reduct Pfam Description: Ferric reductase like transmembrane component
  misc_feature (183)..(211): Pfam Name: efhand Pfam Description: EF hand
  misc_feature: SWISSPROT Homolog: EC 1.6.3.1 NAD(P)H oxidase
MAGYGDRRSPPLDGIAVDGGGRAQSPGAGAGAGAGRLPPPPGGFARGLMKQPSRLASGVRQFASRVSMKVPEGVAGMRPGRMTRMQSSAQVGLRGLRFLDKTSGGKEGWKAVERRFDEMTKGSGRLQKESFGKCIGMGDSKEFAGELFGALARRRNLEPEDGITKEQLKEFWEEMTDQNFDSRLRIFFDMCDKNGDGMLTEDEVKEVIILSASANKLAKLKGHAATYASLIMEELDPDDRGYIEIWQLETLLRGMVSAQAQEKLKRTTSSLARTMIPSRYRSPLKRHLSKTVDFIHENWKRIWLVTLWLVVNLVLFVYKFEQYKRRSAFQVMGYCVCVAKGAAETLKLNMALILLPVCRNTLTTLRSTALSHVIPFDDNINFHKIMALSIAIATAIHTLAHVTCDFPRLISCPTDKFMATLGSNFHYKQPTYPDLLQSIPGVTGILMIIIMSFSFTLATHSFRRSVVKLPSPLHHLAGFNAFWYAHHLLVLAYILLVVHSYFIFLTREWYKKTTWMYLIVPVLFYACERTIRKVRENNYRVSIVKAAIYPGNVLSIHMKKPPGFKYKSGMYLFVKCPDVSPFEWHPFSITSAPGDDYLSVHIRTLGDWTSELRNLFGKACEAEVTSKKATLTRLETTVVADARIEDTRFPRVYIDGPYGAPAQN

SEQ ID NO: 25229 - DNA, 580 bp, Panicum virgatum
  misc_feature: Ceres CLONE 1862666-R
  misc_feature: Encodes the peptide sequence at SEQ ID NO. 25230
gttactagggagcaaggatcattcgaatgtttcaaaggagtcatgaatgatgttgccgaaagcgatcacagtaatgttatagagatgcacaattacctaaccagcgtctatgaagaaggcgacgcaaggtcagctctgattgccatggtgcagtcacttcagcatgcaaaaaatggcgtggacattgtttccggcagcaggattcggacacattttgcaaggccaaactggagaaaagtattctctgatttggccaatgcccacaagaactctcgcataggtgttttctactgtggatctccaacactcacaaaacaactcaaggaactttcaaaggaattcagccagacaaccacgactaggttccatttccacaaggaaaacttctaagaccacatataccagaagacacttgtataggaaagattacaatagcattggtatagcagacttagctttacaagttttgttgtacgccgggttgtacaaaatatgggttgaaagcatgtaagcatcacacatagattctgaaatgcacacagatttctatattcgagaagtgaaactacttgtttcccag

SEQ ID NO: 25230 - protein, 129 aa, Panicum virgatum
  misc_feature: Ceres CLONE 1862666-R
  misc_feature (1)..(112): Pfam Name: NAD_binding_6 Pfam Description: Ferric reductase NAD binding domain
  misc_feature: SWISSPROT Homolog: EC 1.6.3.1 NAD(P)H oxidase
VTREQGSFECFKGVMNDVAESDHSNVIEMHNYLTSVYEEGDARSALIAMVQSLQHAKNGVDIVSGSRIRTHFARPNWRKVFSDLANAHKNSRIGVFYCGSPTLTKQLKELSKEFSQTTTTRFHFHKENF

SEQ ID NO: 25231 - DNA, 2307 bp, Panicum virgatum
  misc_feature: Ceres CLONE 1862671
  misc_feature: Encodes the peptide sequence at SEQ ID NO. 25232
gttgagctcagttattctgtcatcagctcgcagcaaagcctcgtgcagtcgtgctgcttgttgcatcagagcttagagagagagagagtggcttgaggtctgttgctgtagcaagttgcaggtggtagcaaggggagccttcgatccgcttgcagcggccggccttccactgccggagcttcccaatcggcggccagcctcctccgcttctagttctatccaagaagctagcgcttccacttttttttcttgggaaataaagcttcgcctcttttccctccctcatccgtttgttcccttcccccaagaagcttggagctagctagccgccagcgccgtcgcggcccaccactcgcggagctcggcggaggctctcggtagcagtagcacgcgcgctgtccggagctccaggcatgacggcattacggcgtcttggcacggcggtggacggaaatcttccaggggcctgccgccggcgggatggtgccgccgtccccgcgcctcctcgccccgaacggcagcgcgcccaggtcccccgcggcgagccgccgggaggaggcggcagcggccagcggcggaggcggccctggcctcgccccgctccgtcccactcccgccaagccgccgctcgggagcggtaagattcagaagcgggccggcggcaagcccaggaagcgggcgccgctctggcaggctgctctcttcgtctccgtcgccatacacgccgggctcttcgtcctccacccctacgtcaacagcgcagctcctccgcaccgccaccaccacccccaggagccccaggcctgcctgacgcatccagaagctgcaggcagcgacggcggcaggagaagggcgacgcaggagaaggcctgggcggccggggctccgtcgacgggcaagccggcggtgacgccggagtcagtgatcaacctcgaccacggtgacccgaccatgttcgaggagttctggcgcgggacgggggcggcggcggagatcgtcatcccggggtggcagaccatgagctacttctccgacgtcggcaacgtgtgctggttcctggagcccggcctcgaccacgaggtgcgccggctccaccgcctcgtcggcaacgccgccgtggacggctaccacgtcctcgtcggcaccggctccacgcagctcttcatggcggcgctctacgcgctgtcgccgcccgccgccgcgcccatgagcgtcgtgtccacggcgccatactactcgtcctaccctgccgtcacggacttcctccagtcggggctcttccgctgggccggcgacgccagctcgttcaccggcgacacctacatcgagctggtgtgctccccgaacaaccccgacggcaccatccgcgaagctgttctctcctccgcgtccggcgtcgccgtgcacgacctggcctactactggccccattacaccgccatcaccaagcgggccgaccacgacatcatgctcttcaccgtgtccaagagcacggggcacgccggcacgaggatcgggtgggcgctggtgaaggaccgcgacgtcgccaggaagatgaccaagttcatcgagctcaacaccatcggcgtgtccaaggactcgcagctgcgcgccgccacggtgctccgggcggtctccgacgcctacgagctcccggcggcgggggaagagcaccgccgcctgttcgactacggccggcgcaagatggcggagcgctggagcatgctgcgcgaggccgccgccgcgtcgggcatcttcagcctgcccgacgagacctccggctactgcaacttcaccaaggacatggcatccactaaccctgcgttcgcgtggctgcgctgcgacagggaggacgtggaggactgcgcgagcttcctccgggggcacaagatcctgacccggagcgggagccagttcggggcggacccgaggtacgtaagggtcagcatgctggacagggacgacgcctacgacatcttcgtgaagcacctcgcctccctcaagtgaggcgaggaggaggacgaaccatggatcgacgatgccacccgggccggcgccggcaacgcatcatgcccgagcgagcatgagtagagcagcagtatcggtagagtagggagaagcagaggagggggagcaacgttttgtttggcttttttttttttcccttctgctgtgtgctgcgttgttgttggggatggatgcatgtcgcatcgtctcaaaaattcttataaaggtttcatttttttcttgctactaattgctagtatgtgagactgagctgacatgaaaaaaattgtatcgatctgg

SEQ ID NO: 25232 - protein, 508 aa, Panicum virgatum
  misc_feature: Ceres CLONE 1862671
  misc_feature (149)..(508): Pfam Name: Alliinase_C Pfam Description: Allinase
  misc_feature: SWISSPROT Homolog: EC 4.4.1.4 Alliin lyase
MVPPSPRLLAPNGSAPRSPAASRREEAAAASGGGGPGLAPLRPTPAKPPLGSGKIQKRAGGKPRKRAPLWQAALFVSVAIHAGLFVLHPYVNSAAPPHRHHHPQEPQACLTHPEAAGSDGGRRRATQEKAWAAGAPSTGKPAVTPESVINLDHGDPTMFEEFWRGTGAAAEIVIPGWQTMSYFSDVGNVCWFLEPGLDHEVRRLHRLVGNAAVDGYHVLVGTGSTQLFMAALYALSPPAAAPMSVVSTAPYYSSYPAVTDFLQSGLFRWAGDASSFTGDTYIELVCSPNNPDGTIREAVLSSASGVAVHDLAYYWPHYTAITKRADHDIMLFTVSKSTGHAGTRIGWALVKDRDVARKMTKFIELNTIGVSKDSQLRAATVLRAVSDAYELPAAGEEHRRLFDYGRRKMAERWSMLREAAAASGIFSLPDETSGYCNFTKDMASTNPAFAWLRCDREDVEDCASFLRGHKILTRSGSQFGADPRYVRVSMLDRDDAYDIFVKHLASLK

SEQ ID NO: 25233 - DNA, 509 bp, Panicum virgatum
  misc_feature: Ceres CLONE 1862688
  misc_feature: Encodes the peptide sequence at SEQ ID NO. 25234
actagctttccccttctctgccgtccgggaagcccccggcggaagcaagggattaaagggaccatggggcaaaagcctcttctgttgctcacttgtttttgggtcctggcctgtgccctactgcttcctgcctcctcccatggactgctaaaaatccacctccacaaaaaaaaaccggaccagggagctttgactgctgccaaattggctaggcatgaaactccccctccgaaaaaggttgatggttctcccccgtcccctggggaccccagccattacctaattcccttggaccactacctggacccctcataccttggaaaaattggcctccgcaccccccccccaaacttccctggtatattccacaccggaaactcccacttgtggattccctcctccaaatggtatttctccatagcatgccactttcaccaccaataccgggccatccagtccaagaactaccaaaagaaccgggaaacttgcaccataacctatggttctgg

SEQ ID NO: 25234 - protein, 148 aa, Panicum virgatum
  misc_feature: Ceres CLONE 1862688
  misc_feature: SWISSPROT Homolog: EC 3.4.23.40 Phytepsin
MGQKPLLLLTCFWVLACALLLPASSHGLLKIHLHKKKPDQGALTAAKLARHETPPPKKVDGSPPSPGDPSHYLIPLDHYLDPSYLGKIGLRTPPPNFPGIFHTGNSHLWIPSSKWYFSIACHFHHQYRAIQSKNYQKNRETCTITYGS

SEQ ID NO: 25235 - DNA, 639 bp, Panicum virgatum
  misc_feature: Ceres CLONE 1862690
  misc_feature: Encodes the peptide sequence at SEQ ID NO. 25236
attaattttccgcgctgcgcttgtaaacatctatccagcaaaacgcaacaagatggtgtacgcgctcctggtggtcgccttggcggccgtcgccgccgcaacggtgctcccccactacctcccgctgctccccggcgggctccccaagggcagcttccgctgggccctcatcggcgaaaccatcggcttcctccacgcgcaaccgtccaacaccggcggggggttcctcaaagaacacgtccccaggtacgggaaggtgttcaagtcccacctcttccgctcggccgggggggtctcctggcaagaagaactcaaccactttctggtggacaaccaagaacgcctggtccaatggaactaccccggggcccttcccaacattctccgggaatccttcgcggtgggggtcaaccggcaaccccacccccaaaatccgaacatggtccttcccctcctcccctccaacggggttaagggcttctaactccgcaggggccaacaattccccccgttccttcttcgggtctggcgccgccggcaaaacattaactttcggcaagaaggcaagaaatttccctaacaaggtatccttgaacaaggtcctgggcctgccgccgaacggcccgtgggccttccgaa

SEQ ID NO: 25236 - protein, 143 aa, Panicum virgatum
  misc_feature: Ceres CLONE 1862690
  misc_feature: SWISSPROT Homolog: EC 1.14.13.77 Taxane 13-alpha-hydroxylase
MVYALLVVALAAVAAATVLPHYLPLLPGGLPKGSFRWALIGETIGFLHAQPSNTGGGFLKEHVPRYGKVFKSHLFRSAGGVSWQEELNHFLVDNQERLVQWNYPGALPNILRESFAVGVNRQPHPQNPNMVLPLLPSNGVKGF

SEQ ID NO: 25237 - DNA, 278 bp, Panicum virgatum
  misc_feature: Ceres CLONE 1862691
  misc_feature: Encodes the peptide sequence at SEQ ID NO. 25238
tctcccatgcttcctctctccataggtcctctcggaattcttgttgcaagtacagcatgatctgctacacgccatggttgctggcatgctgcctcctgctgctcttgtacagcgtcaggctcaagtctggctggagccatggccacgggccgaggagctacccggtgatcgggtgcctggtcaacttttaccagaaccggttccggctgctggactggtacaccgagctgctggcggcgtcgccgacgcagacgatcgtcgcggaccggctgggcgcg

SEQ ID NO: 25238 - protein, 73 aa, Panicum virgatum
  misc_feature: Ceres CLONE 1862691
  misc_feature: Useful for making plants with modulated nitrogen use efficiency
MICYTPWLLACCLLLLLYSVRLKSGWSHGHGPRSYPVIGCLVNFYQNRFRLLDWYTELLAASPTQTIVADRLG

SEQ ID NO: 25239 - DNA, 696 bp, Panicum virgatum
  misc_feature: Ceres CLONE 1862705
  misc_feature: Encodes the peptide sequence at SEQ ID NO. 25240
agcgacgcgagctgcctaggtgcctcgctcctcctcctccttctcctgcgccagctagctgcgctggccactcagtggagactggagagaggagccgccagcagctagtaggagacaggaggagacagaggggagtgggcggagcagctagagatagcgtcgtcgtggagatggacggcgacggcgggcggcggtggccgagccaccaagaagctggtgcaggggctgtacggctacgccgtgcccggccgcgtcgtcgccatcatggggccgtccggctccggcaagtccacgctcctcgactcgctctccgggaggctggccaggaacgtggtcctcaccgggaaggtgctgctcaacggcaagaagaggcggctcgactatggcgtcgtggcgtatgtgacccaagagaacatactgttgggcacgctgacagtccgggagacggtgacctactcggccctgctgcggctgccgtcgagcatgcgcaagtcggaggtgcgccgcatcgtggacgacacgctggacgagatggggctccgggagtgcgccgaccgccacatcgggacctggcacctccgcggcatcagcggcggcgagaagaagcgcctgagcatcgcgctggaaatcctcacccgcccgcgcctcctcttcctggacgagcccaccacggggctcgacagcggcgccgccttc

SEQ ID NO: 25240 - protein, 143 aa, Panicum virgatum
  misc_feature: Ceres CLONE 1862705
  misc_feature (1)..(141): Pfam Name: ABC_tran Pfam Description: ABC transporter
  misc_feature: SWISSPROT Homolog: EC 3.6.3.25 Sulfate-transporting ATPase
MGPSGSGKSTLLDSLSGRLARNVVLTGKVLLNGKKRRLDYGVVAYVTQENILLGTLTVRETVTYSALLRLPSSMRKSEVRRIVDDTLDEMGLRECADRHIGTWHLRGISGGEKKRLSIALEILTRPRLLFLDEPTTGLDSGAA

SEQ ID NO: 25241 - DNA, 667 bp, Panicum virgatum
  misc_feature: Ceres CLONE 1862707
  misc_feature: Encodes the peptide sequence at SEQ ID NO. 25242
acctcatcgacccagccaaagctgccagagcaaacctcgccgaccccagctcgagcaagagcgtcggcagaggagccgaagatgagcgtggagatcctcgacgggagcacggtccggagcttcgtggaggacgagggcgccttcaactcctccgtcgacggccgcttcgccgcgctggacgccgaccgcgacggcctgctcacgtacgcggagatggccggcgagctcatgagcctccgggtgctggagaagcacttcggcgtggacgaggcggcggcgccggccggcgagctcgccgcgctgtaccgcggcctgttcgcgcggttcgacagggacggcagcggcgaggtggaccgggacgagttccgggcggggatgagggaggtgatgctcgccgtggccaacgggctcggcttcctccccgtgcagatggtcgtcgaggaggggagcttcctcaaggtggccgtcgacagggagctcggccagctcgccagagccgcgtaaagctctactaattgccgaccaccatggcttatatatcacggcagcggatttttcgcatttattttttcccctattcgtaacttcagatgttgtattgagctacagagtccgatcgatcgatcgatccgtgcccccccgctcggcaatcatggagttcccgccc

SEQ ID NO: 25242 - protein, 140 aa, Panicum virgatum
  misc_feature: Ceres CLONE 1862707
  misc_feature (74)..(102): Pfam Name: efhand Pfam Description: EF hand
MSVEILDGSTVRSFVEDEGAFNSSVDGRFAALDADRDGLLTYAEMAGELMSLRVLEKHFGVDEAAAPAGELAALYRGLFARFDRDGSGEVDRDEFRAGMREVMLAVANGLGFLPVQMVVEEGSFLKVAVDRELGQLARAA

SEQ ID NO: 25243 - DNA, 707 bp, Panicum virgatum
  misc_feature: Ceres CLONE 1862725
  misc_feature: Encodes the peptide sequence at SEQ ID NO. 25244
atcaaacccccagacttttccgccagcgccatcctcagtcagccgccaagccttcgagaaccctccggagctcgctagatccgatcggacccggcgcgggctgccgccatggcggacgaggcgaaggccaagggtaatgcggcgttctccgccggccgcttcgaggaggcggcgcggcacttctcggacgccatcgcgctcgccccgggcaaccacgtcctctactccaatcgctccgccgcgctcgcctcgctccaccgctactcggacgcgctcggcgacgccgccagcgccgtcgccgcctacgagaaggggctcgcgctcgaccccaccaacgagggcctcaaggcggggctcgaggacgccaggaaggccgccgccgccccgccgcgccgcgggccgtccgggcccgacgccatcggccagatgttccagggccccgagctgtggagcaagatcgcggccgaccccaccactcgcgcctaccttgaccagccaaactttatgcagatgctgcgcgaggtgcagaggaacccaagcagcctcaacatgtacctctccgatccccgcatgatgcaggtgctcagcctcatgcttaatatcaagatccagagacccgaggcctccgagccgtcgcagtctaccccgccgccgccgccgcagcagcagcagacgacgcctcctgagacgaaggcgagggaggttga

SEQ ID NO: 25244 - protein, 199 aa, Panicum virgatum
  misc_feature: Ceres CLONE 1862725
  misc_feature (2)..(35): Pfam Name: TPR_2 Pfam Description: Tetratricopeptide repeat
MADEAKAKGNAAFSAGRFEEAARHFSDAIALAPGNHVLYSNRSAALASLHRYSDALGDAASAVAAYEKGLALDPTNEGLKAGLEDARKAAAAPPRRGPSGPDAIGQMFQGPELWSKIAADPTTRAYLDQPNFMQMLREVQRNPSSLNMYLSDPRMMQVLSLMLNIKIQRPEASEPSQSTPPPPPQQQQTTPPETKAREV

SEQ ID NO: 25245 - DNA, 681 bp, Panicum virgatum
  misc_feature: Ceres CLONE 1862725-R
  misc_feature: Encodes the peptide sequence at SEQ ID NO. 25246
agcaataaaacattacacggaggctcttaggagaaacccaaaggatcctagggtatacagcaatagagctgcgtgctacaccaagttaggagccatgcctgaaggtcttaaagacgcagagaagtgtcttgagctagatcccaccttcagcaaagggtacacacggaaaggtgcaattcaattcttcatgaaggaatatgacaaggccatggaaacctaccaggctggcctaaagcatgatcctaataaccaggaactgcttgatggtgttaggaggtgtattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaagaaccctggagttctgcagaagattcagaaactcgtaagcgctgaaatagtccagatgagataatgatgcgattgtacccacctgtttgtgtcttgtgctgggcttgttaattcacatgcccccgttcgtatctttcaaaaatgtagccgcggcaaaggttcatcaacttattgggggctagtgtcgtcctcttcccattggattgtaagggcagttgtcattggatt

SEQ ID NO: 25246 - protein, 171 aa, Panicum virgatum
  misc_feature: Ceres CLONE 1862725-R
  misc_feature (16)..(49): Pfam Name: TPR_1 Pfam Description: Tetratricopeptide repeat
  misc_feature (50)..(83): Pfam Name: TPR_1 Pfam Description: Tetratricopeptide repeat
  misc_feature: SWISSPROT Homolog: EC 3.1.3.16 Phosphoprotein phosphatase
AIKHYTEALRRNPKDPRVYSNRAACYTKLGAMPEGLKDAEKCLELDPTFSKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVLQKIQKLVSAEIVQMR

SEQ ID NO: 25247 - DNA, 2499 bp, Panicum virgatum
  misc_feature: Ceres CLONE 1862739
  misc_feature: Encodes the peptide sequence at SEQ ID NO. 25248
accatattccactccgtttcgtgcttcctggcccgccactccctcccactgttgttgcatctcaaggtactgtgcttgctggcatctctctctccccctctcgttccatgtctccgagctcccatcctctggctcgacctcgcgacaccagtgatgagagggaccgatcggcagagcaactgtgagacctcccatcctgtatggaggattggtcgaattttaaccgaggcttcttgctgcatgcagggcaggggccggccaggtcggctctccgatcgctctggccttccgcgtctcgccggcggccggcgcatcaaccaccgtactgcgcgcccgccggagcatgcagttgcaggcaccgttcctgtctccggctgtctcctccgccggacgggctctcgctctcccataggaaacgatcgactcggctaaccgcaacaacgtctccttccacctactctctcgccaacgttttggacaagttcgttgaggcacagaagaatcgcctgccgtgtggcgggtgactgactgttgctcgggatgggcaagatgagctgcttcgccggcctgctcctgctcggcggcaagaggaaggcatccaagggtaagaacaagggcgcttacgccaagaaggttaatggcaatgactgccccaaggtgaagccggtggagttcatggacatggcggacgctctagacgtcagcagaggcgggggcaacgatcctgcatgcaacagcgggtttgtcgttcgcgcagccgccgagttggcaggccgtggcggtagcggggacggcgacaaggccgcaattaagatgggctcgtctgactctgacgctgacctcgtcgccggctacaccagtgacggaacaggtgaaagtgccaagcgctccgagccggacgccggcgagtcctccagcgttggccgcatgtcgccgacgccaccggcgtcgccaaagctgaagcgctcgtgctccaacatcgagacgacgaggtcctccgcgccgccgaaagggttcgacctggcggcgaggtcgcgctcctacaacgacctaaacgccctgcctccggcgtggtcggccacccccagcggcgcgccgtacgcgagcccggcggcgtccgtgaggacgtcgtgctccgccgaccgcgtcatgctcaagaagcggtcgtcgacgctggtgctcccgtcccggagccggaagctgtggcggcggctgttcctgtggagccaccgcagccttgccgcgcccgcgctgccgtcgccggacgcgccccatcagcacgacggatacacgctcgacgcggtcaccgcggacgccaagggcaagagggccgccgtggaggtcgacccgatcccgaaccagtgggtcgccttctccgccggggcctcgccgctggaacgcgtcagcgcgtgggtgaacagcctcggggacggctcgttccacgccgtcgacgaggaggacgccacggagcacggcggcggcggcgccctcccgcaatgctctgagatcgtggagctgcccacgcccggcaagaggcagcctcaggcgaagcggcgcgcggcggacgaggccgccaaccaggcgaggagcatcgtccacgcgctcagcgtgttctcctccgtcgcccacatctccggcatggggctcaaggccgtcccggcgatcgcggcgttctccacactccgtgcagtcaatctgtctggcaacttgatcgttcaaatcgcccccggatcgttgcccaaaggcctgcactcgctggatctgtcgcggaacaggatcgccgtcatcgaggggctccgggagctgacgaggctgcgcgtgctcaacctcagctacaaccggatctcacggatcgggcatgggctctcgagctgcacggcggtcagggagctctacctggccgggaacaagatcagcgacgtcgaggggctgcaccgcctgctgaagctggccgtcctggacgtgagcttcaacagggtcaccacggccaggtcgctgggccagctcgtcgccaactacggctcgctgcgggcgctcaacctgctgggcaacccggtggaggccgccaccggcggcgacacgctgcgcagggccgtgtcgggcctgctcccgcggatcgagtacctcaacaggcaggccgtgaagccgcagcgcgcgcgggaggtggcaaaggacagcgtcgcgcgggcggcgctcgggaacgccggcgggagctcgcgcagcaggcggccgccgcgccgggcgaaccagagccccgggtcgtcgggcaagagccggggcagggacgggagcagcggcagccgcagggggagaaggagcaggtccaacaccaggcagcaggggcagggctccagcctctcgaggaagtgagctgtgagcatgaggccgccgtgtcgcagacatggaagagtgttcaactcttgatcgaagagggagagcaaatgactccgtgtgttttaaactgccgtgttcagataaataattggcattaccggaggc

SEQ ID NO: 25248 - protein, 609 aa, Panicum virgatum
  misc_feature: Ceres CLONE 1862739
  misc_feature: SWISSPROT Homolog: EC 4.6.1.1 Adenylate cyclase
  misc_feature: Useful for making plants with altered protein content
MGKMSCFAGLLLLGGKRKASKGKNKGAYAKKVNGNDCPKVKPVEFMDMADALDVSRGGGNDPACNSGFVVRAAAELAGRGGSGDGDKAAIKMGSSDSDADLVAGYTSDGTGESAKRSEPDAGESSSVGRMSPTPPASPKLKRSCSNIETTRSSAPPKGFDLAARSRSYNDLNALPPAWSATPSGAPYASPAASVRTSCSADRVMLKKRSSTLVLPSRSRKLWRRLFLWSHRSLAAPALPSPDAPHQHDGYTLDAVTADAKGKRAAVEVDPIPNQWVAFSAGASPLERVSAWVNSLGDGSFHAVDEEDATEHGGGGALPQCSEIVELPTPGKRQPQAKRRAADEAANQARSIVHALSVFSSVAHISGMGLKAVPAIAAFSTLRAVNLSGNLIVQIAPGSLPKGLHSLDLSRNRIAVIEGLRELTRLRVLNLSYNRISRIGHGLSSCTAVRELYLAGNKISDVEGLHRLLKLAVLDVSFNRVTTARSLGQLVANYGSLRALNLLGNPVEAATGGDTLRRAVSGLLPRIEYLNRQAVKPQRAREVAKDSVARAALGNAGGSSRSRRPPRRANQSPGSSGKSRGRDGSSGSRRGRRSRSNTRQQGQGSSLSRK

SEQ ID NO: 25249 - DNA, 674 bp, Panicum virgatum
  misc_feature: Ceres CLONE 1862746
  misc_feature: Encodes the peptide sequence at SEQ ID NO. 25250
gtctctcccgctgcccgtcccctgccggcttcgcccccaaatctgcgcagcgccttcgccagatttcccgcggcgacgaggatggttgggagcgtgggcaacgggctggcggatctgggcgcctccatgaacgggaacgggaaggcggcggcggagccgctcccgatggagatggacccgccggcggacgtgatggcggcggcggccgcggctgagggggaggcggcctcgaacgggaggagggagatcgtgatggggaggaacgtgcacacctcctgcttcgcagtcaaggagcccgacgcggacgacgaggagaccggcgagcgggaggccaccatggccagcgtcctcgcgctctaccgccgctcgctcgtcgagcgcaccaagcaccacctcggctacccatacaatctggacttcgattacggtgcattggggcagctgcagcacttctccattaacaacctcggagaccccttcattgagagcaactatggtgtccattccaggcagtttaaggttggagtgctggattggttcgctcgcctctgggatttagaaaaggatgaatactggggatacattactaactgtggtacagaaggaaatctgcatgggattcttgttgggagggaagtgttccctgatggaatcttgtatgcctctcgtgagtc

SEQ ID NO: 25250 - protein, 197 aa, Panicum virgatum
  misc_feature: Ceres CLONE 1862746
  misc_feature: SWISSPROT Homolog: EC 4.1.1.22 Histidine decarboxylase
MVGSVGNGLADLGASMNGNGKAAAEPLPMEMDPPADVMAAAAAAEGEAASNGRREIVMGRNVHTSCFAVKEPDADDEETGEREATMASVLALYRRSLVERTKHHLGYPYNLDFDYGALGQLQHFSINNLGDPFIESNYGVHSRQFKVGVLDWFARLWDLEKDEYWGYITNCGTEGNLHGILVGREVFPDGILYASRE

SEQ ID NO: 25251 - DNA, 690 bp, Panicum virgatum
  misc_feature: Ceres CLONE 1862754
  misc_feature: Encodes the peptide sequence at SEQ ID NO. 25252
aagattattagcgagtcccaggccaagaaacgcgtcagagtttgccttttgatcggacgccggtgcaagaggcagagagagaagaggaagaggaggaggaggaggtgaggtcaggggctgagagggagccagctgccatgcggccagccatggcggtcagggccgggttcttgctcgccgccgcggcgtgggtgtggctatcggctgtgtccgcctccgccatcgacgacgtgccgaccgccgacttcgacgagcggttctcgccgctgttcggcgacggcaacctcgtccgctcctccgatgacaggagcgtccgcctcctgctcgaccgccgctccggttccgggttcatgtcctcggactactacctccacggcttcttcagcgcctccatcaagctgcccaaggactacacggccggcgtcgtcgtcgccttctacgtaagtactccccaatccatgctgcagaaatttcgattccatctcggaacattcctgcccaaagcaaggttttttactagtatagtatagtagcgtatccctgccgctctttcgaggcgttggttcttgcctggtcacatggcgcgtccacacggattttgcaaccgccgccgcggctgccgaaaccggcgagccatcgcaagttgcgggtgcgcccatgtcctgcgccgcagagcaaggcacagcgcga

SEQ ID NO: 25252 - protein, 126 aa, Panicum virgatum
  misc_feature: Ceres CLONE 1862754
  misc_feature (33)..(126): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
MAVRAGFLLAAAAWVWLSAVSASAIDDVPTADFDERFSPLFGDGNLVRSSDDRSVRLLLDRRSGSGFMSSDYYLHGFFSASIKLPKDYTAGVVVAFYVSTPQSMLQKFRFHLGTFLPKARFFTSIV

SEQ ID NO: 25253 - DNA, 584 bp, Panicum virgatum
  misc_feature: Ceres CLONE 1862756
  misc_feature: Encodes the peptide sequence at SEQ ID NO. 25254
acccgctttccttccttggactcatcgtaagtcttagctcggtcaggactaccgccaacgcgccgatggtgacgatgccggtggcgccgccgcgcgcgcggcggtccgtggtggcggagctggagggtgcgctgctccggggcgcggacacgttcccctacttcatgctcgtggggttcgaggcgtcgggcctgtcgtgcttcttggcgctgctggtgctgtggcccctgctgctgctgctggatctggtcggccggggcggcctggtgctgcgcgtcgccgagctcgtggccaccgttttgggtgtcccgggtcgaggtggacgtcttgtcccgcgccgtgctgccttttttcatggcctactacgtcgacccgcgcgcctgggctgccttccgggcctgctatgggaggcgcgtctgcgtcaccacgctgatgccgcgcgtcttggtgtagcgcttcttcagggagcacctcctcctgctctatgtggtcgggtgcgacctccactaccgccggttcttgtgctgcatccagctcctcttgtgcggctgaggctagtgcgtcgcgcgccgcatccgcgcact

SEQ ID NO: 25254 - protein, 172 aa, Panicum virgatum
  misc_feature: Ceres CLONE 1862756
  misc_feature: SWISSPROT Homolog: EC 2.3.1.15 Glycerol-3-phosphate O-acyltransferase
MVTMPVAPPRARRSVVAELEGALLRGADTFPYFMLVGFEASGLSCFLALLVLWPLLLLLDLVGRGGLVLRVAELVATVLGVPGRGGRLVPRRAAFFHGLLRRPARLGCLPGLLWEARLRHHADAARLGVALLQGAPPPALCGRVRPPLPPVLVLHPAPLVRLRLVRRAPHPR

SEQ ID NO: 25255 - DNA, 1320 bp, Panicum virgatum
  misc_feature: Ceres CLONE 1862759
  misc_feature: Encodes the peptide sequence at SEQ ID NO. 25256
aaaacaaaccgaacgccaagcggagggagagcagaggaggccgtctcctgcggattcgccggctccatcggttgcataggccgccgccgggcgcccgcgcggcgctcatcacgcccgccccccacgcaggtgaaggttaatccttaaactcttcaagatgggcgagggacatgaagctgacaagaacattgagatctggagggtcaagaaattaatcaaggcgcttgatgctgctaggggaaatggtaccagcatgatttctctcatcatgccgcctagggaccagatttcacgtgtcactaagatgctgggtgatgagtatggaactgcctcaaacatcaagagcagagtcaaccgtcagtctgtcttggctgccataacctcagctcaacagaggttgaagctttacaatcgagttccccccaatggtttagtgctttatactggaacaattgtcactgatgatggcaaagagaagaaggtaacctttgactttgagccatttaggcccattaacgcgtccctgtatctctgtgacaacaagttccacactgaggcactgaatgagctcctggcttctgatgataaatttggtttcattgtcatggatggcaatggaacattgtatggcactctgagtggcaacagcagggaggttctttacccgtttagtgttgatctcccaaagaagcatgggcgaggagggcaatctgcagtccgctttgcccgcctgcgcatggagaggcgacacaattacctgcgcaaagttgctgagcttgcaacacagtatttcatcaatcctgccactaatcagccaaacattgttgggcttattcttgctggttctgctgacttcaagaccgaactgggaaaatcagagatgtttgatccgcgtctgcaggccaaggttgtcaagatgattgatgtgtcttatggaggggaaagtggcttcaaccaagccattgagatgtctgccgaggttctttctgatgtcaagtttgtccaagaaaagaagctgatcgggaagtactttgaggagataagccaggacacaggaaagtatgtccttggtgtggatgacaccatgacagccctggaaatgggagcggtagagacactgattgtgtgggaaaaccttgatgtcaggcggtatgagctaaagaacagcgccactggagaaacagtcgtgaagtatctgaacaccacacaggaggctgatcagcgcaacttcactgatgagggcaacatctggagatcttgaagtcattgacaacacgctactgctggaggtgggtttgctgagaactaccaccagtttgg

SEQ ID NO: 25256 - protein, 367 aa, Panicum virgatum
  misc_feature: Ceres CLONE 1862759
  misc_feature (6)..(140): Pfam Name: eRF1_1 Pfam Description: eRF1 domain 1
  misc_feature (144)..(278): Pfam Name: eRF1_2 Pfam Description: eRF1 domain 2
  misc_feature (281)..(367): Pfam Name: eRF1_3 Pfam Description: eRF1 domain 3
MGEGHEADKNIEIWRVKKLIKALDAARGNGTSMISLIMPPRDQISRVTKMLGDEYGTASNIKSRVNRQSVLAAITSAQQRLKLYNRVPPNGLVLYTGTIVTDDGKEKKVTFDFEPFRPINASLYLCDNKFHTEALNELLASDDKFGFIVMDGNGTLYGTLSGNSREVLYPFSVDLPKKHGRGGQSAVRFARLRMERRHNYLRKVAELATQYFINPATNQPNIVGLILAGSADFKTELGKSEMFDPRLQAKVVKMIDVSYGGESGFNQAIEMSAEVLSDVKFVQEKKLIGKYFEEISQDTGKYVLGVDDTMTALEMGAVETLIVWENLDVRRYELKNSATGETVVKYLNTTQEADQRNFTDEGNIWRS

SEQ ID NO: 25257 - DNA, 700 bp, Panicum virgatum
  misc_feature: Ceres CLONE 1862760
  misc_feature: Encodes the peptide sequence at SEQ ID NO. 25258
agcacagcccgctgctgcctgcaaccgccgccgctaggcgaagcgaatctgcaaccgccaagctagcactgtgtgggctgcatcgcgtcgcagatggccgcggcggcggcgcaaccctcatcgtccgcgcgggcgcgcgcgccgctgccggcggcgtcggcggctcgcccattgcatcccctcgccggcctggaggagggggaagccgtggcggccgccgcccaccccggcgcacaccgggtgcggcgcagggggaggaagcagaagcagctctggcccaagacggtgctgcggaagtggctcaacatcaggtcgccggagtccgacttcagcgccgacgagggcgacaccaccgacgacgccgacagcgaggtcgagtacgaagagatgtgtgcctgggaacgcaagtcacatgaagagaggagcaaccgtggacttggtgctgaaactattggaaatcaactagggccggttccatatgggctccatagaaggcgcaagtcagagaccctccgcgtgcagtatattgatgtcagggaactaaggatatgtgcgggaacatggaatgttgcaggcagacttccacctgatgacttggatattcaagaatggttagatatggaggaaccaactgatatatatgttcttgggtttcaagaaattgttccattaaatgctgcgaatatatttggtgctgaag

SEQ ID NO: 25258 - protein, 202 aa, Panicum virgatum
  misc_feature: Ceres CLONE 1862760
  misc_feature: SWISSPROT Homolog: EC 3.1.3.56 Inositol-polyphosphate 5-phosphatase
MAAAAAQPSSSARARAPLPAASAARPLHPLAGLEEGEAVAAAAHPGAHRVRRRGRKQKQLWPKTVLRKWLNIRSPESDFSADEGDTTDDADSEVEYEEMCAWERKSHEERSNRGLGAETIGNQLGPVPYGLHRRRKSETLRVQYIDVRELRICAGTWNVAGRLPPDDLDIQEWLDMEEPTDIYVLGFQEIVPLNAANIFGAE

SEQ ID NO: 25259 - DNA, 1343 bp, Panicum virgatum
  misc_feature: Ceres CLONE 1862767
  misc_feature: Encodes the peptide sequence at SEQ ID NO. 25260
gccccgctcgccatcgagctcagcgagccgtacattgacggcgccctgaccaaggccaagagcaaggtctacacgccggcgtccagcggcgtcgaggcctgggtgtggcagctcgccaaggcctacgtcgccgtcaacgactccggctggcaccagctcatcagccactggctgaacacgcacgcggtgatggagccgttcgtgatcgcgacgaaccggcagctgagcgtgacgcacccggtgcacaagctcctgcacccgcactaccgcgacacgatgaccatcaacgcgctggcgcggcagacgctcatcaacggcggcggcatctccgagatgaccgtgttcccgggcaagtacgcgctggccatgtcctcggcggtgtacaagggctggaacttcaccgagcagggcctgcccgcggacattgtcaagcggggcgtggcggtggcggacccgtcgagccccggcaaggtgcggctgctgatcgaggactacccgtacgcgagcgacgggctggccgtctggcacgcgatcgagcagtgggtgggcgagtacctggccatctactaccccgacgacgccacgctgcggggcgacgaggagctgcaggcgtggtggaaggaggtgcgcgaggtcgggcacggcgacctcaaggacgcgccctggtggccccggatgcaggccgtgccggagctcgccggcgcctgcgccaccatcatctggatcgcgtcggcgctgcacgcggccgtgaacttcgggcagtacccgtacgcggggtacctcccgaaccggccgacggtgagccggcggcggatgccggagcccggcacggaggcgtacgcggagctggagcgcgacccggagcgggacttcatccgcaccatcaccagccagatccagaccctcatcggcatctcgctcatcgaggtcctctccacgcactcctccgacgaggtgtacctcggccagcgcgacaccccggcgtggacctccgacacccgggcgctcgcggcgttcaagcggttcagcgacgcgctggtggagatcgagggcaaggtggtgggcgccaaccgcgacccgcagctcaagaaccggagcgggcccgccgagttcccctacacgctgctgtaccccaacacctccgaccgcacgggcgccgctgccgggatcaccgccaagggcatccctaacagcatctccatctgagcagcggcgtgcctgctcgtctgctagccgttgcgcgttctcgaggccatgagagagaggtggtgcttgaagtcttgaacaagtcatgttgctttcgtctctctctctctctctctctctctctctctctctctctc

SEQ ID NO: 25260 - protein, 401 aa, Panicum virgatum
  misc_feature: Ceres CLONE 1862767
  misc_feature (1)..(379): Pfam Name: Lipoxygenase Pfam Description: Lipoxygenase
  misc_feature: SWISSPROT Homolog: EC 1.13.11.12 Lipoxygenase
  misc_feature: Useful for making plants with altered lignin content
APLAIELSEPYIDGALTKAKSKVYTPASSGVEAWVWQLAKAYVAVNDSGWHQLISHWLNTHAVMEPFVIATNRQLSVTHPVHKLLHPHYRDTMTINALARQTLINGGGISEMTVFPGKYALAMSSAVYKGWNFTEQGLPADIVKRGVAVADPSSPGKVRLLIEDYPYASDGLAVWHAIEQWVGEYLAIYYPDDATLRGDEELQAWWKEVREVGHGDLKDAPWWPRMQAVPELAGACATIIWIASALHAAVNFGQYPYAGYLPNRPTVSRRRMPEPGTEAYAELERDPERDFIRTITSQIQTLIGISLIEVLSTHSSDEVYLGQRDTPAWTSDTRALAAFKRFSDALVEIEGKVVGANRDPQLKNRSGPAEFPYTLLYPNTSDRTGAAAGITAKGIPNSISI

SEQ ID NO: 25261 - DNA, 666 bp, Panicum virgatum
  misc_feature: Ceres CLONE 1862767-R
gtgtaccaccatattcgtttaataagcttagcatgtgggattatatgttgacaaggttagtgaatatgcctgtaagacaactagcatcaaagatggtgtaaatcagtttgatctccggcagaggaagcagtagcttgttttcaggcattggttgactttctatgctcccttatgagcagcaatgatgatggaagaataattgttgcaaagcaaaagctcaatcaacaacctgaagaagcatatcttaaatttgtgatgctttgtgcggaaaaatattttcagaggtcactcgagatgcttatgctgttatcctggctggtggaaacctccagcctattgaagaaattaggctacgcgttgtgtccaagcttaccaccagctgatataaaattctttcagaatcttcccctattgtcaaagaggtctactgtctaatagaccaatatttttcagatgtcatggcaaggaggggccaaggtctgatgctattgttaggacatcatattagtattataatttcagtgagatcatgtagtgtgatgtgagaaatgtcttcttcatccattgccatggatggatggcagaccaaaaggcgagtactgcgtggggttgtaacacttttatagggttatattcaattcaagttattaaatttattactttgcg

SEQ ID NO: 25262 - DNA, 1463 bp, Panicum virgatum
  misc_feature: Ceres CLONE 1862769
  misc_feature: Encodes the peptide sequence at SEQ ID NO. 25263
actccgcatccatacccaagcccccacactaccaaccaccggagtctcgcgccgcccacaccgaagtaggagtatgcagctaggctccgcctcttcccgtcgcaatggctcagccatgtgagtcccctataggagcctccacctctcacctctcgccgccttcggtcagcaccggcagcgccatggccgcttcttggtcctagcagagatcaggagttggagggtgcgctgccacaccgctgaatgcttggagaaggtggagagcttggtgttgacctgtctgttcaattctgcacttctgtgtttctgatcatctgctcgtgcccggttcttgtctgctgaatctgtctctccaagcatggtcgggcaagcggcaaagacaaaggagtcagggaaagatgacagacaagaacccggagctgaggtgatgaaagagaagctactgccgtctcaccagcaagaagagtctccagcttctgtgatggataaggattcttcaggcatctcttcagttcctggtgatgtgtcgccggtcctagatggggattctggggagttgaaagtggaggagaacatggatagcaatgggaataaggaaaagaaaacatctcagaagagcagtacgagtgatggcttcgcttctgctaaagtgagtgatgggacaagcagtttgaggaagaccagtggtagtgccacgatgagtacgcgggctgatttcactgagagtgggaagagtagcatgtgccgtgtgagcactggcagtgacattagtgatgagagctcctgcagcagcatgagcagcaccactacgaaaccacacaaggggaatgattcaaggtgggaagcgatccatgtagtgaagtccagggataacgttcttggtttgaatcattttagactgctcaagaagctgggttctggtgatattggcagtgtgtatctctctgaattgagtggtacacggagttactttgcaatgaaggtcatggataagacatctttggcaagtcggaagaagctgcttcgagctcagactgagcgggagatcctgcagtccctggatcatccatttctaccaaccctgtatactcacttcgagacggataagttttcatgcttagttatggagttctgccctggaggggatcttcacactctgcgccaaaggcaacctggaaaatatttttcggagcaagcagcaaagttctatgtagcagaggtgctccttgcattggaatacctgcatatgcttgggattatataccgtgaccttaaaccagaaaatgtccttgttcgggaagatggccacatcatgctgtccgactttgatctttcacttcgctgttcagtaaacccaacggtgatcaagtctgccaatcctggcctagatgcactgcagaggaacaatgcagcatactgtgcccagcctgcttgcattgaaccatcctgcattcagccctcgt

SEQ ID NO: 25263 - protein, 368 aa, Panicum virgatum
  misc_feature: Ceres CLONE 1862769
  misc_feature (179)..(368): Pfam Name: Pkinase Pfam Description: Protein kinase domain
  misc_feature: SWISSPROT Homolog: EC 2.7.11.1 Non-specific serine/threonine protein kinase
MVGQAAKTKESGKDDRQEPGAEVMKEKLLPSHQQEESPASVMDKDSSGISSVPGDVSPVLDGDSGELKVEENMDSNGNKEKKTSQKSSTSDGFASAKVSDGTSSLRKTSGSATMSTRADFTESGKSSMCRVSTGSDISDESSCSSMSSTTTKPHKGNDSRWEAIHVVKSRDNVLGLNHFRLLKKLGSGDIGSVYLSELSGTRSYFAMKVMDKTSLASRKKLLRAQTEREILQSLDHPFLPTLYTHFETDKFSCLVMEFCPGGDLHTLRQRQPGKYFSEQAAKFYVAEVLLALEYLHMLGIIYRDLKPENVLVREDGHIMLSDFDLSLRCSVNPTVIKSANPGLDALQRNNAAYCAQPACIEPSCIQPS

SEQ ID NO: 25264 - DNA, 438 bp, Panicum virgatum
  misc_feature: Ceres CLONE 1862769-R
  misc_feature: Encodes the peptide sequence at SEQ ID NO. 25265
agggcgtgaactgggcgctcattaggtgtgcgagccctccggacattccaaagcctgtagagcttgactgctgcccgaagcaagtgccatcgccatcgacaaatggaaaggttgcaccagtcaccaaccaaaaggggccggataattacctagagtttgaattcttctagtttttttttctttcctttttgtgatatctgaaatgaaagagtgcatctgggctgatattgtggaagaaagcgaaagatgaggagctattctaggcatatgcttggctggaatttttcagctgttagactgtatgctcgctccaggagccccacaaccacaagttgttttacttgttgaagtgcttgactctaggatgtactgaattcatcatgtatgttgcaattttcgaaaccacctatcggtatcgagcgatgtaattgttgctgt

SEQ ID NO: 25265 - protein, 55 aa, Panicum virgatum
  misc_feature: Ceres CLONE 1862769-R
  misc_feature: SWISSPROT Homolog: EC 2.7.11.1 Non-specific serine/threonine protein kinase
GVNWALIRCASPPDIPKPVELDCCPKQVPSPSTNGKVAPVTNQKGPDNYLEFEFF

SEQ ID NO: 25266 - DNA, 2395 bp, Panicum virgatum
  misc_feature: Ceres CLONE 1862835
  misc_feature: Encodes the peptide sequence at SEQ ID NO. 25267
attgcgtcgttatccgactgcgtggaagcggatcatccctcatcagggatatccatcaacgttccttacattcgtttagcggattaaaatcttcccctttgcgctaaagcagtccaaggggcagcattgctggctcgtaagcctctgccctgcagctctagtctgtcgggccagcatttagctccgcctgcagcagctgaaagcctcatcctgatcttcggcgtcgaatccgacccgtttccatcagttcaccaatctccctggtgctctcgagctctaggatagagggcctgaccccaattccggccccaaaatccgatctttgctggtgattcctcggccggcccgatggggaagctcggggacaggctgcgcgccttctccacgaaccggtggctggtgttcgtcgccgcaatgtggctgcagtccatggccggcatcggctacctcttcggcgccatctcgccggtggtcaaggcggccctcgggtacaaccagcgccaggtggccgcgctcggcgtcgccaaggacctcggcgactgcgtcggcttcttcgccggctcgctctcggccgtgctgccgtcgtgggcgatgctgctcatcggcgcggcgcagaacttcctcgggtacggctggctctggctcatcgtcaccaggcaggtgccgccgctgcccctctggttgatgtgtgttcttatctttgttggaaccaatggagagacatacttcaacacaactgcacttgttacatgcattcagaacttcccaaaaagcagaggtccaatagtgggcattatgaaaggatttgcaggccttagcagtgcgatcttgacacaactgtatgcagtaatgcacacaccagaccatgccacacttgtcttcatggttgcagtcggtccatcattggttgccattggcctgatgtttattattaggcctgttggaggtcaccgccaggtgcgtccatccgacaagaacagcttcttgttcatctacactatctgcttgctcctcgcctcatatcttgttggcgtcatgctagtccaagatttcatggaactgagcgacaatatggttaattttcttactttgatcctactcatacttcttattttaccaatctcaatccctgcaaccttgacactatcatcaaaagcgcaacatccaactgaagaggctctcctttctgaaccatcaaaaggagagacaagcacttcacaagagagagaggatcaaccagaggtcattttaagtgaggtggaagaggagaaacctaaagacattgattcgttacctccatccgaaagaagaaagaggattgcggagttgcagaccaagttagtgcaagctgcggcaaggggtggggttagaatccgcaagcgaccacaccgaggggaaaactttaccctgatgcaagcatttgtgaaggctgatttttggcttatttggttctcgctcctgcttggatcaggatcagggctgacagtgatagataatctgggtcagatgagccagtctgtagggttcgaagatgcacatattttcgtgtcattgacaagcatatggaatttccttggtcgtgttggaggaggctacttctctgagattattgtcagggagcacacatacccaaggcatgtagcactggcaatcgctcagattctgatggctgctgggcatttcctctttgcaatggcttggcctggaactatgtacattgggaccttcctggttggacttggctatggagctcattgggctattgtgccagctgctgtttctgaactttttggcgtaaaacacttcggtgcaatgtacaatttcctcacagtagcgaaccccgcagggtcacttgttttctcggggcttattgctagtaacctgtatgactctgaagctgagaaacaagcacagcaacatcatatgacagcaatgcaatctccaagattgcttcacaacatgggtttgcttgcagatggaccgctgaagtgtgagggttctgtttgcttctttgtcagctcactgattatgtcagcattctgtattgtgggagctggtttgagcctcattattgttcagagaaccaaacgagtgtatgctcacctctatcgttctgtccgtacatgaaaattcaatggaaaggagatgttgaatcctcctatcattgatccatgtaccagatctttttgcatatatgtggtcatatgtacacaacattaaagtttgcctgtatattcccaaatcatttcagaggttgtatgtaatctgtgaagtgatgtttcctagtggaaatttacatgtcctatgcatcagatagtaagggtgtggttcatgcttggaccatgaattctgatacttgtagtcctgtaataaatacttgagttactttttgctc

SEQ ID NO: 25267 - protein, 592 aa, Panicum virgatum
  misc_feature: Ceres CLONE 1862835
  misc_feature (15)..(262): Pfam Name: Nodulin-like Pfam Description: Nodulin-like
MGKLGDRLRAFSTNRWLVFVAAMWLQSMAGIGYLFGAISPVVKAALGYNQRQVAALGVAKDLGDCVGFFAGSLSAVLPSWAMLLIGAAQNFLGYGWLWLIVTRQVPPLPLWLMCVLIFVGTNGETYFNTTALVTCIQNFPKSRGPIVGIMKGFAGLSSAILTQLYAVMHTPDHATLVFMVAVGPSLVAIGLMFIIRPVGGHRQVRPSDKNSFLFIYTICLLLASYLVGVMLVQDFMELSDNMVNFLTLILLILLILPISIPATLTLSSKAQHPTEEALLSEPSKGETSTSQEREDQPEVILSEVEEEKPKDIDSLPPSERRKRIAELQTKLVQAAARGGVRIRKRPHRGENFTLMQAFVKADFWLIWFSLLLGSGSGLTVIDNLGQMSQSVGFEDAHIFVSLTSIWNFLGRVGGGYFSEIIVREHTYPRHVALAIAQILMAAGHFLFAMAWPGTMYIGTFLVGLGYGAHWAIVPAAVSELFGVKHFGAMYNFLTVANPAGSLVFSGLIASNLYDSEAEKQAQQHHMTAMQSPRLLHNMGLLADGPLKCEGSVCFFVSSLIMSAFCIVGAGLSLIIVQRTKRVYAHLYRSVRT

SEQ ID NO: 25268 - DNA, 704 bp, Panicum virgatum
  misc_feature: Ceres CLONE 1862836-R
  misc_feature: Encodes the peptide sequence at SEQ ID NO. 25269
ttgctggttctggagccatatttacaggtgacactttgttcagtctatcatgcggaaagctttttgaagggactccacagcagatgtattcctcacttcagaaaattatagctttgcctgatgagacgaaagtatactgtggacatgaatatactttgagtaattcaaaatttgccctgagtgtagaaccaggaaataaagaattacaggaatatgctgcaaatgtagctgagttgcgcaataagaatatacccacggtgccaacaacaattgggagagagaagcggtgcaatcctttcctgcggacctccaatccagaaattaagagaactctgtccattccggatcatttcgatgaagaccgtgtacttgaagttgtccgtcgaacaaaagataacttctgactaacaaaaggaaattcttgtgacatggccaactatcttgttaaagttcggacaaagaaacacccgaaacacaagaaatgtaggaaagaaaggtatataagtttgggcttagattttgaaatgcttcggcaaaattgtgtctgagtgtatgtagcttggcagtgcttgtctatagcagccagtgatttttttttttgtctactacaaataaacatgttctgctatcatctacgctgtaaaaaaatgtgagttagttgttcgatagttaatttcaattcttgcagttcaatacattattag

SEQ ID NO: 25269 - protein, 133 aa, Panicum virgatum
  misc_feature: Ceres CLONE 1862836-R
  misc_feature: SWISSPROT Homolog: EC 3.1.2.6 Hydroxyacylglutathione hydrolase
AGSGAIFTGDTLFSLSCGKLFEGTPQQMYSSLQKIIALPDETKVYCGHEYTLSNSKFALSVEPGNKELQEYAANVAELRNKNIPTVPTTIGREKRCNPFLRTSNPEIKRTLSIPDHFDEDRVLEVVRRTKDNF

SEQ ID NO: 25270 - DNA, 2312 bp, Panicum virgatum
  misc_feature: Ceres CLONE 1862836
cacaaatcggcaagccctcaccaaccacattcgcctctcgcaccagtccgccgccttctctctctgtctctgtcgctctgcccgaaaccgaagcaaaccatggacccggagatggaggagccagaggagcagcagcacccggagccgccgcggccgtgggtgatcctgggccgcatcccccgcgttgtacccggcgacgcgcaggcggcggctgcggcggccgcggcggcgggggatgaggacgcggagcgcgccgccgccgacttctccttcccggtcgtgcctccgccgcgggtcaccgtcatgaacgccttcccgacagcacaccccgatcccaacaatcccgacaagtacccctacatcctcggcgtcagctccgactacatcctcctcaacttcggcgccgggcccgtccgcggcgtgtgcttggacgaccgccccgtcgtgagcaacctcgtcgtggcgcgccacttggacgcgtctggcgtcgagcagggccgcccgcccacgggcgcggccgagcgcatcccgcttcgcgacgccgagttccccgtcgtctccaacctcgagggcgtcgggatcctcgccacccccaacggcggctaccagtacatcatcgccgagctcgtggttgacaggggccgcgacgccgtcaagctcgtctacattttcgccgactccgacaggtggaaccaggaggtcattcccaaccccttgcccgacgtcgaccgggagtgggtgccctccggcgtggtcgcccacggtgagatgctctggtggttcgacctctcgtgggggatcatcagcttcgaccccgacgatgaactcgaagtcccgctgctgctcttccaccccctcccagaggaccgcgctctcgacatcaccgtgccgggcatccacgagcgccgatgcatcgcggagagcggcggcgagctgctgtacgtggagatcatcgtccctgacccagctgagggcggcgaatttggaccctcggtgtgcatgtggacgcggacctccgctggtgacggcaacaacgagaccatcgggtgggacgtggagcacttgctgaccttcgaggagatctggaacgacgacacctacgaggagaccgggctgccgcgggaggttcctgtgctcgcggccgtgtccccgacgaactccgatctggtctacttcgtcctgggggagcgcctcttcggcgtcgacctgctctcgtgcgcggtctctgagttcgtcgatgaggactacgacctggtgacaccgtggccggcggctccctcctgccgctacgttctcccatggtacctaccacaagaggttgccaaagctcttggcatagatcctggcgatttggacagcgctgaagctgagcagatggcggaggatgtccaagatcggctgtcaatcgacgtagaagagatgcaggaagatgaaatccacgaggaggagcagatggcagtggacatcgatggcatcctgaaggaagagttagaacacaatgtggaacagctgctagcggaagtccatgctgccaacgcgcaggcgcagcaggagccgtcaaccgaagacgaagagctggaggaagaagagctagacgaggaggagcagcagctagaggaaatcgatgaggagcagcagcagccagaggaaatggatgacgaggagcagatgccagaggaaatgggcgaggagcagcagctagaggaaatggacgaggagcagcagtcagaggaaatcggccaggaggaacagcagtcagaggaaatcggcgagcaggagcagcagtcagaggaattcgacgtgcaggagcagtcggcagaggatagctacggcgacgaaccaagcagcgaggagatgcttggaatggacgaggagcagcagtcagaggaaatcggccaggaggagcagcagtcagaggaaatcggcgagcaggagcagcagtcagaggaagtcgacgagcaggagcagtcggcagaggatagctacggcgacgaaccaagcagcgaggagatgcttggaatggacttggatcctgaccggtctgtaagcagcgaggaaagcaacacagggacgagcgacaaggagaagaaggaccacccagggccgagccaggacccaggagacgatgcaggagagggcggcttttgagttccagtatcagctcaccgaggagaaagctactctcctctcctcgccgtgccgtcccaccccgcccctcctctcctctgtctctctcctcgctccccacgccacgtatcgcctcgtctcctcggaagccggcagcgccccgcgggcacgggaagggggaggga

SEQ ID NO: 25271 - DNA, 711 bp, Panicum virgatum
  misc_feature: Ceres CLONE 1862844
  misc_feature: Encodes the peptide sequence at SEQ ID NO. 25272
gtcgtcgtcccaagccattcttcctgcagctagctaggtagctaggttgtacctgccactgccagtcgaggaagaagaagcgactggtcgatccaagccataccgatggggcgcgcaccgtgctgcgagaagagcgggctgaagaaggggctgtggacggtcgaggaggacgagaagctcctggtctacatcacgaggcatggccacagcacctggagcaccctccccaagaatgccgggctcgcacggtccggcaagagctgccggctgcggtggataaactacctgaggccggacctcaagcgcggcgccttctcctcccaggagaagcaggtcatcatcagtctccacagcatcctcggcaacaagtggtctgcgatcgcgagccatctgcccgggcggacggacaacgagatcaagaactactggaacacgcacatcagcaagcgccttcttcgcatgggcaacgaccccgtcacccacgcgccgcgcctcgacctctccgacctctccgccgccgccaccacctactgccccacgtcgcccgccggcctcctcgaggtccaggatactggatccatcgtaagcagctcaggtaccatagtctcaaccgcctacacatccagcgtctctcgcccctctactatctctatggaggcggccatgcactttgcctccttggagatcgacgaggacgtcaacatcggtagc

SEQ ID NO: 25272 - protein, 201 aa, Panicum virgatum
  misc_feature: Ceres CLONE 1862844
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1002 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1010 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Useful for making plants with altered terpenoid content
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: Useful for making plants with modulated biomass
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 126 in the 10/412,699 US patent application
  misc_feature: Useful for making plants with altered cell wall content and/or composition
MGRAPCCEKSGLKKGLWTVEEDEKLLVYITRHGHSTWSTLPKNAGLARSGKSCRLRWINYLRPDLKRGAFSSQEKQVIISLHSILGNKWSAIASHLPGRTDNEIKNYWNTHISKRLLRMGNDPVTHAPRLDLSDLSAAATTYCPTSPAGLLEVQDTGSIVSSSGTIVSTAYTSSVSRPSTISMEAAMHFASLEIDEDVNIG

SEQ ID NO: 25273 - DNA, 465 bp, Panicum virgatum
  misc_feature: Ceres CLONE 1862850
  misc_feature: Encodes the peptide sequence at SEQ ID NO. 25274
  misc_feature (77)..(77): n is a, c, t, g, unknown, or other
aacaagagccaccgccgcccccccctcttttacccgagcacagccccacaccacgccagcgccagccgcccaaccancgcaaagaccaagcccccagacacagccacgaaccaggacaggacagcggagccccagagacacggggagggcgagaacggacacgacgccgccgccaccggcaagggcgagagccagccggagccgccgcgggccgacccccagaacagggggaaggcggcggagaaccaggccgggagccaccaggaggccggcaagcggacggcggaggagcaccgccggccgccggcgaggaccgagggggccagccgcacgggcgcccaggccgccgccgcggccgcggccggcgaggaccggggggagcacgacgagaccgcccgcggccgcgcccaggccagcagcgacagggacacgaccagcacgaggaacggcaccgacagcgacggc

SEQ ID NO: 25274 - protein, 154 aa, Panicum virgatum
  misc_feature: Ceres CLONE 1862850
  misc_feature: SWISSPROT Homolog: EC 4.3.1.5 Phenylalanine ammonia-lyase
  misc_feature (26)..(26): Xaa is any aa, unknown, or other
NKSHRRPPLFYPSTAPHHASASRPTXAKTKPPDTATNQDRTAEPQRHGEGENGHDAAATGKGESQPEPPRADPQNRGKAAENQAGSHQEAGKRTAEEHRRPPARTEGASRTGAQAAAAAAAGEDRGEHDETARGRAQASSDRDTTSTRNGTDSD

SEQ ID NO: 25275 - DNA, 605 bp, Panicum virgatum
  misc_feature: Ceres CLONE 1862856
  misc_feature: Encodes the peptide sequence at SEQ ID NO. 25276
atggctacagcgaaggggcaggggcctttaatgcagctcctgctgctcctcatccttgcccagatgagcctcaccggctccagccctccgccggatcccgtagcctgcgcccacggcacctccaactgcaccatcaacaacgcatatgcctccttcccggaccgcagaccctgccacgccgcccgggtcgcctacccacgcagcgagcatgagctcgtcgcggccgtggcggccgcggtggctgccaagcgtaaggtgaaggtcgccaccaggtactcccacagcttcaccaagctggcctgccccggcggcagcgacggcgccatcatcagcacgcggtggctcaaccggaccgtgcgggtcgacgccaagaatcggctcatcacggtggagagcggcgtgctcctcagggagctcatccgtgccgccgcctcggctgggctctcgctgccatacacgccgtactggtttggcctcaccgtcggcggcctcctggcgaccggcgcgcacggcagctcgatgtggggcaaggggggcgccgtgcacgagtccgtggtggcgctgaggatcgtgacgccggcgccggcgagccggggcttcgccat

SEQ ID NO: 25276 - protein, 191 aa, Panicum virgatum
  misc_feature: Ceres CLONE 1862856
  misc_feature (50)..(191): Pfam Name: FAD_binding_4 Pfam Description: FAD binding domain
  misc_feature: Useful for making plants with modulated nitrogen use efficiency
MQLLLLLILAQMSLTGSSPPPDPVACAHGTSNCTINNAYASFPDRRPCHAARVAYPRSEHELVAAVAAAVAAKRKVKVATRYSHSFTKLACPGGSDGAIISTRWLNRTVRVDAKNRLITVESGVLLRELIRAAASAGLSLPYTPYWFGLTVGGLLATGAHGSSMWGKGGAVHESVVALRIVTPAPASRGFA

SEQ ID NO: 25277 - DNA, 638 bp, Panicum virgatum
  misc_feature: Ceres CLONE 1862888
  misc_feature: Encodes the peptide sequence at SEQ ID NO. 25278
gttcccctccccacccacacactctctctccctccgcatgtcaacggccctccccgcggactccgtccccgcccccagttcccgggcctagttacgagccgccctcggctccggatcagcgcggcccgccgctctcgtcatggcatttccgtcgcgggtggctctgctcgtcgcgggggtgttggtgatgctggggctctccgcggcggcggcggcggcggcggcggcggcggcggaagggcgagggagcgtgtgcttccgccgggtgttcagcttcggggactcgctcacggacaccggcaacttcctgctctccgtgccagaggacttcccggaccctgcgcggaacctcccctacggccagaccttcttcggccgcccatccggacgctactccgacggccgcaacctgctcgacttcttcgcggaagcatttgggcttccattcgtgccgccgtaccttggcggtggggacttccaatatggtgcaaactttgcggtcggcggggctactgccctcaaaggttcgttcttccgggaacgtggtgtggagcctacatggacgccacactgccttgatgagcagatgcagtggttcaagaagcttctcccatcaattgcgccatcagagacagaac

SEQ ID NO: 25278 - protein, 166 aa, Panicum virgatum
  misc_feature: Ceres CLONE 1862888
  misc_feature: SWISSPROT Homolog: EC 3.2.1.51 Alpha-L-fucosidase
MAFPSRVALLVAGVLVMLGLSAAAAAAAAAAAEGRGSVCFRRVFSFGDSLTDTGNFLLSVPEDFPDPARNLPYGQTFFGRPSGRYSDGRNLLDFFAEAFGLPFVPPYLGGGDFQYGANFAVGGATALKGSFFRERGVEPTWTPHCLDEQMQWFKKLLPSIAPSETE

SEQ ID NO: 25279 - DNA, 664 bp, Panicum virgatum
  misc_feature: Ceres CLONE 1862911
  misc_feature: Encodes the peptide sequence at SEQ ID NO. 25280
gtgttcgatcaatatgcatgtgcaattgtgcagagatcatcagacagcggtccaatcaactcctacatatatagtcgcccttgtcagccattcgttggaattcattcatcatattagtcatatatagatagggatcggagtagaacagccgatcgatcgcgcgccaggagggagctaggacaagagaatcgaagacagctagcgaatcgagatcttccaactaaccaagaggcaacgtacaataatggaggaggaggggcagtcgtcggcgccgttgctggaggagaagcagccgcagaccgccggggtggaagggtgccccgggtgcgccgtggacaggaggaaggcggccaacccgggcatcccctacggcagcttcatctacgtctggatcgtcaccctctgcacagctttaccaatatcatcattgttccccttcttgtattttatgataagagacttgaatgttgctaaaagaacagaagatatcggcttctatgccggttttgtaggtgcttcatttatgtttggtagatgcttgacttcaacagcttggggaatagcggcagaccgtattgggaggaaaccagttgtcatgtttggcattttctccgtggttgtgttcaatactttgtttgggctaagtgtcaactattggatggca

SEQ ID NO: 25280 - protein, 139 aa, Panicum virgatum
  misc_feature: Ceres CLONE 1862911
  misc_feature: Useful for making plants with modulated flowering time
MEEEGQSSAPLLEEKQPQTAGVEGCPGCAVDRRKAANPGIPYGSFIYVWIVTLCTALPISSLFPFLYFMIRDLNVAKRTEDIGFYAGFVGASFMFGRCLTSTAWGIAADRIGRKPVVMFGIFSVVVFNTLFGLSVNYWM

SEQ ID NO: 25281 - DNA, 2294 bp, Panicum virgatum
  misc_feature: Ceres CLONE 1862913
  misc_feature: Encodes the peptide sequence at SEQ ID NO. 25282
aaggtccacagaccacaggccacagccactgagccacatctccgagttcgttcgagttccatccatgtcttcatctcgcgtttgccttattggctacctcgccatgatcggcctcctccacaattcccttctttattctgttaccgccgacgtcgacttactctacaacggcttccagcacgcccccgacctgatcctaaacggctcggcgtcgatcttgcgcggcggcgcgctccagctcaccaacgacagcaacaacctcatgggccacgccttcttcaattcgccggtgcaagctgtcagcgacaacgccgtcgtctccttcagcacggccttcgtttttgacatagtgaccgtcggccagggcggtggccacggcctggccttcgtggttgcggcttccaaggtgctgcccggtgcaactgccgagcagtaccttggcctcctcggcaagaacaatcagggcaactccagcaaccatgtcttcgccgtggagttcgtcacggtgcaggcaaacgggctgctgaacgagacgaacggcaaccacgtcggcgtcgacctgaacagccttgtgtctaacgtgtcggagccggccgggttcttcaccgacgacggcaagaacatctccgtgacgctcgagagcgcccagcgaattcaggcgtgggtcgactacgacggcagcaccaaggttctcaatgtgaccatagctccggtgtccgtggcaagccggcctcaccggccgctcatctcgcgcgtcatcgacctcctgccgatctttaagcaagacatgtatatcggattctcggcagcgaccgggaagttggcgagctcgcattacatcctcgcatggagctttcgtaccggaggagctgcggcccaagccatcgatctctcccggctcccgaaagttccaaagcctccagctcccccaccttccatgtccaccgtcatcaggatcgtggctgtatcctccgtggtcacgctcaccacgatcctcttggcgattgctttcacactttggctgcggcggagggccgtcctcgccgagaagctggaggagtgggagctggaccaccctcacaggttgccgtacaaagagctttacaaggccaccaaggggttcaagaacagcgggctcctcggcgccggtggtttcggccaggtgtacaaaggcgtgctccggcgctccggcgacgtcgtagccatcaagcggatctcgagcaacggcacgcaggggatgcgcgaattcgtcgccgaggtcgcgagcctcgggcgcatgcggcaccggaacctggtcgatctgcgcgggtggtgcaagcgagggcaagacctgctcctggtctacgagttcatgcccaacggcagcctggacacgcacctgttcggcgaccgcgccggtaccggcgccggcaagcaccggggatcgtcaccggcggcggcgctgctgacgtgggagcagcgagccatgatcctcaggggcgtcgcgtccgggctggtgtacctgcacgaggagtgggagcaggtggtggtgccccgcgacgtcaaggccagcaacgtgctcctcggcgccgacatggccccgcggctcggcgacttcggcctcgcgcgcctctacgagcacggcgcggcacccgcgacgacgcgcgtcgtcgggacgctggggtacatggcaccggagctcaccgtgaccgccagggccaccaaggaaaccgacgtgttcgcgttcggcgcgctgctcctcgaggtcgcctgcggccgtcggccgatcgaccccgtcaccggcgtcaacctaccgcggtgggtccgggaccacggcgccaggggcaacctggtgcgcgccgtggacgagaggctcgacgggcgctacgacgaggaggaggcgaggctggtgctgtggctgggtctcatgtgcagccagtcgcggccggaagcgaggcccagcatgcggcaggtctgccagtatctggacggcgaggcggagatgcaggaggaggccgtggtcgtcttctcggacgccggctccttcgacttcgcgtcgttgccgaccctgacgtggtcgtcctgcaatacaatgtcagtgggatcactcctaggcggccggtgatcatgctcggttaacggttatctgctcctccttcgcgagcctctaccgttttgtttccctgatgctttttgaacgaaattggtgttatgttagttatgtgtaccacgcaccacgcgtgtacttcctgcctgtataatactggttacaagttgccagctaaaactaaaagttctaccatactttgggcttc

SEQ ID NO: 25282 - protein, 679 aa, Panicum virgatum
  misc_feature: Ceres CLONE 1862913
  misc_feature (28)..(265): Pfam Name: Lectin_legB Pfam Description: Legume lectin domain
  misc_feature (353)..(634): Pfam Name: Pkinase Pfam Description: Protein kinase domain
  misc_feature: SWISSPROT Homolog: EC 2.7.11.1 Non-specific serine/threonine protein kinase
MSSSRVCLIGYLAMIGLLHNSLLYSVTADVDLLYNGFQHAPDLILNGSASILRGGALQLTNDSNNLMGHAFFNSPVQAVSDNAVVSFSTAFVFDIVTVGQGGGHGLAFVVAASKVLPGATAEQYLGLLGKNNQGNSSNHVFAVEFVTVQANGLLNETNGNHVGVDLNSLVSNVSEPAGFFTDDGKNISVTLESAQRIQAWVDYDGSTKVLNVTIAPVSVASRPHRPLISRVIDLLPIFKQDMYIGFSAATGKLASSHYILAWSFRTGGAAAQAIDLSRLPKVPKPPAPPPSMSTVIRIVAVSSVVTLTTILLAIAFTLWLRRRAVLAEKLEEWELDHPHRLPYKELYKATKGFKNSGLLGAGGFGQVYKGVLRRSGDVVAIKRISSNGTQGMREFVAEVASLGRMRHRNLVDLRGWCKRGQDLLLVYEFMPNGSLDTHLFGDRAGTGAGKHRGSSPAAALLTWEQRAMILRGVASGLVYLHEEWEQVVVPRDVKASNVLLGADMAPRLGDFGLARLYEHGAAPATTRVVGTLGYMAPELTVTARATKETDVFAFGALLLEVACGRRPIDPVTGVNLPRWVRDHGARGNLVRAVDERLDGRYDEEEARLVLWLGLMCSQSRPEARPSMRQVCQYLDGEAEMQEEAVVVFSDAGSFDFASLPTLTWSSCNTMSVGSLLGGR

SEQ ID NO: 25283 - DNA, 696 bp, Panicum virgatum
  misc_feature: Ceres CLONE 1862916
  misc_feature: Encodes the peptide sequence at SEQ ID NO. 25284
aacaataaaggctgggtcgaagaggaaggggaagcttggaccgagcgagagaggaggggccggccgagcgagagggagagaggaattaatgggtgaggaggccagctgcaacgccgtcagcgtgatggaggccgccaagcagcagcagccgccgcccaaggagaacggcctcgccgctgccggggaggccgctgccgcggccgcggccgacccccgcctgcagggcatctccgacgccatccgcgtcgtcccccacttccccaaagaaggcatcatgttcaacgacatcaccacgctgctgctgcgccccggggtgttcaaggaagccgtcgacctcttcgacgagcgctaccgcggcatgggcatcgacgccgtcgccggctaaacaggtgaagccgaagccgcaataaaccctccctcccaaacaaccagactgaaaaaacatcatacctaatccatgctgctgctgcttatgtcgcacaccaccttttgcattactactatttgcctcgggattgaggccaggggcttcatatttggcccggcaatcgcattggccattggcgccaagttcataccgctgcgcaagcctaggaagctcccaggtgaggtgatctccgagaaatatgttcttgagtacgggactgattgtttagagatgcacgttggagccatcgtgcctgctgagcgtgtcat

SEQ ID NO: 25284 - protein, 98 aa, Panicum virgatum
  misc_feature: Ceres CLONE 1862916
  misc_feature: SWISSPROT Homolog: EC 2.4.2.7 Adenine phosphoribosyltransferase
MGEEASCNAVSVMEAAKQQQPPPKENGLAAAGEAAAAAAADPRLQGISDAIRVVPHFPKEGIMFNDITTLLLRPGVFKEAVDLFDERYRGMGIDAVAG

SEQ ID NO: 25285 - DNA, 638 bp, Panicum virgatum
  misc_feature: Ceres CLONE 1862931
  misc_feature: Encodes the peptide sequence at SEQ ID NO. 25286
gaagacacatttccaaaaccccgtcggtgcgaggacacacgcatcgcgagttcgcgacgcccccgcacgcaggcacggacccgggtctatctcacgcacgcagcaggcgcggaaagcaacccgccttcaccgcccccgcttgccgtctccctcccgtatcgtcgtcttcctgcccgggacgcggccaagcagcaagcgcccaaacccccaaacccaagcctctggcggcgcccgcgccaccttgaagcaagcgcccgtgcgattggcgggtcggagttggatatggtggcggcggcgctggacgcaatggaggggacgcggtgggggcggtggctgggcctggtgacggcggtgtgggtgcagtgcatctccggcaacaactacaccttctccaactactcggacgcgctcaagacgctcatgggcctcacccagctgcagctcaacggcctctccgtcgccaaggacgtcggcaaggcgttcggcctcctcgcggggctcgcctccgaccgcgtcccgacctggctcctcctcgccatcggctccctcgagggcctcctcggctacggcgcgcagtggatggtcgtgtccaggaccgtcgccgccgctcccctactgggagatgtgcgtctccctct

SEQ ID NO: 25286 - protein, 118 aa, Panicum virgatum
  misc_feature: Ceres CLONE 1862931
  misc_feature (16)..(118): Pfam Name: Nodulin-like Pfam Description: Nodulin-like
MVAAALDAMEGTRWGRWLGLVTAVWVQCISGNNYTFSNYSDALKTLMGLTQLQLNGLSVAKDVGKAFGLLAGLASDRVPTWLLLAIGSLEGLLGYGAQWMVVSRTVAAAPLLGDVRLP

SEQ ID NO: 25287 - DNA, 515 bp, Panicum virgatum
  misc_feature: Ceres CLONE 1862936
  misc_feature: Encodes the peptide sequence at SEQ ID NO. 25288
gtgcacccacccaaaccttttggtacgtgggcggcggcggggaggatctcggagtccgaggaggagatggcggcggcggggaacgagtggatcaacgggtacctggaggcgatcctggatgcgggcgcgaggcggcgcggggagcggggcgcgccggcgccggctctggcggaggcgtcggcggcggcctaccgccccacgcgctacttcgtggaggaggtcgtcagccacttcgacgaccgggacctccacaggacttggaccaaggtggtagcgatgcgcagcagccaggagcggaacaaccggctggagaacctctgctggaggatctggcacgtcgccaggaagaagaagcaggtggaatgggagtactcgcggcagttggcgcggcggcggcaggagcaggagctgggcagtcgagaggccgcccaggagctctccgagggcgagaaggactgccccgacggcgcctcggccctccagccccctagcgcggctgacggcgaccaacaaca

SEQ ID NO: 25288 - protein, 149 aa, Panicum virgatum
  misc_feature: Ceres CLONE 1862936
  misc_feature: SWISSPROT Homolog: EC 2.4.1.14 Sucrose-phosphate synthase
  misc_feature: Useful for making plants with altered cell wall content and/or composition
  misc_feature: Useful for making plants with modulated biomass
  misc_feature: Useful for making plants with modulated carbohydrate content
MAAAGNEWINGYLEAILDAGARRRGERGAPAPALAEASAAAYRPTRYFVEEVVSHFDDRDLHRTWTKVVAMRSSQERNNRLENLCWRIWHVARKKKQVEWEYSRQLARRRQEQELGSREAAQELSEGEKDCPDGASALQPPSAADGDQQ

SEQ ID NO: 25289 - DNA, 703 bp, Panicum virgatum
  misc_feature: Ceres CLONE 1862949
  misc_feature: Encodes the peptide sequence at SEQ ID NO. 25290
tcaagattctggagctggaggagcccatcgcgcggatgaaggtcatccacgtcgcagggaccaagggcaagggttcgacatgcacgttcaccgagtcaatcctgcgatcgtgtggcttccacactgggctgttcacctcaccacatttgatggatgtcagggagcgattccggctagatggagttgatatttctgaagagaaatttttgaagtacttttggtggtgctggaataagttgaagcctatttcaggttcctggcgttgctcgcattcaagatattttctgctgagcaggtgaaataaacacaagcatcccctgtcctttctgcctgctttgctaatttcagtcgttacatctgtctagccataaagatggccaagtcattttacttgcatagcagtggacaaatctatgattttaaggtggacacgtctatcacatatggatatgggttcttctgagacttcgattttactcactggttatacatcttgagtttcctacatcaacatcaacatcaacaaagcctttttccgtgtctttttatggctctaataggtagatgttgctgtcctcgaggttggccttggagggaagtttgatgcaactaatgtggttgaagcacctgtagtttgtggggtatcttcgcttggatatgatcatatggaaattcttgggaatacgcttggagaaatcgctgg

SEQ ID NO: 25290 - protein, 98 aa, Panicum virgatum
  misc_feature: Ceres CLONE 1862949
  misc_feature: SWISSPROT Homolog: EC 6.3.2.17 Tetrahydrofolate synthase
KILELEEPIARMKVIHVAGTKGKGSTCTFTESILRSCGFHTGLFTSPHLMDVRERFRLDGVDISEEKFLKYFWWCWNKLKPISGSWRCSHSRYFLLSR

SEQ ID NO: 25291 - DNA, 1639 bp, Panicum virgatum
  misc_feature: Ceres CLONE 1862950
  misc_feature: Encodes the peptide sequence at SEQ ID NO. 25292
ccggcgcctccgccgccgccctccaccaccgccgtcgctaatcacccccaaccctagatccaccgccggcggcgtccccgccgctgccttggcaacccgcctccactgccgcctcgccgcgccgccctcgcaacccacctccaccgtcgcctcgccgtgccgccctcgcaaccctgcccccctcccaccttctcaggtcgccggtggccacagccgtccccggcaaaccccgttcctcgaagtctggccgacacagctcgaggaagaagatgaacaggaccttgtgcgacgcgctcgattccactcgcgcgcgcgataaatagacttccccatgtcattaggctcgccatggctatagttccgaggtttagggtttaggctcgaactcgaacccctctccccgggcctccctcatggcctctgcgtctcgagcgagggtcggcactctggttccccttgccaaggacaatgctggctcatctaatggatccgtatcagccatccccatcttcgagggttccaatgtcgtcgggaggaatcatttggtcatcgccgacaagaggatcagccgcaagaatctgagcctccatgcctctgcagatggctccattgaagtcgtagtagaagggccaaatcctattattgtccgatcagaggggcagaggaggaaggtttctgcccaggaaacagccaagattacacacaacgatgtcctggaactgattccgggtgattattttgtgaagtacatggatatggctgatgacccaattggttcaaacggcctaaagaagggaaagaggcacagtgaggaagatagtgcagctgtcaaaaggaatcggcagattatggaagatgaagctttggcaagaacactacaggagagttttgcagaagagagcacaaatgtttctgacatggcttctggtcaaacatcaagtctgcttgacagttctgggtcttccaagagaagtaacaagagaatgcactccgtcggtccttcaaatgatgtgccctctttgactcttcgccttatgcgtgtccagggtcttccatcatgggctaacagttcgtcagttaccgttcaggatgtcatacagggtgaagtgcttcttgcagttctctcagattatatggtggacattgattggttgcttactgcttgtccaagtttgaggaaagttcctcacgtcctagttatacatggagaagacggtgcttcattggagcttttgaagaaaatgaagcctgcaaattggatcctccacaaacctccactcccgatttcatttggaacacatcattccaaggccatgctgcttgtatatcctcaagggattcgtgttgttgtgcacacagcaaacatgatacatgttgactggaataacaaaagtcaaggtctatggatgcaagactttccctgcaaagatgcaaaggatatcaataaaaaagttccatttgaaaatgatctggttgattatctcagtgcacttaagtggcctgagttcagggtgaatctcccagtggttggcgatgtcaatatcaatgcatcattctttaggagatttgattatagtagcgcaatggtcaggttgattggatcagtttctggttatcatgcgggccccagtattaagaa

SEQ ID NO: 25292 - protein, 408 aa, Panicum virgatum
  misc_feature: Ceres CLONE 1862950
  misc_feature (197)..(408): Pfam Name: Tyr-DNA_phospho Pfam Description: Tyrosyl-DNA phosphodiesterase
MASASRARVGTLVPLAKDNAGSSNGSVSAIPIFEGSNVVGRNHLVIADKRISRKNLSLHASADGSIEVVVEGPNPIIVRSEGQRRKVSAQETAKITHNDVLELIPGDYFVKYMDMADDPIGSNGLKKGKRHSEEDSAAVKRNRQIMEDEALARTLQESFAEESTNVSDMASGQTSSLLDSSGSSKRSNKRMHSVGPSNDVPSLTLRLMRVQGLPSWANSSSVTVQDVIQGEVLLAVLSDYMVDIDWLLTACPSLRKVPHVLVIHGEDGASLELLKKMKPANWILHKPPLPISFGTHHSKAMLLVYPQGIRVVVHTANMIHVDWNNKSQGLWMQDFPCKDAKDINKKVPFENDLVDYLSALKWPEFRVNLPVVGDVNINASFFRRFDYSSAMVRLIGSVSGYHAGPSIK

SEQ ID NO: 25293 - DNA, 403 bp, Panicum virgatum
  misc_feature: Ceres CLONE 1862950-R
cccaacccctcaagtccataccacaattttcgtgcacggagaagaaccgcccaagccaggatggcctcacccttggcaagacgatcaagaccaagctggtcacgctttgctggaaaggcgacgaggaaacggaaccatctacgaaaaccgtcagattgcctgtgccatatcaactccctccacaaccttacggcccagaagatgtcccttggtcatgggatcggaggtacacaaagaaggatgtgtatggttcagtctggcctcgtcatggctagctactgtctgtgcgaggtagtgacggttcccaaaccctgttccatggttaacgtcggtatagcggtgtagccagtgattcactggcccctggattattggtcaaatatgagtcgaaccgttcttgttt

SEQ ID NO: 25294 - DNA, 507 bp, Panicum virgatum
  misc_feature: Ceres CLONE 1862968
  misc_feature: Encodes the peptide sequence at SEQ ID NO. 25295
gtaacgggaagggcagtaaaggagggctttggttgcctccgagccatccggccgtccttttcctcggccacctcctcctcttcagactcctttcctcgcggcgctggcgcggctctccgcgcgccacagaccggtgttgctcctgtctatggcctcccaccgcgccgtggtggcgttctcgccggacgccgccagggagtgcttcacggagcacgacgtcgccttcgccaaccgcccgctgttcccctcgcagaagctcgcgtccttgggcggcacctcgctctccaaggccaactacgggcccaactggcgcaacctccgtcctgtcgacgccgtgcacctcctctccgcgcaccgcgtcaccagcatgtcccccgccatctccggcaaggtgcgagccatggtgcgcctcatgagaccccccgccgcggctgcgccgggaggcgccgcgcgcgcacaactgaagcgaaggctgtttctacctcttccctcaccgccctaacggaa

SEQ ID NO: 25295 - protein, 117 aa, Panicum virgatum
  misc_feature: Ceres CLONE 1862968
  misc_feature: SWISSPROT Homolog: EC 1.14.13.89 Isoflavone 2'-hydroxylase
MASHRAVVAFSPDAARECFTEHDVAFANRPLFPSQKLASLGGTSLSKANYGPNWRNLRPVDAVHLLSAHRVTSMSPAISGKVRAMVRLMRPPAAAAPGGAARAQLKRRLFLPLPSPP

SEQ ID NO: 25296 - DNA, 1814 bp, Panicum virgatum
  misc_feature: Ceres CLONE 1862969
  misc_feature: Encodes the peptide sequence at SEQ ID NO. 25297
aacgcgccagaccatccccacaccagacccgccattgccccgactcgaacacggggcgaaaattccttcgagtcctctcagatctcgcttctggaagcttccgcgccggcgcggctgatgaccacgaagcccgctcccatggagaacggcgccgcggccggcgccggtgggggcaaccgccgacgcggcggccggtggcagtatgcggccgcgggtgccctcctcgtggccgtcctcgccgtggccgtgagctcccgcagcttcccgggcaccccctcctcttcgccaggaggctgcggctgccctgctgcgaggaagtacacggggatggtggaggactgctgctgcgactatgagacggtggactctatcaatgaagaggtcctgcatccgtccctgcaggaactcgtcaagttacccttcttcaggtacttcaaggttaaattgtggtgtgactgccctttttggcctgatgatggaatgtgccggcttagagactgtagtgtctgtgagtgcccggagaatgagttccctgaaccattcaagaagccttacaatggactttctccagatagtatgatatgccaagaaggaaaaccgcaggctgctgttgataaaacccttgacaccaaggttttcaaaggatgggttgaaactgacaatccatggacatctgatgacgagactgataataatgagatgacttacgtgaatcttcaactgaatcctgaacgatacactggctatactggtgattcagcaagaaggatatgggactctatttacaaagaaaactgcccaaaatatccctcagaagaattgtgtcatgagaagaaggcattgtacaagcttatttcagggctgcactcctcaatttcagtgcatattgcttatgattatcttcttgatgaatctactaacgtgtggggacaaaaccttcctttgctgtatgaccgtgtccttaagtacccagagcgtgtccaaaatctgtacttcacctacctgtttgttcttcgagcagtgacaaaggcagcagattatcttgagcaggctgagtacaatactggcaatcctgaagacgacttgaaaacacaatctcttgtgaagcaattgctttaccatcccaagttaagatctgcatgcccaaaaccttttgatgaagcgaaactctggcaaggcgagaatggtcctgagctaaagcaagagattcagaagcaatttagaaacattagtgcaattatggattgcgttggctgcgagaagtgccgactatgggggaagctccaagttcttggtcttggaactgcactgaaaattcttttctctgttgatggagataacaatttgaaccagccattgcagctgcagagaaatgaggtcattgcattgttcaatcttctgaatagactgtcagaatctgtgaagtttgtacatgaaaaaggatcatcaattgaagaggtcattaaggagcagagccctccaactgttcaaaagggtgtttccaagccgaaccttaaactggacttcctctgagatgtaggagtgtaatttgtagttacatgcacatgccggccatgtaccgagagagcaacatgtacatgttggaagcagtttcctatgaggttctgttgcagccctatacaagacaatgagatacagacccttgggagctaaatacaatgacagagttaacccagtttttctcttccatcttggtgggctccggcccttaaaattttcgatgtatagtttacctcatttgttgtaaggatctcactggcttcacattcgtcatgatgaagagaggataaccc

SEQ ID NO: 25297 - protein, 471 aa, Panicum virgatum
  misc_feature: Ceres CLONE 1862969
  misc_feature (88)..(439): Pfam Name: ERO1 Pfam Description: Endoplasmic Reticulum Oxidoreductin 1 (ERO1)
  misc_feature: The sequence is a functional homolog of SEQ ID NO 2 in US patent 7064247
MTTKPAPMENGAAAGAGGGNRRRGGRWQYAAAGALLVAVLAVAVSSRSFPGTPSSSPGGCGCPAARKYTGMVEDCCCDYETVDSINEEVLHPSLQELVKLPFFRYFKVKLWCDCPFWPDDGMCRLRDCSVCECPENEFPEPFKKPYNGLSPDSMICQEGKPQAAVDKTLDTKVFKGWVETDNPWTSDDETDNNEMTYVNLQLNPERYTGYTGDSARRIWDSIYKENCPKYPSEELCHEKKALYKLISGLHSSISVHIAYDYLLDESTNVWGQNLPLLYDRVLKYPERVQNLYFTYLFVLRAVTKAADYLEQAEYNTGNPEDDLKTQSLVKQLLYHPKLRSACPKPFDEAKLWQGENGPELKQEIQKQFRNISAIMDCVGCEKCRLWGKLQVLGLGTALKILFSVDGDNNLNQPLQLQRNEVIALFNLLNRLSESVKFVHEKGSSIEEVIKEQSPPTVQKGVSKPNLKLDFL

SEQ ID NO: 25298 - DNA, 687 bp, Panicum virgatum
  misc_feature: Ceres CLONE 1862977
  misc_feature: Encodes the peptide sequence at SEQ ID NO. 25299
atgtctgcatcgatctgaccttgggtaggcgcacgcgatgggtcgataagtaagtaagtacacccttcgtgcatcaatactggccacagctagtagatcaagcaagcattgcgtggcctcgtctctgcagtgtgcagcaataatggaggtgccaccgccatggctgtcctccctcgcggtcctgctggtcaccgccctcttcctcgcggcggccgtcctccgccggcgaggagcgcgcaacaagcggcgctacaacctcccgccgggcccccggccgcggccggtgatcgggaacctgaacctgatcggcccgctgccgcaccagtccatccgcgagctctcggcgcggcacggcccgctcatgtcgctccggttcggctccttccccgtcgtcgtcggctcgtccgtcgccgccgccgagttcttcctccggacccacgacctggcgttcctcgaccggccccgcatggcctgcggcaagcacaccgtctacaactactccggcatgctctggtcccactacggcgcctactggcgccagctccgcaagctgtggctgacggagctcctcagcgcccggcagctccggcggacggagcacgtccgcgccgaggaggtgcgcgccctgctgagcgacatccgccgcgcggccggcggcggcggcgcggcggcggcgccggtggtggt

SEQ ID NO: 25299 - protein, 181 aa, Panicum virgatum
  misc_feature: Ceres CLONE 1862977
  misc_feature: SWISSPROT Homolog: EC 1.14.13.68 4-hydroxyphenylacetaldehyde oxime monooxygenase
  misc_feature: Useful for making plants with altered carbohydrate content
MEVPPPWLSSLAVLLVTALFLAAAVLRRRGARNKRRYNLPPGPRPRPVIGNLNLIGPLPHQSIRELSARHGPLMSLRFGSFPVVVGSSVAAAEFFLRTHDLAFLDRPRMACGKHTVYNYSGMLWSHYGAYWRQLRKLWLTELLSARQLRRTEHVRAEEVRALLSDIRRAAGGGGAAAAPVV

SEQ ID NO: 25300 - DNA, 703 bp, Panicum virgatum
  misc_feature: Ceres CLONE 1862986
  misc_feature: Encodes the peptide sequence at SEQ ID NO. 25301
agccatacccattctgttcccctcccaaacaaaacttgctttgaaatctcgcttcactgcgaacgctgcagcggaggaagaaaaagaaagaagaagaaaaaaaacaattcgtagcggaaatcagcaagcaaaagaagaaaataatttccataagaaatcgcccaatcccccttcctccttttctcttgaggcttcggaacgtgcggggaacttagccaggatggtggcgatcgagaaccagagccaggtcgcgcgggcggcggcggcggaggcggtgccggcagcggggccgcggatccccaaggaggcgcggcggctgctgcacgacctggcggcggcgtgggcggacgtgtcggactgccgcgcgctccaggtcgtgccgctcaagggcgccatgaccaacgaggtgtaccaggtgcgctggctcaccggcgtcccctccgcgggcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttccccaacggccgcgtcgaggagttcatccacgcaagggtacctactacctactcgataccgcctccttatcaaactacctgctgttgttatatgact

SEQ ID NO: 25301 - protein, 160 aa, Panicum virgatum
  misc_feature: Ceres CLONE 1862986
  misc_feature (1)..(50): Pfam Name: Choline_kin_N Pfam Description: Choline kinase N terminus
  misc_feature: SWISSPROT Homolog: EC 2.7.1.82 Ethanolamine kinase
MVAIENQSQVARAAAAEAVPAAGPRIPKEARRLLHDLAAAWADVSDCRALQVVPLKGAMTNEVYQVRWLTGVPSAGGEAEEPRGEREVRKVLVRIYGDGVDLFFDREDEVRTFECMSRHGQGPRLLGRFPNGRVEEFIHARVPTTYSIPPPYQTTCCCYM

SEQ ID NO: 25302 - DNA, 2144 bp, Panicum virgatum
  misc_feature: Ceres CLONE 1863000
  misc_feature: Encodes the peptide sequence at SEQ ID NO. 25303
ctctttcccccctccccgttttgcccccacccaaaccctagcaagacctcccaacatggccgccgccgccaccgccgccgccgaccaggctctggacacaactggcgacgtcttggcgaccaaggagaaggttccggcgaagggcgtggtggcggccgtagggagcctgcagcaggaggtggagactttacaggtgcaggactacaaggacgcgagcatgtactatggtgcttacccagcttacgcctacggagcctatggtggctggggggattactccacatacttgagccatgagggagcacagacaccaacttctggtgcctatgctgatatgtactatggctatgctccatatggtgttgcagcgttggggcatgatggtcagatttatgggtctcagaattaccagtacccatcgacatacaacaagcagcagaattccactgacaagctgtcatccaatgttaaaagtgaaaaggtcactccatcgccacaaggggatgtctccactaacggcattgatggggtgaagagtctgaaaaattcgaactcgtccctgaagtcagaccggccagtttccaatggttcgtatggccgatctagtgctcgttctggtagctaccagaaccagactaactggtcagcctatccgtattacagtagcgagatgttctctgacaagcagcaaaaacttcccagcaatcgcaattcaaccgctttcaatactaaaaccaagggtcagtctaggaatcaaaacacgagacagtatcctcatctcatgacgccaacttcaccaatgggatccccatcgatttactcagctaatggaatctatgggtacgactcatatggacctggcctttggtatggatcgcatatgtatagttctgggttatatggtggatggaatgggctgtatgatggaaagtacaggcccagaagcagagataatgggtactatgcttatggcaatggaagcctagatggtttcaatgagctgaaaagagggccaagaagtggtctgtacaaaagtcagcaatggcttggagctactactgaagtgcctgcaaaagagcaggaccttccggctactaatggctcacatgctgccgtgaagaatcagtataacctgcctgactttgcggaaacatactcagatgctaaattctttattattaaatcatacagtgaggatgatgttcacaaaagcattaagtacaatgtgtgggctagcacccccaatggtaataagaagcttgatgccgcttatcaagaggctaaagaaaaatcatgtgaatctcctgtcttccttcttttctctgtgaatgccagtggtcagtttgttggcctcgctgagatggtgggtcgcgttgattttaacaaaacagtggagcattggcaacaggataagtggactggttgtttccctgtcaagtggcacattgtgaaggatgttccaaacagcttgctgaagcacatcattctcgagaacaatgagaacaagccagtgacaaacagcagagatacacatgaggtgaagcttgagcaaggccttcaagtgcttaagattttcaaggatcatgtctgcaagacatccatactggatgactttggcttttatgataaccgtgagaagatgatgcaagagaggaaagcaaagcagcagcagtcactgaagaaggtcatcgatgtgaagctgccaaatgctgccgatgcagagaagaaaagtctcgaaggggagactgtatcaactgaactcgctaaggttgaggttgaagttttgaacaaagagccttcacttgacaaaggagagaaaaatgatgcaagaggaaatggtgttgccccagaagatctgaaatctccaactgagaagttggcaggtgcaaatggctgctaattaatttagtcatcgcctcagccattgctggtggtatggggcaaaacctataggttgtggggtttgagtttgaggcaatttgagatcccattaagcttatttcttgttcctgtttcctacttccccatagcttgtttcataggagctagaggtttagctagttgcttgtgtttggcgatagttgtggtctgtgttctggcatatcagttatttaggaatagaaggatgattaactgggttttcc

SEQ ID NO: 25303 - protein, 614 aa, Panicum virgatum
  misc_feature: Ceres CLONE 1863000
  misc_feature (420)..(510): Pfam Name: YTH Pfam Description: YT521-B-like family
MAAAATAAADQALDTTGDVLATKEKVPAKGVVAAVGSLQQEVETLQVQDYKDASMYYGAYPAYAYGAYGGWGDYSTYLSHEGAQTPTSGAYADMYYGYAPYGVAALGHDGQIYGSQNYQYPSTYNKQQNSTDKLSSNVKSEKVTPSPQGDVSTNGIDGVKSLKNSNSSLKSDRPVSNGSYGRSSARSGSYQNQTNWSAYPYYSSEMFSDKQQKLPSNRNSTAFNTKTKGQSRNQNTRQYPHLMTPTSPMGSPSIYSANGIYGYDSYGPGLWYGSHMYSSGLYGGWNGLYDGKYRPRSRDNGYYAYGNGSLDGFNELKRGPRSGLYKSQQWLGATTEVPAKEQDLPATNGSHAAVKNQYNLPDFAETYSDAKFFIIKSYSEDDVHKSIKYNVWASTPNGNKKLDAAYQEAKEKSCESPVFLLFSVNASGQFVGLAEMVGRVDFNKTVEHWQQDKWTGCFPVKWHIVKDVPNSLLKHIILENNENKPVTNSRDTHEVKLEQGLQVLKIFKDHVCKTSILDDFGFYDNREKMMQERKAKQQQSLKKVIDVKLPNAADAEKKSLEGETVSTELAKVEVEVLNKEPSLDKGEKNDARGNGVAPEDLKSPTEKLAGANGC

SEQ ID NO: 25304 - DNA, 606 bp, Panicum virgatum
  misc_feature: Ceres CLONE 1863009
  misc_feature: Encodes the peptide sequence at SEQ ID NO. 25305
ctcccaattccttcgcttctcgatttcacagcagcctttgcagccgagctgaatcgtctggttcaaatcatctcccctctctctctctctctctctctctctctctctctctctctctcgcagcctcccttgttggttggttggttttcgcctccgatccaaagggaagagagccatggcgctgatgacgctgcgttccaccacgtcgttcctgtcgcccgtcgaccccagctccaagctcctccacaagcccggcgccgacgacgcgccgccgagctgcgccgccgtgcccgccccgccccacggcgccgcgcctagcgcaaggctgggccgcggcgtggggggacgtgtcggactgccgcgcgctccaggtcatgccgctcaagggcgccatgaccaacgaggtgtaccaggtgcgctggctcaccggcgtcccctccgcgggcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttcc

SEQ ID NO: 25305 - protein, 77 aa, Panicum virgatum
  misc_feature: Ceres CLONE 1863009
  misc_feature: SWISSPROT Homolog: EC 2.7.1.82 Ethanolamine kinase
MPLKGAMTNEVYQVRWLTGVPSAGGEAEEPRGEREVRKVLVRIYGDGVDLFFDREDEVRTFECMSRHGQGPRLLGRF

SEQ ID NO: 25306 - DNA, 1775 bp, Panicum virgatum
  misc_feature: Ceres CLONE 1863026
  misc_feature: Encodes the peptide sequence at SEQ ID NO. 25307
gcaccccgcgactcccgactcccgagcggtgctccaatttcaatccccttccccggcgctgtcttccgatcatccgccgccgccgacgccgccctcgtgccctcaccgtgccactcccgctcgcgccagcctcctctcctccatctctgccgcgcgtcgcatcgcgcagctgccgtcgccctggcggagcgccggggcggctccggcccgatcagaggcggccggtgaggcggtgcggtgccgaccgttggggaggcgagcggcggcggggcggcccgtgtagaggatgatctacacggcgattgacaccttctacctgacggacgagcagctgcgggactcgccgtcgcggaaggatgggatcaacgaggccactgagaccgcgctccgcgtctacggatgcgacctcatccaggagagcggcatcctcctcaggctaccacaagcagtgatggccacagcacaagtattgtttcatcgcttttactgcaagaaatcatttgttcgatttagtgcaaagagagttgctgctagctgtgtttggctggcagggaagttggaggaaagtcctagaagatcaaagcatattatatttgtattccatagaatggaatgtaggagagaaaacttgccaattgaatacttagatatctgttcaaagaaatactcagagctgaggcatgatctgataaggacagaacggcatctgttgaaggagatgggttttatttgccatgtcgaacacccccataagttcatatcgaactaccttgtaacacttgaagcccctgagctgactcaagaggcatggaaccttgccaatgatagcttgaggacaactctgtgtgtgcgattcaagagtgaagtagtagcatgtggagttgtgtatgctgcagctaggagacgcggtattgcccttcctgaggatcctccgtggtggactgtcttcgatgctgatgaagctggaatccaagaagtttgccgggttcttgctcacctctacagcctccccaagtcagagtacataccagtatataaagacaatgattcctttactgttagaaggacaccagagccgcaggtttcaaaggaaagtcctgcaagtgctgttgctagcgataagggaacccctataccctcaagttctagccaggagaaggattcggtgacaaaggctgcaccagacaaggtcaaggaaaaaagtgacgatgaaggtaagccattgcctgctgaactcaatggaaaacaagatgcagcggcgaagttgaagaatgagaaatcagagttgggtgttgactggagtcgggaacgagaacgagagagatcaagaggacaggaccgtgatggcaggggtagggattctgatcgtgatagcaggggccgtgactcggatcgtgaaagggacaggagacggcgttctagggagagaagtttgggacattcagacaagcagaggtcaaggcgccactcatcacgagaccgtggtgactactatagttcccactcatctcgtgaaaaggatcggcacaggcaccattgatcaagctgaggatccctgtccacaaagtttcgccgcacggagaccaacagaagaacgaagcagaataatttgtagtgcgggtgtcatctcatcattgcacatgccaatggctttacctttgcctccattattttggcacctgaattttgtaacatgctgctggggacttgaatttgtagaaactgaaccaaggactcgagggagaattggcgtacggggcccactggcattagtc

SEQ ID NO: 25307 - protein, 417 aa, Panicum virgatum
  misc_feature: Ceres CLONE 1863026
  misc_feature (4)..(149): Pfam Name: Cyclin_N Pfam Description: Cyclin, N-terminal domain
MIYTAIDTFYLTDEQLRDSPSRKDGINEATETALRVYGCDLIQESGILLRLPQAVMATAQVLFHRFYCKKSFVRFSAKRVAASCVWLAGKLEESPRRSKHIIFVFHRMECRRENLPIEYLDICSKKYSELRHDLIRTERHLLKEMGFICHVEHPHKFISNYLVTLEAPELTQEAWNLANDSLRTTLCVRFKSEVVACGVVYAAARRRGIALPEDPPWWTVFDADEAGIQEVCRVLAHLYSLPKSEYIPVYKDNDSFTVRRTPEPQVSKESPASAVASDKGTPIPSSSSQEKDSVTKAAPDKVKEKSDDEGKPLPAELNGKQDAAAKLKNEKSELGVDWSRERERERSRGQDRDGRGRDSDRDSRGRDSDRERDRRRRSRERSLGHSDKQRSRRHSSRDRGDYYSSHSSREKDRHRHH

SEQ ID NO: 25308 - DNA, 1239 bp, Panicum virgatum
  misc_feature: Ceres CLONE 1863036
  misc_feature: Encodes the peptide sequence at SEQ ID NO. 25309
tgcttgtctctagtctctgctgctactgcatctactgctttctctctgagctaacaagcttctttcgatccccagcgtaacgtggccgccgtacgtcaagctgctgcctactatactgccaggtgccagccagctcgagccgcgggagctagctagctagctgtggaggatggcgcacgatccgagcctggcgtacgcggactacttcgcggcggcgggcggcgtggccacgctcgtcccggaggtggacgcggcgggggaggacgagggccacctgtacggcggcgtgcacgcgcaccaccacgggctcgaaatgttcggggccagaggcctcgtgccgggcgccacggtggcggccgcggcgcacggcaaggccgcagccgcgctcggggacttcggcctcggcgccgagcaccagtaccgcctgctgggccacagccagcagccgccgctgacgtccctgtcgctgcacgggtccgccgaggccgcgtcgctggctctgcaccaccaccagcttggcggcggcggcggcgcgctcaggcagcaccagccggcggcgtggccgcagcagccgcagcagggcggcgcgtggcacctgcgcggctccaggttcctgcgcccgacgcagcagctgctgcacgaattctgcggcctccccgtggaggccaccggcgcggcggcttccaagccgccggcgaagccggggagcgaggaccgcgccggggaggggtcgtcgtcctcggccccgtcggcgcagatccaggccatggacgccgccgagctgcagaggctcaaggccaagctctacgccatgctccaagaggtcaccctctctaatcgctcaccacgcctcgattaaccgtcacacacagcacaggtccaccagcagcaggatcaggatcagctcgcgactcaggatcaggagcccttgcatgtcatgtccttggaaatctaaaaaactgcagccaagtgcgagttcaattatggcttgtctgaagggccctgggcggctggggcaggcacggacagttgttgccattctaggagggcctcagcctcacctcctgcctttggaaacctccagccctccatccttcgcctcgccgcagacgtagctacgcacctgtacagggcaacctgtagctcccgcagatcagcagggccatgccatgagccccatcaccgcgcagcggcagcccagacctctgcagagctaccactgctagtctgctctctctc

SEQ ID NO: 25309 - protein, 229 aa, Panicum virgatum
  misc_feature: Ceres CLONE 1863036
  misc_feature (141)..(224): Pfam Name: POX Pfam Description: Associated with HOX
MAHDPSLAYADYFAAAGGVATLVPEVDAAGEDEGHLYGGVHAHHHGLEMFGARGLVPGATVAAAAHGKAAAALGDFGLGAEHQYRLLGHSQQPPLTSLSLHGSAEAASLALHHHQLGGGGGALRQHQPAAWPQQPQQGGAWHLRGSRFLRPTQQLLHEFCGLPVEATGAAASKPPAKPGSEDRAGEGSSSSAPSAQIQAMDAAELQRLKAKLYAMLQEVTLSNRSPRLD

SEQ ID NO: 25310 - DNA, 681 bp, Panicum virgatum
  misc_feature: Ceres CLONE 1863036-R
agccgacgcgggcgcagctgcaggtccacgacgacgcggggtccctggcctccgtcgtgagcatcggcagcggcggcaggggcccgcagaacatcgacttcggcatgatggacggccacctcgacctcggcgcgtacggcgacgccgcccacgccgcgggggccgggcacggcttcggcggcggcgtgtccctgacgctggggctgcagcagcacgccggcgacccgcacggcggcgtgaacgtcgcgttcgcggcggcgcatgagttcctgttcatggcgggcggcgagcagcatcagcagcagcagatggtcgcgggcggcggcgtcgtccacggtcaccagggccagttcggcgccggaatggacggcgacgacgccgtggccgcctcgcactaccaccaccggggcatcagcgccgccacggggttccagctcctccacgacctggccggctgatggcatgatgatttgattagcacgagcgggctgcgtgctttaatttgcttttggaggttcacgcggtggttgacggggatgcgccaacggcagcgaacagcagctagcggatggcattgggcatggggcgcatggcgcgagcgcagcttgtgcgcctcttgtttttttttttgagatagtaccaccttcaattaagaaatatagttggtacaaactctatcag

SEQ ID NO: 25311 - DNA, 532 bp, Panicum virgatum
  misc_feature: Ceres CLONE 1863039
  misc_feature: Encodes the peptide sequence at SEQ ID NO. 25312
gtctgctctctctctctctcttttcgtccgtcgcctgctgctgcttccccgtccggcggtttcattcgcgatcgttgcttctccgatccatcacgtattgacatggcggcggaggccaagcacttcaagtacgtcatcctcggcggcggcgtcgcggcggggtacgcggcgagggagttcggcaagcagggcgtcaaccccggcgacctcgccatcatctccaaggaaccctttcggctggacaaattgctagacggatcggaggaacctgctggcgctgctccatcggtacggtagttgaaacaagcggaggagaggaacccgttttttcgcttgtttctctatctatctgtatacaccagagaacgaattgaattggacacctggatgaaattccgcaccatgttccttcaacccatcctcaccaacgtttcttctgctgtttgctggcaagccggagagatttcagaccaactgaacaagatgccaacaacagccggctccttagccgacatgcttgtgtgcagctgat

SEQ ID NO: 25312 - protein, 64 aa, Panicum virgatum
  misc_feature: Ceres CLONE 1863039
  misc_feature: SWISSPROT Homolog: EC 1.6.5.4 Monodehydroascorbate reductase (NADH)
MAAEAKHFKYVILGGGVAAGYAAREFGKQGVNPGDLAIISKEPFRLDKLLDGSEEPAGAAPSVR

SEQ ID NO: 25313 - DNA, 701 bp, Panicum virgatum
  misc_feature: Ceres CLONE 1863049
  misc_feature: Encodes the peptide sequence at SEQ ID NO. 25314
tcccgtccccccccccccccaccccaaagcgcagccagccagagccgtccggagtccacgaggacagcgtcgtcgtcctcctcctccgccgccgccgccggccgcagcagaacagagcccacgtgcgctccgtccgggtggagcgcacgagcgcgggttcagggagcgaggggatcggggcggcgctcggcttgactgcgcgggatggcgggccgcaaggatgtcgggatcctcgccatggacatctacttcccgcccacctgcgtgcagcaggaggcgcttgaggcccatgacggcgcgagcaaagggaagtacaccatcggtcttgggcaagattgcatggccttttgcagtgaggtggaggatgtcatctcaatgagtttgaccgttgtcaattccctacttaaaaagtacgatgttgatccaaagcttattggccgtttggaggttggaagtgagacggttatagacaaaagtaaatccatcaaaacttggctgatgcaaatttttgagaaaagtggcaatactgacattgaaggagttgactccagcaatgcttgttacggtggaactgctgccctgctgaattgcgtgaattgggttgaaagtaactcctgggacggacgctatggtcttgtcgtttgcacagacagtgcggtttatgctgaagggccagctcgtccaactgggggtgcggctgc

SEQ ID NO: 25314 - protein, 165 aa, Panicum virgatum
  misc_feature: Ceres CLONE 1863049
  misc_feature (5)..(165): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MAGRKDVGILAMDIYFPPTCVQQEALEAHDGASKGKYTIGLGQDCMAFCSEVEDVISMSLTVVNSLLKKYDVDPKLIGRLEVGSETVIDKSKSIKTWLMQIFEKSGNTDIEGVDSSNACYGGTAALLNCVNWVESNSWDGRYGLVVCTDSAVYAEGPARPTGGAA

SEQ ID NO: 25315 - DNA, 655 bp, Panicum virgatum
  misc_feature: Ceres CLONE 1863058
  misc_feature: Encodes the peptide sequence at SEQ ID NO. 25316
aaccccaactccaactcgacccgggaagggggggagaaggagagagagagagagagagagagagagagagagaggcgcggcgaggaggccggcggcggcgccggcagcggcagccggggatgggggaggtggccgcgctgcgccagctcgtcggccaggtgcaggagctctgggacctctacggcgccaacgcccacccgctccccagatggtatttacttgactttgaacatggttcaatcaaagatgattattgtggaggacggactggatacaactcggaattactgaagatcatggagactaaccaatctcctcctcgcaagcgaccgtggagagatcgaaaccgcgagaaggcgccctgttcaaacacaactgaggtaatgcaacaggagatttggaaagagttccctgaagatctttttgaaactgtcattgcaaggcttccagttgctgcaatttttcgattccgcactgtctgccgaaagtggtcttctcttttgggctcagacagtttctctcatcagtactctgaagctccacatggactgccatggttctatacaatcacccatgagaatgcaaacaataatgttgcaatgtatgacccttcactgaagaaatggcaccacacatctgttcctcttgctcctac

SEQ ID NO: 25316 - protein, 178 aa, Panicum virgatum
  misc_feature: Ceres CLONE 1863058
  misc_feature (92)..(139): Pfam Name: F-box Pfam Description: F-box domain
MGEVAALRQLVGQVQELWDLYGANAHPLPRWYLLDFEHGSIKDDYCGGRTGYNSELLKIMETNQSPPRKRPWRDRNREKAPCSNTTEVMQQEIWKEFPEDLFETVIARLPVAAIFRFRTVCRKWSSLLGSDSFSHQYSEAPHGLPWFYTITHENANNNVAMYDPSLKKWHHTSVPLAP

SEQ ID NO: 25317 - DNA, 1907 bp, Panicum virgatum
  misc_feature: Ceres CLONE 1863059
  misc_feature: Encodes the peptide sequence at SEQ ID NO. 25318
agagttgagactcctcgcggctcggaatcccatctcgcgaggaggattggaggaagaggaagcggaagaggaggaagagaaggagcgtggcggcgcgatggctcccgatccggaggcggcggctggcgggcaggcggagccgcccgacgaggaggaggacgaccccgacgtcgacgaggtcgaccccaccggccgctacctccggtacaaggagatcgtgggatcaggtgccttcaagacagtgtattttccgatcttccctcgtcagctgtttattagcagtgataattcagtagcagatgacagtaactaatccctcgaattcaaaggcatattcgtaaactcgagcagccacataattcaggccctgaatacttgcttcattatttcaaacgaaaaaaatacgaaacagttgtttggtgttgctgcatcacgtgatcgatttggtggcagctacaaaggcttcgacgcggtggacggcatcgaggtggcgtgggccaaagtggagataaccagccggatcatgggatccccgaaggagctgcagcggctcaagacggagatccagctgctgcggtctctccagcacaagcacatccttaagctctatgcctcgtgggtcgacaacaagaagaggaccgtcaacatcatcactgagctcttcacctccggcaacttgaggcagtaccgtacaaagcacaaaaaagttgacatcaaggcaatgcggcgatgggcgaaacaaatattgacagggctagcttatctgcacgatcagaagccaccaatcatacacagggacttgaagtgtgacaacattttcatcaatggaaaccatggaaaagtaaagattggggatttcggtttggcaatggtcatgcaacagaggaagacacagagtatacaaggcaccttagaattcatggcaccagagctctttggtgaaaactacaatgagttggtggatatatattcttttgggatgtgtatgcttgaaatggtgactggtgagtgcccttacagtgaatgtcagggctttcttcagatatacaagaagatttctgaaggtgtaaaaccaatttctctctccaagatcaaagatgcagaagtaagtttcatagagggctgtctgggttcagcagctgacagattaccagcaagtgagctcttgaagagcccttttatcctgaaagatgacatcatcaatgataaaacctttaatccagcacaagaaccgatagcgtttccacaaaatttggatctagatctcgatgccacaccaattttcgtctctttgttatccaatggaactcctggtgatgggaaggagtctatcagcctggtgcttcggaggggtgtttttgtgctggaaggagatatgaggatcaacgaccccgtcaagttgttactaagaattcctgtccccaatggtaagtgtaagaacattgagttcgcatttgacctggagaaggacacgagtctttcagtggctactgagatggtcgaagagcttgaactgccttcttggagcatgcatgctgtggcgaagctgatcgatgcattcttgctcaagacggtgcgcggctggaggccctgcgttcaggtcggccagatgattcaggcagtgctcaacactgcatcagcagatggaacgtgaaattgtgaatccaaatctctcggtgtttttctgaatccaaagcactggttcaatgctcatggtcatccattctgcccctcttgtacatgctcaaatcgcaatgccatgaacggtgttgctaagcacatcttttttttatttgatgatggctaaagattgtgcatgcatgattactaatttctctagattagttcttgtagtatttcatattatttttggagtcttttattcataggaaagaggacgatcgttc

SEQ ID NO: 25318 - protein, 376 aa, Panicum virgatum
  misc_feature: Ceres CLONE 1863059
  misc_feature (1)..(220): Pfam Name: Pkinase Pfam Description: Protein kinase domain
  misc_feature: SWISSPROT Homolog: EC 2.7.11.1 Non-specific serine/threonine protein kinase
MGSPKELQRLKTEIQLLRSLQHKHILKLYASWVDNKKRTVNIITELFTSGNLRQYRTKHKKVDIKAMRRWAKQILTGLAYLHDQKPPIIHRDLKCDNIFINGNHGKVKIGDFGLAMVMQQRKTQSIQGTLEFMAPELFGENYNELVDIYSFGMCMLEMVTGECPYSECQGFLQIYKKISEGVKPISLSKIKDAEVSFIEGCLGSAADRLPASELLKSPFILKDDIINDKTFNPAQEPIAFPQNLDLDLDATPIFVSLLSNGTPGDGKESISLVLRRGVFVLEGDMRINDPVKLLLRIPVPNGKCKNIEFAFDLEKDTSLSVATEMVEELELPSWSMHAVAKLIDAFLLKTVRGWRPCVQVGQMIQAVLNTASADGT

SEQ ID NO: 25319 - DNA, 1241 bp, Panicum virgatum
  misc_feature: Ceres CLONE 1863060
  misc_feature: Encodes the peptide sequence at SEQ ID NO. 25320
gcggccgcgccatggccgaaacgctcgccctcccgctccccctccgcgcaccggcgccgccgccgcgccctactatccccaaccccatcatcacccaccgccagcctcacacaccctcctcctcccctcctcgcctcttctccccgacctccctcctctccacctcccgccccaacccagcctcctcctcccgcaagccgcgtctcggccgcccactcgacccctcccgaggcgggaccggcggcgacgaccagccgtggcacctgccgccgtcccccaccctccccgcccgccgcgcgctcgtcgcgctcctcgccgacccggcggaacactcctccccgcgcgacatcctcgccgctctctcagagaccgatctcgccgccgtcctgaacgcgctcgcctcccgcggggggcaccccggcgtagcgctcgtcgcggtccgcgccgcgcgggacctccacggtgaccgcgccctccaccacccgcgcgtgctcccagccgccgtccgcgtgctcgcgcgcgccggccgcctcgccgaggcctccgctctcctcgaggccgcgctggagcccgacgccagcgcatacacggcgctcgtgtccgcgttctcccgtgccggccggttccgggacgcggtcaacgtgttccggcgcatggtggatagaggcgtgcggccgtctctcgttacctacaacgtcgttctccatgtctactccaagatgactgtaccgtggaaggaggttgtggcgctcgtcgactccatgaaggaggacggtgttgcaatggacaggtatacttacaacacgctcatcagctgttgccgtcgtagggggctttacagggaggcggcacagttgtttgatgagatgagggctgctggtttcaaacctgacaaggtcacgttcaattccctgctcgatgtgtatggtaaggcacggaggcatgaggatgcagttgtggtgctcaaggagatggagaatgcaggctgtccacccagtgtggtgacctacaattcgctcatctcagcatatgtgaaggatgggttgctgaaagaggctctggagctgaaaacggagatggaggtgaaggggatgaagcctgatgtggttacatacacaacattgatctctggccttgacaggattggcaaaattgatgcagcagtaggtacatacaatgaaatggtgagcaatgggtgtagcccgaacttgtgcacgtacaatgcattgatcaagatgcat

SEQ ID NO: 25320 - protein, 409 aa, Panicum virgatum
  misc_feature: Ceres CLONE 1863060
  misc_feature (331)..(365): Pfam Name: PPR Pfam Description: PPR repeat
  misc_feature (261)..(295): Pfam Name: PPR Pfam Description: PPR repeat
  misc_feature (296)..(330): Pfam Name: PPR Pfam Description: PPR repeat
  misc_feature (190)..(224): Pfam Name: PPR Pfam Description: PPR repeat
  misc_feature (366)..(400): Pfam Name: PPR Pfam Description: PPR repeat
MAETLALPLPLRAPAPPPRPTIPNPIITHRQPHTPSSSPPRLFSPTSLLSTSRPNPASSSRKPRLGRPLDPSRGGTGGDDQPWHLPPSPTLPARRALVALLADPAEHSSPRDILAALSETDLAAVLNALASRGGHPGVALVAVRAARDLHGDRALHHPRVLPAAVRVLARAGRLAEASALLEAALEPDASAYTALVSAFSRAGRFRDAVNVFRRMVDRGVRPSLVTYNVVLHVYSKMTVPWKEVVALVDSMKEDGVAMDRYTYNTLISCCRRRGLYREAAQLFDEMRAAGFKPDKVTFNSLLDVYGKARRHEDAVVVLKEMENAGCPPSVVTYNSLISAYVKDGLLKEALELKTEMEVKGMKPDVVTYTTLISGLDRIGKIDAAVGTYNEMVSNGCSPNLCTYNALIKM

SEQ ID NO: 25321 - DNA, 682 bp, Panicum virgatum
  misc_feature: Ceres CLONE 1863060-R
  misc_feature: Encodes the peptide sequence at SEQ ID NO. 25322
tgcaacctataatagcctgatgcatatgtattctcgtttaggtgattgtgaaaagtgtgaaacaatcctcagtgagatcaaatcaagtggcatgcgccctgatcgatattcatataacactgtgatatatgcatatggaagaaaaggacagatgaaagaagcctctaggttgttctctgagatgaaatgttcaggcgtgaaaccagatattgtaacatacaatattttcatcaagagctatgtcgccaactcaatgtttgaagaagctattgatttagtacgctatatggttgcccaaggttgcaggcccaatgagagaacttgcaattcaatattgcagggctattgtagacatggaaggatggtagaggccaaatcattccttaccaacctccctaaactttatcctggaatatctaaacaagaaaaacagaaactgttagaactgttggcaaaacacacttcttaagacggttgttgagaatgaaaccatttttggtattcctgaggatgataagtagatagtactattttttatttgtccttagtggcatgtacatcacagcggattgtacagattacatgtgttgtgaagaagaatcaaaagaacctgttgaaatacatatagttcctctgctaactttgcaggggaactcatggtgtagaaccttcatactggacg

SEQ ID NO: 25322 - protein, 155 aa, Panicum virgatum
  misc_feature: Ceres CLONE 1863060-R
  misc_feature (36)..(70): Pfam Name: PPR Pfam Description: PPR repeat
  misc_feature (71)..(105): Pfam Name: PPR Pfam Description: PPR repeat
  misc_feature (1)..(35): Pfam Name: PPR Pfam Description: PPR repeat
ATYNSLMHMYSRLGDCEKCETILSEIKSSGMRPDRYSYNTVIYAYGRKGQMKEASRLFSEMKCSGVKPDIVTYNIFIKSYVANSMFEEAIDLVRYMVAQGCRPNERTCNSILQGYCRHGRMVEAKSFLTNLPKLYPGISKQEKQKLLELLAKHTS

SEQ ID NO: 25323 - DNA, 300 bp, Panicum virgatum
  misc_feature: Ceres CLONE 1863068
  misc_feature: Encodes the peptide sequence at SEQ ID NO. 25324
agggcgacggcctcctccctgttctcccacgtccacccggagcccactgaccccatcctcggggtcactgaagcctacctcgccaacccctcgcgaaacaatgacaaccatggccttcgtccctaccgggaagataaccgacatcccctcgtgttcgattgagtgatcgacgccgagcgctcgattggcggtatccctgaaatggacaatcacacaccgggaagtattataaagatgattgaacaaacgatgaaaccggttataacaataggattctaaactactaaaaaaatagaggat

SEQ ID NO: 25324 - protein, 53 aa, Panicum virgatum
  misc_feature: Ceres CLONE 1863068
  misc_feature: SWISSPROT Homolog: EC 2.6.1.1 Aspartate transaminase
RATASSLFSHVHPEPTDPILGVTEAYLANPSRNNDNHGLRPYREDNRHPLVFD

SEQ ID NO: 25325 - DNA, 1373 bp, Panicum virgatum
  misc_feature: Ceres CLONE 1863070
  misc_feature: Encodes the peptide sequence at SEQ ID NO. 25326
aaaccatccgcgacttctctacaggcgcggcgttagcgcgcctaccatcctagaagaagtttccgccactggcggaaaagcaacctccatcctctccgccgctctcgctccgcggccgcgcaactgcgcaacatggcgaacgccgcctctccggcgcctcacccaacgccgccgcagccgccgccgcaggcacccactgacccgaagagggcgctgaccgtcaacgcgcaccgcttgaaagcgattggcgaacgcctcagggaccacctgagcggcatgtccatcctccccgtcggcgagttcgtccacctcacctacgccttcgccagagggatcgacttcgcggtctcggctggtgatattcctgtggtggccaatgagatacccgccattttgagaaagatatatgagctgaggaaagaaacatttatacaatcttcgcttatggtactagtgatatcgtgcaagaatgcttgctccaagaaatggtttcaacctacagattccagtgacattctcagaatagctaatgagctctctggtaacttctgcacatcctctggccaggcagctagtgacagcgctgtgcttgaaattatatcacaaataatgccaaggtattatccatggttgaagtttgggcgtctaatcacttctattgaagcaaaggttggctatgatgtattaatgtctgacttctttattgagaggaacctatctcgagatgaaaagattagactaattgttgtacaaaaggaaaatttagatgcctcgacatgtgtcacaagcccaccacatgtgagctttttggtcaatggaaagggtgtggacaagaggactaatgtttcaatggacctaggaccccagttcccttctgatatcaccaaaatgctcaaatatggggcaaacattatccaagctgttggatattttaatgctaattatatcatagctgtagcatttataaacaatgtggcatccttcagtgctccaaaactggatgactatactcaacctatcactgtttatcctgcagattctgatgtacttgagggaccatcaagagtttcactaaattgtcctataagtttaaagcgcataaaaactcccattaaagggcgcctttgcaaacactatcagtgttttgattatgataattacatggagatgaactcaagaaaaccaaactggcgctgtccatattgtaataccccttcaaacttcactgacctacgcattgaccaaaagatggcaaagatactagaagagactggagataatgtcgttgatgtacttgtatttgctgatggatcttggaaagctgcaccagctcatgatgagaaatcagatagtcatagaggtgatgccatcct

SEQ ID NO: 25326 - protein, 413 aa, Panicum virgatum
  misc_feature: Ceres CLONE 1863070
  misc_feature (312)..(361): Pfam Name: zf-MIZ Pfam Description: MIZ/SP-RING zinc finger
MANAASPAPHPTPPQPPPQAPTDPKRALTVNAHRLKAIGERLRDHLSGMSILPVGEFVHLTYAFARGIDFAVSAGDIPVVANEIPAILRKIYELRKETFIQSSLMVLVISCKNACSKKWFQPTDSSDILRIANELSGNFCTSSGQAASDSAVLEIISQIMPRYYPWLKFGRLITSIEAKVGYDVLMSDFFIERNLSRDEKIRLIVVQKENLDASTCVTSPPHVSFLVNGKGVDKRTNVSMDLGPQFPSDITKMLKYGANIIQAVGYFNANYIIAVAFINNVASFSAPKLDDYTQPITVYPADSDVLEGPSRVSLNCPISLKRIKTPIKGRLCKHYQCFDYDNYMEMNSRKPNWRCPYCNTPSNFTDLRIDQKMAKILEETGDNVVDVLVFADGSWKAAPAHDEKSDSHRGDAI

SEQ ID NO: 25327 - DNA, 658 bp, Panicum virgatum
  misc_feature: Ceres CLONE 1863070-R
tgtaccacctgctgctcctagcacacctcaggctggatcctcagatggtcttccacctgacctccctgtggatgagaactggtgccccacgggtcagatgagagggagtttgacaggcaatgcctacaattctgctatcctgcgctatcagccggctcaggctcgtccttccagcactgcgggtgcgcgaaggcctcactaactgctgggcattagtataaaaaaaacgctgggcattgtggtattgtgataatcatcaagcagggcttttggcagcgagctagatattacttgattcttttggctggtgtctgggaactatgatgatctggagttgatgtagggagaggctaatgaatagtgagtgctgcctgtgtttgggaactacgatgatctggagttaatgtagggggagatgctagtgaatagtgagtggtgacagtactctgctgacctgccgcacttgtcatagttgtttgcactttgtagcagtttgtagttggctgcgtagcttaggtgctttaaatagcattatggtgttaagcattggaactagtacctggttatctaccgcgctagctgactagctctcgcatgtgtaaatctgatcatgcttgccttacaaaattataccaagacagcggtgtagttttcatat

SEQ ID NO: 25328 - DNA, 1958 bp, Panicum virgatum
  misc_feature: Ceres CLONE 1863076
  misc_feature: Encodes the peptide sequence at SEQ ID NO. 25329
tctccaaaccctagctccctcaatcccccaccggcccaccccgaccgagatccgatctcgcttgccgccgccgccgccaccatggcctccggcggcaaccccaactcgagcggcgccccgcctcagccccgcccgccgcatccccagcagcagcagccgccgggtggctccccggcgacgcccatgacccacctccgcccaccctccctcgccggctccccgttccagggcgtcttccacacgccgccccacaaccctgccttccagatccacatgggcgcctcctcgccccagactccgctcatggcggccgccgctgccgtcgcggcgcaatcggccaagcgtcccccgcagaagcccctcgtgcggcccccggctcccgggtctacctcggccgccgcggcggcttcggcagctgccgcgtacaaggctgcggcggcggcggcggccgtggcgaactccggaggcgtcgaccttacccctgccgcgcgacgaaataagaaacgcaagctcccggagaagcagctcccagaccgcgtcgccgcgctgttcccggagtccgcgctctacacgcagctgctcgagttcgaggctcgcgtggacgctgcgctggcgcggaagaaggtggacatccaggaggcgctcaagacgccgccctcgctccagcgtacgctccgcatctacgtcttcaacaccttcgccaaccagggcccacgcaccatcccgccgccaaagaacgccgatccgcccacctggtcgctcaagatcattggccgcgtgcttgaggatggcgccgagctggaccctgccagcgtggtgcccaagcacaacccggtgtacccgaagttctcccagttcttcaagagggtgaccattgcgctggacccacagctgtaccctgaaaatccattgatcatttgggaaaatgctcgttctgccgcccatcaggaagggttcgaggtgaagaggaaaggggataaggagttcgttgcgaacatccgcctggagatgaactacaaccctgagaagtttaagctgtcacagccgctgatggaggtgcttggggttgaggtggacactcgcgcgcgggtgattgctgccctgtggcagtacatcaaggcgaagaagcttcagaatccaaacgacccttccttcttcatgtgcgaccctcaattgaagaaggtgtttggggaggataagcttaagtttgcaatgctgtcgcagaagatatcgcagcatctgactgctccaccgcccatcaacttggagcacaagattaagctatcaggcaatggagcttctggaagtgcttgctatgatgtgctggtggatgtgcccttcccactacagaaggagatgatggcattcctcgccaacactgagaagcacaaggacattgaggcctgtgatgatgtgatatctgcctcgatcaagaagatccatgagcatcgcaggaggagggctttcttcctgggtttcagtcagtctccggtggagttcattaacgccctgatagcttctcagagcaaagatttgaagctggttgccggcgaagcgaataggaacattgataaggaaagacgtgcagacttctacaaccaaccatgggttgaggatgccgttataagatacctgaaccgcaagccagctaatgagggcccaggcggtggtgctggtggttcttgaggataggatttcctctagtgcccttttggtgtagaaacaaattatctttcttgtattagtagtaaaatccagcggtgttagcgaggagattcgttcagtgttgtgaaaggatgtttggggtagtcactgtatgttgtgttctatattgccaactattgtggaagtataaagccaagcgaacaactggagccgatgatgttgtgaggacccatgttgccaattctttttgtcttggtcgtgatcttatctggagaattaagatgttgaattgg

SEQ ID NO: 25329 - protein, 534 aa, Panicum virgatum
  misc_feature: Ceres CLONE 1863076
  misc_feature (313)..(388): Pfam Name: SWIB Pfam Description: SWIB/MDM2 domain
MASGGNPNSSGAPPQPRPPHPQQQQPPGGSPATPMTHLRPPSLAGSPFQGVFHTPPHNPAFQIHMGASSPQTPLMAAAAAVAAQSAKRPPQKPLVRPPAPGSTSAAAAASAAAAYKAAAAAAAVANSGGVDLTPAARRNKKRKLPEKQLPDRVAALFPESALYTQLLEFEARVDAALARKKVDIQEALKTPPSLQRTLRIYVFNTFANQGPRTIPPPKNADPPTWSLKIIGRVLEDGAELDPASVVPKHNPVYPKFSQFFKRVTIALDPQLYPENPLIIWENARSAAHQEGFEVKRKGDKEFVANIRLEMNYNPEKFKLSQPLMEVLGVEVDTRARVIAALWQYIKAKKLQNPNDPSFFMCDPQLKKVFGEDKLKFAMLSQKISQHLTAPPPINLEHKIKLSGNGASGSACYDVLVDVPFPLQKEMMAFLANTEKHKDIEACDDVISASIKKIHEHRRRRAFFLGFSQSPVEFINALIASQSKDLKLVAGEANRNIDKERRADFYNQPWVEDAVIRYLNRKPANEGPGGGAGGS

SEQ ID NO: 25330 - DNA, 567 bp, Panicum virgatum
  misc_feature: Ceres CLONE 1863114
  misc_feature: Encodes the peptide sequence at SEQ ID NO. 25331
accgagcccggggagtgacgggagcgcgagcgagcgatagccgataggaggcgggccatggcgggtgcgggcagaagtcgccgccgtcgtcgcgagtccccgccggcgacggtgaggctggcgctgctggtggcggtggccaccatggccggcgtcgcggcggagggcaaggcggtgcgcgtgggggagccgcaccggcggagcatgctggccaacggcctcggctccgcccctcccatggggtggaacagctggaacctcttccagtgcggcggcaacggcgaggtggtcatcagggagaccgctgacgcgctcgtgtccaccgggctcgctgctctcggctacaaatacgtcaacttcaatgactgctgggcggagcctaaacgtgatgcaacgggcaatctggtggccaacaccaagacgttcccgcacgggatcaaggcgctggcggactacgtccacagcaaggcgctcaagctcgggatctactccgatgccgggttccagacctgcgccaaggcccattctgggctccctcgttcactaggagcaggacgccataccctt

SEQ ID NO: 25331 - protein, 169 aa, Panicum virgatum
  misc_feature: Ceres CLONE 1863114
  misc_feature: SWISSPROT Homolog: EC 3.2.1.22 Alpha-galactosidase
MAGAGRSRRRRRESPPATVRLALLVAVATMAGVAAEGKAVRVGEPHRRSMLANGLGSAPPMGWNSWNLFQCGGNGEVVIRETADALVSTGLAALGYKYVNFNDCWAEPKRDATGNLVANTKTFPHGIKALADYVHSKALKLGIYSDAGFQTCAKAHSGLPRSLGAGRHT

SEQ ID NO: 25332 - DNA, 2510 bp, Panicum virgatum
  misc_feature: Ceres CLONE 1863129
  misc_feature: Encodes the peptide sequence at SEQ ID NO. 25333
ctctttttctctccctctcccacctcgcagccccacccttcccctctctccccgcacaccatggcgatctccgagctcgggtgagctgacgagaatgcggccgatttgaggaggcggcgggagggtgatgggggttccgggcggattcgccagggtgtagagtaggtttcggttccggtggacgtgggaggatgagctcgtcgtcggcggccagcatcggccagacgccgccgccgccgccgccggacgaagagaagaagtgcctcaactcggagctgtggcacgcgtgcgccggcccgctcgtctgcctccccaccgtcggcacgcgcgtcgtctacttcccgcagggccacagcgagcaggtggcagcgtcgacgaacaaggaggtggacgggcacatccccaactaccccaacctgccgccgcagctcatctgccagctccatgatgtcacaatgcatgccgatgcggagactgatgaagtgtacgctcagatgacgctgcagccgctgaacccacaagagcagaacgatgcatacctgccggccgagatggggatcatgagcaaacagcctacgaattacttctgcaagacgctgacggccagcgacaccagcacgcatggcgggttctctgtgccccgtcgtgcagcggagcgcgtcttcccccctctggatttcacacagcagcctccagcacaggagcttattgcacgggatattcatgatgtggagtggaagttcaggcatatcttccgaggccaacccaagagacacctgctgactactggctggagtgtgtttgtcagtgctaagagactcgttgctggagattctgtgctattcatatggaatgagaagaaccaacttttgcttggaatcagacatgccagccggccacagactgtaatgccctcttctgttctttctagtgacagtatgcatataggcctccttgcagcagcagctcatgctgctgcaacaaacagccgcttcacaattttctataatcccagggcaagtccatcagaatttgttatacccctttcaaaatacatcaaggctgttttccacactcggatatcggttgggatgcgattcaggatgttgtttgagactgaggaatctagtgtccgcaggtacatggggacgataacagaagtaagtgatgcggacccagtgcgctggcctagttcctattggagatcggtaaaggttggttgggatgaatcaacagcaggagaaaggccccctagagtttctctgtgggaaattgaaccattgacaacctttccaatgtatccatccctgttcccactgcgagttaagcatccttggtattctggagtcgctgctcttcatgatgacagcaatgctttgatgtggctgagaggagttgctggtgaaggaggctttcagtctttgaacttccagtcacctggtataggttcctggggacaacagcgactccatccatccttacttagcaacgaccatgatcagtatcaagcagtggttgctgctgcagctgcctcccagtctggtggttatctgaagcagcaattcctacaccttcaacaacctatgcagtcccctcaggaacagtgcaacctcaatccgctgttgcagcaacaaattatgcagcaagcgagccaacagcaactagttagtcctgattctcaaaacattcagtctgtgctcagcccaagttctatccagcagcagctccaccaactccagcaaatgcagcatgctcataatgatcagaagcagaagattcaaccggatcaaccttatcaagttcctagcagtgcagttctccctagcccaacgtcactaccaagccatttacgtgaaaaatttggattctctgatcctaatgtgaactcttccagctacatcagctctagcagcaacgaaaacatgttggaatcgaacttccttcagggaagctcgaaatgcgtggacttgtctagattcagccaaccagtagttagcgagcggcagcagcagcagcagcaacaggcgtggaagcaaaagtttatgggctcacaatcaatgtcttttgggggctcgggttcgcttaactcacccactagcaaagatggttctgttgacaacaaagttggccgagatgggcagaaccagtccctttttagtccacaagttgacaattcttccctattgtacaatatggtacctaatctgacttcaaatgttgcggataacaatatatcagcgattccctctggatcaacatatctgcaaaatccgatgtacggttgtctggaggactcttctggtttattgcaaaatacaggggagaatgatccaacaactagaaccttcgttaaggtttacaagtcaggatcagtggggaggtcattggacatcacccggttctctaactatgctgaacttcgagaggaactgggtcagatgttcggcattaagggtcagttggacgaccctgatagatcaggctggcagcttgtatttgtcgacagggag

SEQ ID NO: 25333 - protein, 772 aa, Panicum virgatum
  misc_feature: Ceres CLONE 1863129
  misc_feature (258)..(341): Pfam Name: Auxin_resp Pfam Description: Auxin response factor
  misc_feature (131)..(236): Pfam Name: B3 Pfam Description: B3 DNA binding domain
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
MSSSSAASIGQTPPPPPPDEEKKCLNSELWHACAGPLVCLPTVGTRVVYFPQGHSEQVAASTNKEVDGHIPNYPNLPPQLICQLHDVTMHADAETDEVYAQMTLQPLNPQEQNDAYLPAEMGIMSKQPTNYFCKTLTASDTSTHGGFSVPRRAAERVFPPLDFTQQPPAQELIARDIHDVEWKFRHIFRGQPKRHLLTTGWSVFVSAKRLVAGDSVLFIWNEKNQLLLGIRHASRPQTVMPSSVLSSDSMHIGLLAAAAHAAATNSRFTIFYNPRASPSEFVIPLSKYIKAVFHTRISVGMRFRMLFETEESSVRRYMGTITEVSDADPVRWPSSYWRSVKVGWDESTAGERPPRVSLWEIEPLTTFPMYPSLFPLRVKHPWYSGVAALHDDSNALMWLRGVAGEGGFQSLNFQSPGIGSWGQQRLHPSLLSNDHDQYQAVVAAAAASQSGGYLKQQFLHLQQPMQSPQEQCNLNPLLQQQIMQQASQQQLVSPDSQNIQSVLSPSSIQQQLHQLQQMQHAHNDQKQKIQPDQPYQVPSSAVLPSPTSLPSHLREKFGFSDPNVNSSSYISSSSNENMLESNFLQGSSKCVDLSRFSQPVVSERQQQQQQQAWKQKFMGSQSMSFGGSGSLNSPTSKDGSVDNKVGRDGQNQSLFSPQVDNSSLLYNMVPNLTSNVADNNISAIPSGSTYLQNPMYGCLEDSSGLLQNTGENDPTTRTFVKVYKSGSVGRSLDITRFSNYAELREELGQMFGIKGQLDDPDRSGWQLVFVDR

SEQ ID NO: 25334 - DNA, 430 bp, Panicum virgatum
  misc_feature: Ceres CLONE 1863129-R
agaaacgatccacgctacctatcttaaatggatacatgtagccttttctggctaccatgacgattctgcggcacaaggtagcactcctgctcgtgacagtctgctccgccgtgctcgcttgttcgcccgtgtcatctcttgcatgttcaccatgcacgtcctcagaactccccgtttatctgtatcaggtgcaggccaccgatactctggactgatatcgtgtaagtcccacttaggaatcagtatcagtattcagtaactctatcctagttggtttgtagcttgcacggccctttgtgtcgcgtcaaatcttcggactaaatccttagttgaaactgaattgtgattcgtaagttatgtatttgaggattcctcagcatggttcaacgatgaactgcaataatttgaatgcacgaggattgtttaaatc

SEQ ID NO: 25335 - DNA, 443 bp, Panicum virgatum
  misc_feature: Ceres CLONE 1863133
  misc_feature: Encodes the peptide sequence at SEQ ID NO. 25336
acacattcacaccccaaagcagcgcagccgcctcattcctcctctccatcctcctctctctctctcgcgcgcgccgctcttcccgttccgttccaggagagcagtgaggcgggtagtagtggtcggggaggggaggcaagatgttcatcgagagcttccgcgtggagagcccgaacgtgcggtacggcccgtcggagatcgagtcggagtaccggtacaacacgacggagctggtgcacgagggcaaggacggcgcctcccgctgggtcgtccgccccaagtccgtcaagtacaacttccggaccagcccccccgtccccaagctcggggtgatgctcgtggggggggggggcaacaacgggtccaccctgacgggtggggtcctcgcccacggggaggggattctctgggccaacaaagaccagggggaacaaggcaattta

SEQ ID NO: 25336 - protein, 100 aa, Panicum virgatum
  misc_feature: Ceres CLONE 1863133
  misc_feature: SWISSPROT Homolog: EC 5.5.1.4 Inositol-3-phosphate synthase
MFIESFRVESPNVRYGPSEIESEYRYNTTELVHEGKDGASRWVVRPKSVKYNFRTSPPVPKLGVMLVGGGGNNGSTLTGGVLAHGEGILWANKDQGEQGN

SEQ ID NO: 25337 - DNA, 2060 bp, Panicum virgatum
  misc_feature: Ceres CLONE 1863140
  misc_feature: Encodes the peptide sequence at SEQ ID NO. 25338
aaacaaaccccaccccacccgccccggccgcggccgcggccactccacacaacgcaggacgcacgggcacggcacgctgttgcagcccaaggacgacgctgccctccggagagcagagcggggagccgacatgccggcggcctccacacaacgcaggacgcacgggcacggcacgctgttgcagcccaaggacgacgctgccctccggagagcagagcggggagccgacatgccggcggcgggcggcgtgttctccgggtcggtgaacctcaagtacgtgaagctggggtaccagtacctggtgaaccacttcctgacgctgctgctggtgccggtgatggcggccacagcgctggagctggcgcgcctcggccccggcgagctgctctcgctcaggcgctcgctggagctcgacctcgtccacatcctctgctccgccttcctcgtcgtcttcgtcggcaccatctacgtcatgtcgcggcccaggcccgtgtacctggtggactacgcctgctaccagccccccgccagctgccgggtgcccttcgccaccttcatggagcacacgcgcctcatcagcgacgacgacaagagcgtgcgcttccagaccaggatcctcgagcgctcggggctcggcgaggacacgtgcctcccgcccgccaaccactacatcccgcccaaccccagcatggaggcctcgcgcgccgaggcgcagctcgtcatcttctccgccatcgacgacctcgtccgccgcaccggcctcaagcccaaggacatcgacatcctcgtcgtcaactgcagcctcttctccccgacgccgtcgctctccgccatgatcatcaacaagtacaagctccgaagcaacatccgcagcttcaacctctcgggcatgggatgcagcgccggcctcatctccatcgatctcgcccgggacatgctgcaggtgcaccccaactcgaacgcgctggtggtgtccacggagatcatcacgcccaacttctaccagggctcccggcgcgacatgctgctgcccaactgcctcttccggatgggcgcggcggcgatcctgctctccaaccggcggcgcgaggcccaccgcgccaagtaccggctggtgcacgtggtgcggacgcacaagggcgccgacgaccgcgcctaccggtgcgtgtaccaggaggaggacgagcaggggttctcgggcatctcgctctccaaggagctcatggccatcgccggcgacgcgctcaagtccaacatcacgacgatcggcccgctggtgctgcccatgtcggagcagctgctcttcttcttccggctggtggggcgcaagctcgtcaacaagagctggcggccctacatcccggacttcaagctggcgttcgagcacttctgcatccacgccggcggccgcgcggtgatcgacgagctgcagaagaacctgcagctgtcggcgcggcacgtggaggcgtcccgcatgacgctgcaccgcttcggcaacacgtccagcagctcgctctggtacgagctcgcctacatcgaggccaagggccgcatgcgccgcggcgaccgcgtctggcagatcggcttcggcagcggcttcaagtgcaacagcgccgtctggaagtgcctccgcaccatcaagacgcccaccaacgggccctgggacgactgcatccaccgctaccccgtcgacattccggaggtcgtcaagctgtaactgtacgtcccgcgaagcatcggagctttgagctcttttttcttctttcttctttcttctcctcttcctttttcttttccgggtctattaaaagggggtaaaaatccatactttggtcgctggacgtgtcacaccatacgtacaaggaatgacgatcatcacaggagattaattaaaactagttgttgttggaaaaattggatgttatcgtgggcgtgctgtcgaaactggcctatgccagggattgggtggtgttttggaacttggatgggaaggaaagggagcacttgtaaattgtaatccatgttgtaactggtgaaagggatacctgcattctcctgat

SEQ ID NO: 25338 - protein, 495 aa, Panicum virgatum
  misc_feature: Ceres CLONE 1863140
  misc_feature (80)..(368): Pfam Name: FAE1_CUT1_RppA Pfam Description: FAE1/Type III polyketide synthase-like protein
  misc_feature (382)..(466): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MPAAGGVFSGSVNLKYVKLGYQYLVNHFLTLLLVPVMAATALELARLGPGELLSLRRSLELDLVHILCSAFLVVFVGTIYVMSRPRPVYLVDYACYQPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREAHRAKYRLVHVVRTHKGADDRAYRCVYQEEDEQGFSGISLSKELMAIAGDALKSNITTIGPLVLPMSEQLLFFFRLVGRKLVNKSWRPYIPDFKLAFEHFCIHAGGRAVIDELQKNLQLSARHVEASRMTLHRFGNTSSSSLWYELAYIEAKGRMRRGDRVWQIGFGSGFKCNSAVWKCLRTIKTPTNGPWDDCIHRYPVDIPEVVKL

SEQ ID NO: 25339 - DNA, 719 bp, Panicum virgatum
  misc_feature: Ceres CLONE 1863167
  misc_feature: Encodes the peptide sequence at SEQ ID NO. 25340
acccagagctctgtagaagaagcggcgagggggcgaaccggagccactcagccgccaccgactgcgtgaatcccctccccacgccgctcctgctcgccgccgcccgctgctctcgccatttcagctgcagcgctcgccgccgccgcagggccgcagcgcctctcctcctccgcccgcctgccggctgccttccggatgagaagcggcgcaaccggggcggcggaagcgtggtcggcgtgaggcttcgtcggagtccgtgaacgcgccgacaaggatcctggagatcaagcgcatgggttccttggaggcccggtaccggccggccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtctctactgccaacattcaatgggaagatgtatataaaagtattcaaaatctgaatggtggtgaacaaaagctcaaagttgcactcctgaatttttacagaactgagtttggcacttggacagatatgctctcag

SEQ ID NO: 25340 - protein, 142 aa, Panicum virgatum
  misc_feature: Ceres CLONE 1863167
  misc_feature: Useful for making plants with altered carbohydrate content
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLNGGEQKLKVALLNFYRTEFGTWTDMLS

SEQ ID NO: 25341 - DNA, 634 bp, Panicum virgatum
  misc_feature: Ceres CLONE 1863186
  misc_feature: Encodes the peptide sequence at SEQ ID NO. 25342
acccaccactccactctatccgcgccgcacgcagttgcgtttcactacagcctggtggtacgtacagtggtgacaagatgaaattgtcgccgttcctcgtgctgctcgtcacgctgctatctgcaaccgccactcttccgtcagaggcgctcaacgtgagaggccacctgctcaagtccaagaccttcctgtccccgccgatcttcctgcgcccgggctccgtctccaacaagtggtacttcgacatcgccttccccagaggccacctcgcgctcaagagcttcaacgccgaggtcgtcgacgagcgcggcgtccctgtcccgctccacgagacctacctccaccactgggtcgtggagccctacttcgccgtgaaggaagccgccgccgccgccgccgccgccggcgaggcccagaagcgctccaagggaatcctgaacaggaactccggcgtgtgcaagaacacactgggacagtactacggccttggctccgagacccggcacacggcgacgtgggtgcccgatccctacggcatcgaggtcggcgacccggaggcgccgccggaggggtacgaggagaagtggctgctcaacgtgcacgccatcgaacaccaggggcgccgccgacaagc

SEQ ID NO: 25342 - protein, 185 aa, Panicum virgatum
  misc_feature: Ceres CLONE 1863186
  misc_feature (27)..(185): Pfam Name: SURNod19 Pfam Description: Stress up-regulated Nod 19
MKLSPFLVLLVTLLSATATLPSEALNVRGHLLKSKTFLSPPIFLRPGSVSNKWYFDIAFPRGHLALKSFNAEVVDERGVPVPLHETYLHHWVVEPYFAVKEAAAAAAAAGEAQKRSKGILNRNSGVCKNTLGQYYGLGSETRHTATWVPDPYGIEVGDPEAPPEGYEEKWLLNVHAIEHQGRRRQ

SEQ ID NO: 25343 - DNA, 1242 bp, Panicum virgatum
  misc_feature: Ceres CLONE 1863196
  misc_feature: Encodes the peptide sequence at SEQ ID NO. 25344
atctgtgctgtgcactgcggcgactccccagcaccccacaccgcgtcttggcttcccgtgacgtccgcggcgacgcgcccgcgcttgcggtccggacacgggggcacccatggcggcgcgggggaagaagctcatcaacgatcccaacgatgtggtgacgcagttcattgagggcttagccgagacgtaccccgggctgcagtacctggacgggttccccgagatcaaggtggttctccgctccgatgtcgcggtcgggacgtacgataaggttgctgttatttgcggaggtggaagtggtcatgaaccagcccatggtggatttgttggtcaaggaatgctgactgctgctgtttctggagatgttttcacttctccacctgtcaactctattttggctgctatccgagctgtaacaggtcctaagggctgtcttttagtagtaacgaattacacgggcgaccggcttaattttggcctagcagctgaggaagcaaaatctgaaggctacaaagtggagatggttatcgttggagatgattgtgctctcccaccgactcgaggcatagctggcaggagaggccttgcagggacaattctcgtgaataaggtagctggagcagctgccgatgctggattgccccttgaggaggtagctgagcaagcaaggcatgcatccaagtttgttggtacagtgggagttgctctgtcagtgtgcacactgcctggtcaggagacctctgatcgtttaggtctagaacaaatagagctcggtcttggaattcatggagagcctggcgctgctgtcactgaacttcagcctgttgatgtagtggtgtctcgtgttcttaagcagatcttgtcatcggaaactcgatatgttcctattacaagcggcgacagggttattctcctgactaatggattaggtgctactcctaccatggagttgatgattgccactagaaaggctgtgcgtgagttgcaactggaatatggaattgctactgacagagtctacacaggatcttttatgacttcacttgacatgcaaggagatcggcaaaaacctgcaaaaatttctgttccagcaccaccatcatgtgcgatgaagagtgataagatgcttcaacaaagtcgagagctaaccaaggagggctgcattttagaggcttgtattgaagcaggtgctaaagaaataatcaggaataaggatagtttgaatgaatgggacagtaaagt

SEQ ID NO: 25344 - protein, 377 aa, Panicum virgatum
  misc_feature: Ceres CLONE 1863196
  misc_feature (22)..(337): Pfam Name: Dak1 Pfam Description: Dak1 domain
  misc_feature: SWISSPROT Homolog: EC 2.7.1.29 Glycerone kinase
MAARGKKLINDPNDVVTQFIEGLAETYPGLQYLDGFPEIKVVLRSDVAVGTYDKVAVICGGGSGHEPAHGGFVGQGMLTAAVSGDVFTSPPVNSILAAIRAVTGPKGCLLVVTNYTGDRLNFGLAAEEAKSEGYKVEMVIVGDDCALPPTRGIAGRRGLAGTILVNKVAGAAADAGLPLEEVAEQARHASKFVGTVGVALSVCTLPGQETSDRLGLEQIELGLGIHGEPGAAVTELQPVDVVVSRVLKQILSSETRYVPITSGDRVILLTNGLGATPTMELMIATRKAVRELQLEYGIATDRVYTGSFMTSLDMQGDRQKPAKISVPAPPSCAMKSDKMLQQSRELTKEGCILEACIEAGAKEIIRNKDSLNEWDSK

SEQ ID NO: 25345 - DNA, 716 bp, Panicum virgatum
  misc_feature: Ceres CLONE 1863196-R
  misc_feature: Encodes the peptide sequence at SEQ ID NO. 25346
ctctcctgctggaattgcttccttttacaaattagaaaaattctagcataactaatccatgttctatataggtatgacatactctgtaaggctgcctatgcaagtttaaagggcattaaaacagtagaagcaaagcattgggctaatgctttacaagcatccatcgttgccatcagcaaatatggtggtgctcgtgaaggctatcgtaccatgcttgatgctctgattcctgcttcagaaattcttagagagagacttgaagctggggatgaccctcttgatgcattcattgtatcatctgaagctgccatgactggtgctgaatccacaagacacatgcaggcccaggctggtagatcatcctatattgctgctgacaagttggcatcagctcctgatcctggagccatggctgttgctgcttggtatagagctgtagccctttcattgaagagcatgtcgtgccattcaaaatcatagctctgtttcagctccacttgcctaccaaagtttcgcacatatacaggccagtccttgtgatctctgtctagtatttcattggctccaattttcagtggtgtgtatattctgcttggccttggcatcaaaactttcacggtagcattgtgcatgataatgatgctgtaactacaagacgctcatctgctcacttctataaatatttgaacgaaaagatgtagaatgtgaattttgtc

SEQ ID NO: 25346 - protein, 89 aa, Panicum virgatum
  misc_feature: Ceres CLONE 1863196-R
  misc_feature: SWISSPROT Homolog: EC 2.7.1.29 Glycerone kinase
MLDALIPASEILRERLEAGDDPLDAFIVSSEAAMTGAESTRHMQAQAGRSSYIAADKLASAPDPGAMAVAAWYRAVALSLKSMSCHSKS

SEQ ID NO: 25347 - DNA, 2344 bp, Panicum virgatum
  misc_feature: Ceres CLONE 1863201
  misc_feature: Encodes the peptide sequence at SEQ ID NO. 25348
gagtccaaaaccccacttcctcgcatccgctccatccccaatccccatctccccgttgccaatggcggcctccctgctccgcgcctcgcccctctccctcctctcgcgcctaaagcccaggccgtccgccttgcacctccgccgcatcctcccgctctccaccacctcggcctcggcctcgcccgcgccctcgtcctccggccccgcgccccagctccgaaccctagcggccgcggcggcgaccgacgcggcagcgaacccggcggaggagacggcggccgcggcgcccgccgcggcgggtgagaaggtcgagaggctgcagccgctgcagtggccgccgagggacgcgctgtgcggcgagctcggcgccggggacgccgggcgcagggtgcggctctgcggatgggtcgcgctgcgccgcgcgcacgccgggctcaccttcctcaccctgcgcgaccgctccggcatggtgcaggtgacaacattgccagagtatccagaagtttacaacatagtaaacaagttgagagttgagtcagtggttgctgttgagggggtggtccggccgcgcccagcagatgccatcaatgcagatatgaagactggggctatagaggttgctgcagatcgtgttttagtactgaactcagtaactcgttcactgccgtttccagttacaactgctgactctgtaaaagagaagtttccagaagaaattagactgaggtttagagtgctggacttgcgtcgtcctcaaatgcagtcaaacttgcggttgcggcataatgttgttaaatccgtccggcgttacttggaagatgaacatgaatttgttgaaattgagactccagttttatccaagtctacaccagaaggtgctcgggactatcttgtaccatcaagagttcagccaggaacattctatgctctccctcaaagtcctcagttgttcaagcaaatgttgatggtttctggctttgaaaaatattaccagattgcaaggtgcttccgtgatgaagatttgcgtgcggacaggcaaccagagttcacacaacttgatatggagattgcctttatatcaatggaggatatgttgaagttaaatgaagatttgatgagacatgtttttcaagcggtaggaggtatcaagctgccaaatccatttccaaggttaacatatgcagaggcaatgagtcgctatgggacagataggcctgaccttcggtttgattgggagctgaaagatgttagtgatgtatttttgggaagtggcttcaaggtttttgctgataccatggaaaatggaggtgtaataaaggcactgtgtgttcctggtggtgccacggtgttttcaaacactgacctaaagaaaggaacggtttacactgaagcttccaaagctggagccaagggcctgcctttcctcaaagttatggagaatggggatcttgaaggaattggtccactggtatcaagtctgaaacctgaaaagaaagagcagctcgtgaaacttctggatgcaaaggccggcgaccttatcctgtttgcactaggtgaacaatcatcagctaaccgggttcttggccggttaagattatttattgctcataagctggaagtgatagacacgtcagcacattcagttctttgggtgacagattttccaatgttcgaatggaacagtgatgagcagagatacgaggccctacaccatcctttcactgcgccaaatcctgaagatatgaatgatctaccatcagctcgtgccctggcttatgacatgatttacaatggtgtggagattggagggggcagtttgagaatctacaaaagtgatgtacaacaaagaatttttgagatcattggtatctcacctgaacaggcggaggagaaatttggctaccttttagaatctttcgacatgggtgctcctccacatggaggcattgcctatggattggatcggttggtgatgctcttggctggtgagagctcaatacgggatgtgatagcattccccaagaccacgacagctcagtgtgcactcaccaaagcaccatctgctgtagatcctcagcaactgaaggatcttgcgttcccaaagtctactttgtaatactgttcagaattttgggttggttgcttctctatattttgaggcacattctagttttgcatggtagggaatgcgctttgttcatgagaattttccaacactggaaaatctatagaagatggttaacacaaagatctggaaatctggattcacaagagtttcaacagcgatactatgcatttgtatacatgtcttgtaaatcattcaacatagtacgaattattgtgc

SEQ ID NO: 25348 - protein, 684 aa, Panicum virgatum
  misc_feature: Ceres CLONE 1863201
  misc_feature (216)..(657): Pfam Name: tRNA-synt_2 Pfam Description: tRNA synthetases class II (D, K and N)
  misc_feature (110)..(194): Pfam Name: tRNA_anti Pfam Description: OB-fold nucleic acid binding domain
  misc_feature (408)..(507): Pfam Name: GAD Pfam Description: GAD domain
  misc_feature: SWISSPROT Homolog: EC 6.1.1.12 Aspartate--tRNA ligase
MAASLLRASPLSLLSRLKPRPSALHLRRILPLSTTSASASPAPSSSGPAPQLRTLAAAAATDAAANPAEETAAAAPAAAGEKVERLQPLQWPPRDALCGELGAGDAGRRVRLCGWVALRRAHAGLTFLTLRDRSGMVQVTTLPEYPEVYNIVNKLRVESVVAVEGVVRPRPADAINADMKTGAIEVAADRVLVLNSVTRSLPFPVTTADSVKEKFPEEIRLRFRVLDLRRPQMQSNLRLRHNVVKSVRRYLEDEHEFVEIETPVLSKSTPEGARDYLVPSRVQPGTFYALPQSPQLFKQMLMVSGFEKYYQIARCFRDEDLRADRQPEFTQLDMEIAFISMEDMLKLNEDLMRHVFQAVGGIKLPNPFPRLTYAEAMSRYGTDRPDLRFDWELKDVSDVFLGSGFKVFADTMENGGVIKALCVPGGATVFSNTDLKKGTVYTEASKAGAKGLPFLKVMENGDLEGIGPLVSSLKPEKKEQLVKLLDAKAGDLILFALGEQSSANRVLGRLRLFIAHKLEVIDTSAHSVLWVTDFPMFEWNSDEQRYEALHHPFTAPNPEDMNDLPSARALAYDMIYNGVEIGGGSLRIYKSDVQQRIFEIIGISPEQAEEKFGYLLESFDMGAPPHGGIAYGLDRLVMLLAGESSIRDVIAFPKTTTAQCALTKAPSAVDPQQLKDLAFPKSTL

SEQ ID NO: 25349 - DNA, 715 bp, Panicum virgatum
  misc_feature: Ceres CLONE 1863224
  misc_feature: Encodes the peptide sequence at SEQ ID NO. 25350
ctctcgccccacaccgcacacgcacgcacgcttcgctcccaccccccatcgccgccgccgccgccgccgccgccaaaaccccaacccttgccgagcccgtctcggccaccatctcctccccatcctcctcctcctcggcggcgcggcgagccgcgggcgatccggtcggtgaggggggcgcgcgcggggcgggggcggagatggcatcggaggacgtggtggggaagagcaggggcgacacggccgtcaccaccatcgtcaacctggcggaggaggccaagctcgcgcgcgagggggtcaaggggccggggcaccaggtcctcaccatctgcaagtcgctcgtcgccggcggcgtcgctgggggagtgtcacgcactgctgttgctccgcttgaacgattgaaaatcttgctccaggttcaaaatccacacagtatcaagtacaatggtacaattcaaggtctcaagtatatatggagaaccgagggcctccgtggccttttcaagggcaatggtaccaattgtgcaaggattgttccaaattctgctgtgaagttttttagctacgagcaggcatcaaagggaattttgtgggcgtaccgtcaacagactggggacgaggatgctcagcttagtccactcttacgccttggagctggagcttgtgctggtatcatagccatgtctgctacttacccgatggatatggttagggg

SEQ ID NO: 25350 - protein, 171 aa, Panicum virgatum
  misc_feature: Ceres CLONE 1863224
  misc_feature (42)..(133): Pfam Name: Mito_carr Pfam Description: Mitochondrial carrier protein
MASEDVVGKSRGDTAVTTIVNLAEEAKLAREGVKGPGHQVLTICKSLVAGGVAGGVSRTAVAPLERLKILLQVQNPHSIKYNGTIQGLKYIWRTEGLRGLFKGNGTNCARIVPNSAVKFFSYEQASKGILWAYRQQTGDEDAQLSPLLRLGAGACAGIIAMSATYPMDMVR

SEQ ID NO: 25351 - DNA, 479 bp, Panicum virgatum
  misc_feature: Ceres CLONE 1863229
  misc_feature: Encodes the peptide sequence at SEQ ID NO. 25352
accacagatatccaccaagacatctgcattagtgagccatggcttctcctgtcaagagcaggaagctgcgcatcctcctcatgcccttcctcgccactagccacatcggccccttcaccaacttcgccgcccacctcacggctgcgcggccggacatcgtcgaggccaccatcgccgtcaccaccggaacggcgaacgccgcggtcgtacagtcagctcttgcacggcaccagagccccggcagcgtgacagcggtgagggtggcgacctacccgttcccggtggtggatggcctcccaccgggggtggagaacctctcgaccgtcaaggccgcggatgggtggcggatcgccgtcgccgctttcgacgagaccctgatgaggcccggacaggaaggcctcatcagggagcactcgccggacgtcatcatcaccgacgcgcacttcttctggaacaccgacctcgccgccgatctcggc

SEQ ID NO: 25352 - protein, 146 aa, Panicum virgatum
  misc_feature: Ceres CLONE 1863229
  misc_feature: SWISSPROT Homolog: EC 2.4.1.238 Anthocyanin 3'-O-beta-glucosyltransferase
MASPVKSRKLRILLMPFLATSHIGPFTNFAAHLTAARPDIVEATIAVTTGTANAAVVQSALARHQSPGSVTAVRVATYPFPVVDGLPPGVENLSTVKAADGWRIAVAAFDETLMRPGQEGLIREHSPDVIITDAHFFWNTDLAADL

SEQ ID NO: 25353 - DNA, 2553 bp, Panicum virgatum
  misc_feature: Ceres CLONE 1863249
  misc_feature: Encodes the peptide sequence at SEQ ID NO. 25354
aggcgaatgaatcccagccacacgcgcccggccatggccttccccaccccaccccaccccacctccgtggtcacccacacggtcacactcgccgccctgaccctcccctcacctctccgccggccgcagcgcaccgctactataggagcctcccatcccagcgctgtttcctcactcgcccccctccggccactccttgaccgaatccccccgccgacgtttcgctagctactccgcacactgccgccgccactgttagcttgcagctcaagctcggccacgctgcgtttgggccggttcttgagggaggaaatcgagcacttggtggtccgacgccattgggagaagctgctgctgctgcggtcttgagcagcaggaggagagggagcaatggcgctgtcgacgttctctgttccgcggggattcctcggcgtgccggctcaggactcccatttcgctccggcgggcgagctccatgcccacaagcagcttcaggccaggcctcccactgtcaagggccacgctcggcgtaggtcgacgacttgcgtgtcggcgtcgctgtcggagcgggagcgcgaggcggagtactactcgcagcggccgccgacgccgctgctggacaccatcaactacccggtccacatgaagaacctgtcggccaaggagctgcggcagctcgccgacgagctccgctccgacgtcatcttccacgtctccaagaccggcggccacctcgggtccagcctcggcgtcgtggagctcaccgtcgcgctgcactacgtcttcaacgcgccgcaggaccgcatcctctgggacgtcggccaccagtcgtacccgcacaagatcctgacggggcggcgcgacaggatgccgacgatgcggcagaccaacgggctggcggggttcacgaagcgcgccgagagcgagtacgactgcttcggcacggggcacagctccaccaccatctcggcggcgctgggcatggcggtggggcgggacctcaggggcggcaagaacagcgtggtggcggtgatcggcgacggcgccatgacggcggggcaggcgtacgaggccatgaacaacgccggctacctcgactcggacatgatcgtcatcctcaacgacaacaagcaggtctcgctgccgacggccacgctcgacgggcccgtgccgcccgtcggcgcgctcagcagcgcgctcagcaagctgcagtccagccgcccactcagggagctccgggaggtggccaagggcgtgacgaagcagatcggcgggtcggtgcacgagctggcggccaaggtggacgagtacgcccgcggcatgatcagcggccccggctccacgctcttcgaggagctcggcctctactacatcggccctgtcgacggccacaacatcgacgacctcgtctccatcctcaacgacgtcaagagcaccaacaccacgggccccgtcctcatccacgtcgtcaccgagaagggccgcggctacccctacgccgagcgcgccgccgacaagtaccacggcgtcgccaagttcgacccggcgacggggaggcagttcaagtcccccgccgcgacgctgtcctacaccaactacttcgccgaggcgctcatcgccgaggccgagcaggacggcagggtcgtcgccatccacgccgccatgggcggcggcacggggctcaactacttccaccgccgcttccccagccgctgcttcgacgtcgggatcgccgagcagcacgccgtcacgttcgcggccggcctcgcctgcgagggcctcaagcccttctgcgccatctactcctccttcctgcagcgcggctacgaccaggtggtgcacgacgtcgacctccagaagctcccggtgaggttcgccatggacagggccgggctggtcggcgccgacgggccgacccactgcggcgcgttcgacgtcacctacatggcgtgcctgcccaacatggtcgtcatggccccggccgacgaggccgagctctgccacatggtcgccaccgccgcggccatcgacgaccgcccgtcctgcttccggtacccgaggggcaacggcgtcggcgtcccgttgccgcccaactacaaaggcacccccctcgaggtcggcaagggcaggatcctgcgggagggcgaccgggtggcgctgctggggtacgggtcggcggtgcagtactgcctggccgcggcggcgctggtggagcgccacggcctcagggtcaccgtcgccgacgccaggttctgcaagccgctggaccacgccctgatcaggagcctcgccaagtcccacgaggtgctcatcaccgtggaggaaggctccatcggagggttcggctcgcacgtcgcgcagttcatggccctggacggccttctcgacggcaaactcaagtggcgcccactggtgcttccggacaggtacatcgaccacgggtcgccggcggatcagctggccgaggccgggctgacgccgtcgcacatcgccgcgacggtgttcaacgtcctggggcagaacagggaggccctggccatcatggcagtgccc

SEQ ID NO: 25354 - protein, 720 aa, Panicum virgatum
  misc_feature: Ceres CLONE 1863249
  misc_feature (396)..(563): Pfam Name: Transket_pyr Pfam Description: Transketolase, pyrimidine binding domain
  misc_feature (577)..(700): Pfam Name: Transketolase_C Pfam Description: Transketolase, C-terminal domain
  misc_feature: SWISSPROT Homolog: EC 2.2.1.7 1-deoxy-D-xylulose-5-phosphate synthase
  misc_feature: The sequence is a functional homolog of SEQ ID NO 12 in US patent 7132250
MALSTFSVPRGFLGVPAQDSHFAPAGELHAHKQLQARPPTVKGHARRRSTTCVSASLSEREREAEYYSQRPPTPLLDTINYPVHMKNLSAKELRQLADELRSDVIFHVSKTGGHLGSSLGVVELTVALHYVFNAPQDRILWDVGHQSYPHKILTGRRDRMPTMRQTNGLAGFTKRAESEYDCFGTGHSSTTISAALGMAVGRDLRGGKNSVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSTLFEELGLYYIGPVDGHNIDDLVSILNDVKSTNTTGPVLIHVVTEKGRGYPYAERAADKYHGVAKFDPATGRQFKSPAATLSYTNYFAEALIAEAEQDGRVVAIHAAMGGGTGLNYFHRRFPSRCFDVGIAEQHAVTFAAGLACEGLKPFCAIYSSFLQRGYDQVVHDVDLQKLPVRFAMDRAGLVGADGPTHCGAFDVTYMACLPNMVVMAPADEAELCHMVATAAAIDDRPSCFRYPRGNGVGVPLPPNYKGTPLEVGKGRILREGDRVALLGYGSAVQYCLAAAALVERHGLRVTVADARFCKPLDHALIRSLAKSHEVLITVEEGSIGGFGSHVAQFMALDGLLDGKLKWRPLVLPDRYIDHGSPADQLAEAGLTPSHIAATVFNVLGQNREALAIMAV

SEQ ID NO: 25355 - DNA, 526 bp, Panicum virgatum
  misc_feature: Ceres CLONE 1863262
  misc_feature: Encodes the peptide sequence at SEQ ID NO. 25356
cccggcgaccgccctcgcagcttcctccgccggttgccggctggcctcgaacctgcgagaagcttccggcgccggcccaccgagaaccgcaatggcgtccgccggcggagcggccatctcggcggggcccacgccgccgtcggcgacggcgacggcggtggagtggcaccagcggccgccgaacccgaagaacccggtggtattcttcgacgtcaccattgggtccatccccgccggccgcatcaagatggagctcttcgccgacatcgcccccaagaccgccgagaacttccggcagttctgcactggcgagcacagaaaaaatggtttaccacaaggttttaagggctgtcaattccatagagtgatcaaagatttcatgattcagggtggtgacttcttgaagaatgatggtactggatgcatatcaatctacggtgccaaatttgatgatgagaattttattgcaaagcatacggggcctggactgctctcaatggtattcattctttccacctagtttttt

SEQ ID NO: 25356 - protein, 142 aa, Panicum virgatum
  misc_feature: Ceres CLONE 1863262
  misc_feature (36)..(140): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MASAGGAAISAGPTPPSATATAVEWHQRPPNPKNPVVFFDVTIGSIPAGRIKMELFADIAPKTAENFRQFCTGEHRKNGLPQGFKGCQFHRVIKDFMIQGGDFLKNDGTGCISIYGAKFDDENFIAKHTGPGLLSMVFILST

SEQ ID NO: 25357 - DNA, 754 bp, Panicum virgatum
  misc_feature: Ceres CLONE 1863267
  misc_feature: Encodes the peptide sequence at SEQ ID NO. 25358
ctcgaaaccctagtccccctcccatccccggccgccacagttccccgtctcgtccccacctccggccctcgcgaagcgcctcctcgaccgccgggagtgagaagagatggcgggcaagggcgacgggccggcgatcggcatcgacctcggcaccacctactcgtgcgtcggcgtgtggcagcacgaccgcgtcgagatcatcgccaacgaccaggggaaccgcaccaccccctcgtacgtcgccttcaccgactccgagcgcctcatcggagatgcggccaagaaccaagtcgccatgaaccccatcaacaccgtctttgatgccaagcgtctcatcggcaggaggttcactgatgcttctgtccagagtgatatcaagctctggccattcaaggtcatttctggacctggtgagaagcccatgattgttgtccagcacaagggtgaggagaagcagtttgccgctgaggagatctcatccatggttctgatcaagatgcgcgagattgctgaagcttaccttggcagcactatcaagaacgctgtggtcacagttcccgcctacttcaatgactcccagaggcaggccaccaaggatgctggggtgattgctggcctcaacgtgctgcgtatcatcaatgagccgactgctgctgctattgcctatggtcttgacaagaaggctaccagtgtgagcgagaagaatgtcctcatctttgaccttggtggtggtaccttcgatgtttccctcctc

SEQ ID NO: 25358 - protein, 215 aa, Panicum virgatum
  misc_feature: Ceres CLONE 1863267
  misc_feature (9)..(215): Pfam Name: HSP70 Pfam Description: Hsp70 protein
  misc_feature: Useful for making plants with modulated heat sensitivity
MAGKGDGPAIGIDLGTTYSCVGVWQHDRVEIIANDQGNRTTPSYVAFTDSERLIGDAAKNQVAMNPINTVFDAKRLIGRRFTDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVSEKNVLIFDLGGGTFDVSL

SEQ ID NO: 25359 - DNA, 1911 bp, Panicum virgatum
  misc_feature: Ceres CLONE 1863268
  misc_feature: Encodes the peptide sequence at SEQ ID NO. 25360
gttagtggactaccttttcgccccgcccctgttgttcttgtcctgaaatcgatcttgcttagatcagattgacagtagggagacctcgatcgtagttaccaaggcaaggatagcgagggacgtatggatccggcgttgtacaaggcggcgacgcaggggaaagttgcgagcctgaggcagctggtggatccggaggatcccagtgtcctcagctccacgacgccccagctcaacacggcgctccacctcgccgccctgcacggccacgccgcgttcgccggcgaggtcctggacaagaacgaggagctgctcgtcgcccggaacgacgacggcgacacgccgctgcacctggcggccaaggcgggcaagctggaggtggcgcagctgctcatcagccacgccctggcctggccgcaggaccggaagagccctctggtcatgaccaacaaggccggcaacaccgcgctgcacgaagcggtgcggaaccggaggggcgccgtggcggaggccctgctcgacgccgatcccagccgtggccacgacctcaacgagcggatggagtccccgctgcacatggccgcccgcgagggcctcgtccaggtcgtccagaagatcgtcgactacacctgggtcggccaggagttcctgccctccgtctccctcagcggcaccgccctgcaccaggccgtgctcggcacccaccaccggatcgtggagatcctgctggagaagcggccggagctgatcgacctgacggactccgacggcaataacgccctgcactacgcggcgcagaaggaccaccagcgggcggtggagctgctgctcaagaagcggacggagctggcctacaggcgcaacctccacggcatgtccccgctgcacgtcgccgcgcactacggctcgacggacgccatcaaggcgctgctccggcattgccccgacgtggccgagatggtggacagctacggccgcaacgccttccacgcctccgtcgacagcggcaaggcgaacgcgctccggtgcctgctccgccgcgtccggcccgcggagctgctcaaccgcgtcgacagccacggcgacgcgcccctgcacgtcgccgccaagaggagccgcgtccactgcgcgctgctgctgctcaaggaccgccgcgtcgacccctgcgtccgcgaccacgccggccagaccgcgcgcagcctcgtggagatgaagctgcacacgggcgagatggacgcctacgagatgtacctctggaagcagctcaagcaccaggagctcaagaggtgccgcaagaagcagctgccgccgctcgccacctaccccagccgccggggctccaacgacaagtactttgagcgcatcgtcgagacctacatcctcgtcgccacgctcatcgccaccgtcaccttcgccgccaccttcaccatgcccggcggctacgaccagaccaagggcatcgcgctccacggccacaacaccgccttcaagatcttcgtcatctccaacaccgtcgccatgtgcagctccatcgtcgtcgtcttctgcttcatctgggcatggcaggaccccgtgaggttcaaggttgaccagctcctgtggggtcacaggctcaccatcatcgcctgcctcggcatgctcgtctcgctcatgaccgcagtgtacatcaccgtggcgcccacatcacggtggcccgcctacgtcgtcatcgccatcggcgtgagcaccccggccgtcgtcgtcctcatgctgggtagggatgtgatcttcgtgccgctataactgccagacccaattcatcaacgtgtgccagatgaattttcgagaaaaaaaacacgagcgatttgtagaaatatataaatatgttgttcatttgtagattaaattttatggaactccccatcagaccatgtc

SEQ ID NO: 25360 - protein, 551 aa, Panicum virgatum
  misc_feature: Ceres CLONE 1863268
  misc_feature (248)..(280): Pfam Name: Ank Pfam Description: Ankyrin repeat
  misc_feature (69)..(102): Pfam Name: Ank Pfam Description: Ankyrin repeat
  misc_feature (214)..(246): Pfam Name: Ank Pfam Description: Ankyrin repeat
  misc_feature (318)..(351): Pfam Name: Ank Pfam Description: Ankyrin repeat
  misc_feature: SWISSPROT Homolog: EC 2.7.11.1 Non-specific serine/threonine protein kinase
MDPALYKAATQGKVASLRQLVDPEDPSVLSSTTPQLNTALHLAALHGHAAFAGEVLDKNEELLVARNDDGDTPLHLAAKAGKLEVAQLLISHALAWPQDRKSPLVMTNKAGNTALHEAVRNRRGAVAEALLDADPSRGHDLNERMESPLHMAAREGLVQVVQKIVDYTWVGQEFLPSVSLSGTALHQAVLGTHHRIVEILLEKRPELIDLTDSDGNNALHYAAQKDHQRAVELLLKKRTELAYRRNLHGMSPLHVAAHYGSTDAIKALLRHCPDVAEMVDSYGRNAFHASVDSGKANALRCLLRRVRPAELLNRVDSHGDAPLHVAAKRSRVHCALLLLKDRRVDPCVRDHAGQTARSLVEMKLHTGEMDAYEMYLWKQLKHQELKRCRKKQLPPLATYPSRRGSNDKYFERIVETYILVATLIATVTFAATFTMPGGYDQTKGIALHGHNTAFKIFVISNTVAMCSSIVVVFCFIWAWQDPVRFKVDQLLWGHRLTIIACLGMLVSLMTAVYITVAPTSRWPAYVVIAIGVSTPAVVVLMLGRDVIFVPL

SEQ ID NO: 25361 - DNA, 2135 bp, Panicum virgatum
  misc_feature: Ceres CLONE 1863274
  misc_feature: Encodes the peptide sequence at SEQ ID NO. 25362
aagaagagcctccgcctcctcctcctccggtacccgagctcttctccactccacgtctcctccagccgcccatccatcgcaactaccaagctcccagacacagccacgaaccttttcagttcagctgtgccgttgagacacatggagtgcgagaacggacacgtcgccgccgccaccggcaatggcgtgtgcctgccggtgccgccgcgggccgaccccctgaactggggcaaggcggcggagaacctggccgggagccacctggaggccgtcaagcggatggtggaggagtaccgccggccgctggtgaggatcgagggcgccagcctcacggtcgcccaggtcgccgccgtggccgcggccggcgaggcccgggtggagctcgacgagtccgcccgcggccgcgtcaaggccagcagcgactgggtcatgagcagcatgatgaacggcaccgacagctacggcgtcaccaccggcttcggcgccacctcccaccgccgcaccaaggagggcggcgcgctccagagggagcttatccggtaagcactactgctagtaacaggacaaggacttttttccttcttctttattaattaatggcgcccaactgtaatcatgtactctgccaatttagacgccttaaacgcgtttcgcacgtttctttgtctactattttattacagattccttaacgccggggcgttcggcaccggcgacgacggccacgtgctgccggcgtcggccacgcgcgccgccatgctcgtccgcatcaacaccctgctccagggctactccggcatccgcttcgagatcctcgaggcgatcgccgcgctgctcaacgccaacgtcaccccgtgcctgccgctccggggcaccatcaccgcgtcgggcgacctggtcccgctctcctacatcgcggggctcgtcaccggccggcccaactccgtggccgtcacgcccgacggcaggaaggtggacgccgcggaggcgttcaaggctgccggcatccagcacggcttcttcgagctgcagcccaaggaagggctcgccatggtgaacggcacggcggtgggctccgggctcgcgtccccggtgctcttcgaggccaacgtcctcgccgtcctcgccgaggtgctgtccgccgtcttctgcgaggtcatgaacggcaagcccgagtacaccgaccacctcacccacaagctcaagcaccacccgggtcagatcgaggccgcggccatcatggagcacatcttggagggcagctcctacatggcgcttgccaagaagctcggcgagctcgaccccttgatgaagcccaagcaggacaggtacgcgctccgcacgtcgccgcagtggctgggcccccagatcgaggtcatccgcgccgccaccaagtccatcgagcgcgagatcaactccgtcaacgacaacccgctcatcgacgtctcccgcggcaaggcgctccacggcggcaacttccagggcacgcccatcggcgtgtccatggacaacacccgcctcgccgttgcggcgatcggcaagctcatgttcgcgcagttctcggagctcgtgaacgacttctacaacaacggcctgccgtccaacctgtccggcggccgcaacccgagcctggactacgggttcaagggcgccgagatcgccatggcctcctactgctccgagctccagttcctggccaaccccgtgaccaaccacgtccagagcgcggagcagcacaaccaggacgtcaactccctgggcctcatctcgtccaggaagacggccgaggccgtcgacatcctgaagctcatgtcgtcgacgttcctggtcgcgctgtgccaggccatcgacctacgccacctcgaggagaacctcaagagcgccgtcaagagctgcgtgatgacggtggccaagaagaccctgagcaccggcgccaccggcgcgctccacagcgcgcgcttctgcgagaaggaccttctgacggcgatcgaccgcgaggcggtgttcgcgtacgcggacgacccgtgcagcgccaactacccgctgatgcagaagatgcggtcggtgctcgtggagcacgccctggccaacggcgaggccgagcacgacccggacacgtcggtgttcgccaagct

SEQ ID NO: 25362 - protein, 506 aa, Panicum virgatum
  misc_feature: Ceres CLONE 1863274
  misc_feature (3)..(441): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MYSANLDALNAFRTFLCLLFYYRFLNAGAFGTGDDGHVLPASATRAAMLVRINTLLQGYSGIRFEILEAIAALLNANVTPCLPLRGTITASGDLVPLSYIAGLVTGRPNSVAVTPDGRKVDAAEAFKAAGIQHGFFELQPKEGLAMVNGTAVGSGLASPVLFEANVLAVLAEVLSAVFCEVMNGKPEYTDHLTHKLKHHPGQIEAAAIMEHILEGSSYMALAKKLGELDPLMKPKQDRYALRTSPQWLGPQIEVIRAATKSIEREINSVNDNPLIDVSRGKALHGGNFQGTPIGVSMDNTRLAVAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKSAVKSCVMTVAKKTLSTGATGALHSARFCEKDLLTAIDREAVFAYADDPCSANYPLMQKMRSVLVEHALANGEAEHDPDTSVFAK

SEQ ID NO: 25363 - DNA, 393 bp, Panicum virgatum
  misc_feature: Ceres CLONE 1863274-R
  misc_feature: Encodes the peptide sequence at SEQ ID NO. 25364
catacccgctgtacaggttcgtgcgccaggagctcggcaccgagtacctgaccggggagaagacgaggtcccccggcgaggaggtgaacaaggtgttcgtggccatgaacgcgggcaagcacatcgacgccgtgctcgagtgcctcaaggggtggaacggcgagcccctgcccatctgctgaacagggaacgcccgtgccccaaatgggacaaagtgaagccaggacagagatagcgagctacagagtggtcagacccagggccctgtaggtgcccacatccagatgtgcgtagctgattgtacctgtttttgttccttaattttccgttggagttcttgttagagggaattccttatttgacaccgaaatcaataaaatgtgcttcttttgc

SEQ ID NO: 25364 - protein, 59 aa, Panicum virgatum
  misc_feature: Ceres CLONE 1863274-R
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
YPLYRFVRQELGTEYLTGEKTRSPGEEVNKVFVAMNAGKHIDAVLECLKGWNGEPLPIC

SEQ ID NO: 25365 - DNA, 1217 bp, Panicum virgatum
  misc_feature: Ceres CLONE 1863280
  misc_feature: Encodes the peptide sequence at SEQ ID NO. 25366
acgctaatcacaaaaccaaacatccaaatccaaaccataccagccaagcaccatgcccgccctcgcctggtttctgcagcgagggtcaagcgctcgtgacgcaacggacacaggcatggcggcctccggccacacggtgatcgacatcgacgccgccgatgacgagccggcgaagacgccgctcgcgcctgtcccctacgtgatcagcttcgccgacctctcgtacagcgtcaacaagggcggcgggctcgccggctgctgcctggcgccccgcgccagcagccgcctggtggcgtcggcggacgcgcccccgccgccgtcggggtccaggcgcgccaagacgctgctcgacggcgtctccggcgaggcgtgcgcgggcgagctgctcgccgtgatgggcgccagcggctccggcaaatccacgctgctggacgcgctggcggggcggatcgcgcgcgagagcctccgcgggagcgtcacgctcaacggggagccgctccacggccgccggctccgcgccatctccgcccacgtcatgcaggacgacctgctgtacccgatgctgacggttcgcgagacgctgcgcttcgccgccgagttccgcctcccgcgcgcgctgtcgcaggagaagaaacacgcgcgcgtggacgcgctcatcgaccagctcggcctgtcccggtccgcggacaccatcatcggcgacgagggccaccgcggggtgtccggcggcgagcgccgccgcgtgtccatcgggacggacatcatccacgaccccatcctgctgttcctggacgagcccacctccgggctggactcggccagcgccttcatggtggtacaggttctccgccgcatcgcacagagcggcagcgtggtgatcatgacgatccaccagcccagcgcgcgcatcctcggtatcctcgaccgcctgctcctgctctcgcgcgggcgtactgtctacgccggcacgcccgccggcctaaagcccttcttcgccgagttcggcatgcccatgccggataacgagaaccccgccgagttcgcgctcgacaccatccgagagttcgagcgccagccagacggcggcgccgcgctcgccgatgtcaatgccaacaggatgaaggcgaacatcaagcttgtgagcacgatgcctctggagctcgccatcgccgagagcgtgtctcgggggaagctggtcgccgggagcggtttggggg

SEQ ID NO: 25366 - protein, 367 aa, Panicum virgatum
  misc_feature: Ceres CLONE 1863280
  misc_feature (88)..(278): Pfam Name: ABC_tran Pfam Description: ABC transporter
  misc_feature: SWISSPROT Homolog: EC 3.6.3.41 Heme-transporting ATPase
MAASGHTVIDIDAADDEPAKTPLAPVPYVISFADLSYSVNKGGGLAGCCLAPRASSRLVASADAPPPPSGSRRAKTLLDGVSGEACAGELLAVMGASGSGKSTLLDALAGRIARESLRGSVTLNGEPLHGRRLRAISAHVMQDDLLYPMLTVRETLRFAAEFRLPRALSQEKKHARVDALIDQLGLSRSADTIIGDEGHRGVSGGERRRVSIGTDIIHDPILLFLDEPTSGLDSASAFMVVQVLRRIAQSGSVVIMTIHQPSARILGILDRLLLLSRGRTVYAGTPAGLKPFFAEFGMPMPDNENPAEFALDTIREFERQPDGGAALADVNANRMKANIKLVSTMPLELAIAESVSRGKLVAGSGLG

SEQ ID NO: 25367 - DNA, 661 bp, Panicum virgatum
  misc_feature: Ceres CLONE 1863280-R
cgtgctgatcatcctggcctccttctgggcgggcagcggcttcgtcacgtttctctccgcggtggtgccgcacgtcatgttggggtacacggtggttgtggccatcctggcctacttcctccttttctccggtttcttcatcaaccgcgaccgcatccccgagtactggacgtggttccactacttgtccctagtgaagtacccataccaggccgtgctccagaacgagttcagcgacgcgtcgcgctgcttctcccgtggcatcgagatgttcgacggtagccctatcgggcatctcccagaggcagtcaagctgagggtgttggacgccatcagcaccacgctgggcacgaacgtcacctcgaacacctgcgtcaccactggccccgacatcctacagcagcaggccgtcaccgacataggcatgtggaagtgcctgctgatcaccgtggcctggggcttcttgttcagggcgctgttctatgtgatcttacttgttggcagcaagaacaagcggaagtaatccagaaatagtagttggggaacaagcaagaccacttagattgcagtaaatggaagcacttttatgttgtcttgctcgtcatcagcaagaacaaaactgcaggaggaaatgaactagcagtcaactgtgtttatttct

SEQ ID NO: 25368 - DNA, 2252 bp, Panicum virgatum
  misc_feature: Ceres CLONE 1863285
  misc_feature: Encodes the peptide sequence at SEQ ID NO. 25369
gttttctgctcgctttctctctcttccctctctccctcctctattcccctttacccctcttcccttccctccctcccctacctcgctaaccccacccacccgcctccctcctcgcccgtccccgccgcccgccgccgccggaaccctagctccggcgaggcccccggcttcccctccgtcgatcgggctccggggagccccgcgcccctccgcgcgatcgcgggagatccgggggtggtcgccgccggctgtgggggtgggagccacatgtcgggggtcggcagcggcaggccgccggccgcgcagaagatcctgcagtcgctgcgcccgcccatcgccttcgcctcgccgtcgcggccgcccttcgccgcgcccgacgactaccaccgcttccccacgccggcagcggccgcggccccagccgccacctcgggcggcgtcggcgcggcgggcgcttctgatactatcgaggaggggctggtcatccggacgccgctaaaaagaaaagccacatctgaagacaatgatgctgctgagtcaagtgactgtattattactagcactggatttcctggtagttcgatgctcactccagtctctggaaaaactgttaaaacttcgaagtcaaaggcgaagaacaataaagctgggcctcaaacgcctacgtcaaatgttggttcacctctcaatccagaaacgcctgctggcacttgccgctatgacagttcattggggcttctgacaaaaaagttcattaacctgctcaagcaggctccagatggcattttagatttgaatattgctgcagaaacactagaggttcaaaaacggcggatatatgacattaccaatgtccttgaaggaattggattaatagagaagacacttaagaacagaatccgttggaagggcctggatgattcaggtgttgatttggataatggtatttctgcattgcaggcagaagttgaaaatcttagcctgcaggagcaagcattagatgagcatatacgtgatatgcgtgaaaaactaaggggcttaactgaagatgaaaacaatcaaaggtggctatatgtgactgaagatgatatcaagagattgccctgctttcagaatgaaacactaattgcgataaaagcacctcatggtactacacttgaagtcccggatccggatgaggttggtgattatcttcaaaggagatatagaattgtattaagaagtacaatgggaccaatagatgtttacttggttagtcaatttgatgagaaatttgaggacttgggtggtgttgcaacacctacaaggcatacaaatatgcctagacgttatcccattgaagattccaatacaacaaatggtggacaatgtagcacagcaatggatgtggaacaaaatgttcaacaaagccagaggactccacaggatcctagtgctttgcatgattttggagggatgacaaggattattccttcggatgttgacacggatgctgattactggctcctaacagagggtgatgttagcattactgatatgtggaaaacagcaccagaagtgcagtgggaccagatggacttcttgtctgaagacgttgtcacaccacctcatgcccataatcagcagccagtcacagtcggtgggccacagatgcaggctccaagcatggataaaccataagatcatggtggcttttcaactctgacatctgaaacacctggagcagtgttttgaatgagatgtttctggtgcaacgacatagattctcttgtgaaagcaagtgctcattgcaacagaagagcaggacacttggagagaagttagggcagcagtccagaacttcagattgatgcgcaccttgaattcacactgtgcggaggccagtgaggtcaactaagctaacagcttgctgcctgatgggttgaagcgcaccagttcagtttcactgataaaggcacctgctccattgtgagtccattgctgctcattcatccactgctccattcgtttaccaagctaacattatcaaactagcggtactctgtttagaaatgctgcaaaaatgtataaatatcgtgacaaaatggtgcacaatgcatgaagtgttggtgtaacgatgggtgaggtatgagctatcgatgtagccagaattctttgtactctttgtacaattgtttgatacctagcacgctgtttccttgtaaaaaaactgttccatgcgtgtaacaaagaggagactcaaattttgtatc

SEQ ID NO: 25369 - protein, 470 aa, Panicum virgatum
  misc_feature: Ceres CLONE 1863285
  misc_feature (150)..(215): Pfam Name: E2F_TDP Pfam Description: E2F/DP family winged-helix DNA-binding domain
MSGVGSGRPPAAQKILQSLRPPIAFASPSRPPFAAPDDYHRFPTPAAAAAPAATSGGVGAAGASDTIEEGLVIRTPLKRKATSEDNDAAESSDCIITSTGFPGSSMLTPVSGKTVKTSKSKAKNNKAGPQTPTSNVGSPLNPETPAGTCRYDSSLGLLTKKFINLLKQAPDGILDLNIAAETLEVQKRRIYDITNVLEGIGLIEKTLKNRIRWKGLDDSGVDLDNGISALQAEVENLSLQEQALDEHIRDMREKLRGLTEDENNQRWLYVTEDDIKRLPCFQNETLIAIKAPHGTTLEVPDPDEVGDYLQRRYRIVLRSTMGPIDVYLVSQFDEKFEDLGGVATPTRHTNMPRRYPIEDSNTTNGGQCSTAMDVEQNVQQSQRTPQDPSALHDFGGMTRIIPSDVDTDADYWLLTEGDVSITDMWKTAPEVQWDQMDFLSEDVVTPPHAHNQQPVTVGGPQMQAPSMDKP

SEQ ID NO: 25370 - DNA, 1088 bp, Panicum virgatum
  misc_feature: Ceres CLONE 1863287
  misc_feature: Encodes the peptide sequence at SEQ ID NO. 25371
ctctcctccgcagcgccgaacccagccagtggagtaagggtttgtttgctcgcccccacccgaccgcagagacacccccccagaggttctgctcctgagcgcaggaagcctggcgacctgccatggacctggtgggaccgttgctggtggccatggccggcttgcttgacgcccccggcctcccgttcttcggctggctcatcaccgcgggctccttcggcctcgccgcgctcatctacgcgctcctccgcctgcagcgcgaggcctcgctctactggaccaaggcggccgccagggagaagcgcgccgcctggaagaccctgcggtgcccgagctccagccacacctggaccgaggactacttccgcggcggccagccgtcgacgtgctgcgcgtgcctgtcgtccctcggctccgcgcagggcgtggtgggctccagggccgccgaggccgacgtggtccaccgctgctctgtttgcggggtggccgcgcactcctactgctccaagggcgccgacaaggactgcaagtgcgtcgcgcaggcgggtgcgtcgcccttgctgcaccactggtccgagaggtgggtcgagctggacgacaacccggagatatcctccttctgctactactgcgacgagccgtgcggtgtgccgttcctcggcgtctctcctatatggcgctgcctgtggtgccagcggcagatccatgttgactgccatgcaaagctgttgaaggagaccgggaacacttgtgatcttggccttctcaggaggcttattgttcctccccagtcggtgaaagaaattagtgaaggcccagcaatcagtggagtgttgaactcgatcaaggaggggcttgtcaattcatcacgtaggagtcgggacaggaggccacgcagcaagaagcgcatgaataaccattccggtggcaagactgatccgactcccacaaacagctcaatccttgattcagtgcttgaaggatttgctagattgcagggcctggatggaaagtatgcactggcaaagcctaaattatctcaaaattctgtcaaccaaacatatggatctggcattcctaatggagca

SEQ ID NO: 25371 - protein, 321 aa, Panicum virgatum
  misc_feature: Ceres CLONE 1863287
  misc_feature (148)..(209): Pfam Name: C1_1 Pfam Description: Phorbol esters/diacylglycerol binding domain (C1 domain)
  misc_feature: SWISSPROT Homolog: EC 2.7.1.107 Diacylglycerol kinase
MDLVGPLLVAMAGLLDAPGLPFFGWLITAGSFGLAALIYALLRLQREASLYWTKAAAREKRAAWKTLRCPSSSHTWTEDYFRGGQPSTCCACLSSLGSAQGVVGSRAAEADVVHRCSVCGVAAHSYCSKGADKDCKCVAQAGASPLLHHWSERWVELDDNPEISSFCYYCDEPCGVPFLGVSPIWRCLWCQRQIHVDCHAKLLKETGNTCDLGLLRRLIVPPQSVKEISEGPAISGVLNSIKEGLVNSSRRSRDRRPRSKKRMNNHSGGKTDPTPTNSSILDSVLEGFARLQGLDGKYALAKPKLSQNSVNQTYGSGIPNG

SEQ ID NO: 25372 - DNA, 614 bp, Panicum virgatum
  misc_feature: Ceres CLONE 1863287-R
  misc_feature: Encodes the peptide sequence at SEQ ID NO. 25373
tgaagaaccccctgggcatgctgcagcaatcatgagtgaggtcctcgtcaatgctgagtgcaatggtgtgatcgacgcagctcagaagagattgctcctccatgagatagcactccgcttatcctcctgacacactgtccgctcctcttgtctgacaaaagctaacgccatgttatattgactgataccaagcatgatgaatcgcttccgttgcacagacacagagcacatatggccgagttgatgtatacaatacaaagaggaaatagaagatttcccacgttctcatttgactgtacctaaaagatagttctgcttctttgtggcttggctcatctgagcagcagttgaaagtggctgtcaagttgagagagtgccagtccacacaaagagttttgtagtgcatagaacactttgtaactacaaatagggctcaatgagcagtgtatctagagtgtgtgtcagtgtttttttgctccgaagatatggatacaaagtgtaaccagacttctctgagaagatctgtaatttagctatctttgataggtgatattttgttgtgctgtcgtggagaaattcgtagttacataatcttgatggatgtgttcctccgg

SEQ ID NO: 25373 - protein, 42 aa, Panicum virgatum
  misc_feature: Ceres CLONE 1863287-R
  misc_feature: SWISSPROT Homolog: EC 2.7.1.107 Diacylglycerol kinase
EEPPGHAAAIMSEVLVNAECNGVIDAAQKRLLLHEIALRLSS

SEQ ID NO: 25374 - DNA, 1297 bp, Panicum virgatum
  misc_feature: Ceres CLONE 1863302
  misc_feature: Encodes the peptide sequence at SEQ ID NO. 25375
aaactcttcccagtcgtctcgcagtctcaccacgcacccttcccccacctccgacgaaagattgaggcgcctcacctcatcttcaatggccggcgcctagatacagccccaccaagcaagcgtccctgcgcaccttgctcctgccgtcgtgctgtgccgtgcatccatcgacgtgctaagatggctcgggcgaaccagagatcctgcacgcgttgccacagggacctcccgacctgctcctgcggcggcgtcgggcccgcccgtcgatccgcccggctctgccgcggccgcgacccgggcggcgccgaccgcatcagcgccctgcccgacgacctgctgctccagatcctcaaccgcctcggctgcgccgccgccgccgcccggacgggcctgctgtcgcgccggtggcggggcctctggacccgcctccccgacctcgtcctccgcgagatgaaccccggctcgctccacgccgcgctcgcgcggctcgtcgccgcgttcgagctcgagccccgcgcccggccgcggctcctcaacatccgggcccccagctaccgcatgttctcgcccgcccagatcgcctcgctgctcaacgccgccgcgatgctgcagccggagaatctcactgtcgccgtcgccgctgccgtcctggtgatgctaccctccctcgacggcaccaggtcgatgacgctggacgtgcagggcgtcagtctgatcaccccccaattcggggacatgcccgacctcgagagcctgtcgcttcatcgctacgacgctgtcccattcagcctgctccgccgctgctccgcgctgcgtagcctctcgatctcctactggcgccttgactccatcacgatcgacctgcccttgctcgaggagctagttctgtcgcccacggcgcagctccggcgagtcgtcatcaaagcccctaggcttaagaagctgacgtttggggccatagagggtgtcctggatgatttctccctgtgctacatggcatcagaggtggagcatctctcgtggcaatgcgctagcggcgcgtcacatgttcactttggtgatatttggtccctgatgaccgtgactatgaagacatcggagcctcaaggtcagctgcagcgctgccctacctccaacaccctgtcgctcaacatatttgaatggcagtttgatcaggaagaaggtgcagccctgagctttgactttgagcattacatatcatcctgctgtcctattgccaacatttctgctttagagctgtgcatcaactccagcggtcatgtctacggagcactgg

SEQ ID NO: 25375 - protein, 372 aa, Panicum virgatum
  misc_feature: Ceres CLONE 1863302
  misc_feature (43)..(91): Pfam Name: F-box Pfam Description: F-box domain
MARANQRSCTRCHRDLPTCSCGGVGPARRSARLCRGRDPGGADRISALPDDLLLQILNRLGCAAAAARTGLLSRRWRGLWTRLPDLVLREMNPGSLHAALARLVAAFELEPRARPRLLNIRAPSYRMFSPAQIASLLNAAAMLQPENLTVAVAAAVLVMLPSLDGTRSMTLDVQGVSLITPQFGDMPDLESLSLHRYDAVPFSLLRRCSALRSLSISYWRLDSITIDLPLLEELVLSPTAQLRRVVIKAPRLKKLTFGAIEGVLDDFSLCYMASEVEHLSWQCASGASHVHFGDIWSLMTVTMKTSEPQGQLQRCPTSNTLSLNIFEWQFDQEEGAALSFDFEHYISSCCPIANISALELCINSSGHVYGAL

SEQ ID NO: 25376 - DNA, 700 bp, Panicum virgatum
  misc_feature: Ceres CLONE 1863302-R
aaaggcgtaagaggggaggatcatgaaattgatatattaaaagtcatattaagaagtgcagcgaggcttgaaagagtgaccatcacattcaagacgaagtcgaaacagcacattcgccacttttccaataaactacaaagaatcttgaaggcacatccctatgagaagtgtggaatttatcgctgttctggtgaggaggtggtgtttgcatgactagcttacttgtaggtgtgaaaaggttccactgcagttaattttgatggagccaaaacagcctgaagctatttaagtggttggagtttagccagcatccagcatccatttcctaaattccaagtgtctcaaggggcgtcccagaggccacttctatatcaagggcggcagagatgctgctgttaccgtgcatttgggatgaacttatctactgaaaaagattaatttactctctttaacaatgtactatccctggaggggcgtcccagaggccacttctatatcaagggcggcagagatgctgctgttaccgtgcatttgggatgaacttatctactgaaaaagattaatttactctctttaacaatgtactatccctggaggggcgtcccagaggccacttctatatcaagggcggcagagatgctgctgttaccgtgcatttgggatgaacttatctactgaaaaagattaatttactctcttt

SEQ ID NO: 25377 - DNA, 2115 bp, Panicum virgatum
  misc_feature: Ceres CLONE 1863308
  misc_feature: Encodes the peptide sequence at SEQ ID NO. 25378
attcattcattccccaccgcgccaaggtgagcctgcatttctgagctcatctccagtccaccgcgccaaggtgacccagcagaggtaggacgcgactcgcgaggcgcatgagcaagcccgtgcgataagagagctaggcaagatgatggcatcgacgaagcagctggcgaccgaggccatccgctcatcggggtggctcttctggggcctctgggcgtcgctgctgacggtctacgctccgcggggtcaaaatctgcccaagatgtacttcaacatgcacctccggcggcacgcgaggcggctggtcccgttcctggacccgtacgtcacaatcgacatcgtcaacaacaagaagtcttctaatttgttgtcacctggcgacggcgaggaatcgtgccagtccagcaacaacgcctacaaggaagtggaggcgtacctgaccaaggtgtgcacgcgggacgccctcgcgttctgcgccgagggcaccgtcgaggaccgcagcttcacgctcagcctccgcgtggggcaggaggtgactgaccacttacgaggcatcaccgtgtggtggctactggaggagagatgcctccgcctgatgttcccccagcggtaccgggcgttcatcctggacgagtacctgccgcacgtccgccaaactggctgtgatgatctgatcgtcaccgtcgacatcgtcgaagacaagtatgattcgatcaataatgaggagctcaagagcatcaaggcctttgaggaggtgaaggcgtacctgaactcggcgtgctcgcgggactcgctcgacctctacgccgacggcaccttcaggggcgacagcttcttgttcagcctccgcacgggcgaggaggtggccgacagcttccgcggcgtcagcttgcggtggttgtcggggaaaatcaacaccaacaacacacagcgccctacccgcttcctccgcctcaagttcccccagcagcaccgggcgttggtcctgaacgagtacctgccgcacgtccgccgagaaggccgcaacatcatgatcggcaagcgaggccagagcctctacacctacgaggaaagtatgatggggagactaggtccgtggagacacactgcctttgagcatccagccaccttcgacaccctcgcgatgcacccgaacaagaagcgcaagatccaggaagatctggacaacttccgcggaaacaaggagtactaccgccgcatcggaaagccatggaagcgcggctacctcctgtatggcccaccaggcacaggcaaatccacaatgatagccgccatggccaaccacctcaagtatgacatctacgacgttgatcttacatcactgaagaacaaccgcgacctccgccgtctcctcgtcgatataacagccaggtcaatcgtcgtcatcgaggatatagactgcagcttcgatgatgtcaccggccagcggagcaaccaggggaggcggagtggatggatgaggtacaacaacgacaacgacacatctaaagtgacgctgtcggccctgctcaacttcatcgatggtgtctggtccgctcaaagtggtgagcggatcatagtgttgacgaccaacttcccggaaaagctcgaaccggcactgatccggagtgggcggatggacgtgcacatcgagatgtcctactgctgcttcgaggcgttcaagacgctggccaacaactaccttgaggttgaagcacaccctctgttccaaagagtcgaggagctactgcaggtggtgaagatcactccagccgacgttgccgagtgcctcctttgtccccagactgactcccccacaggctccgaccgcggtgtggagacatgcatcgggcgcctgatcaacgaactcgagaagaaggctgcactcaacgagctcgaggagaaggctgcggagccaaagaagcggcggcggcggcgacactgattggcaggccggtagctgtggctaatggatgccgtgactgttcactcaggaaaggtgtttggcgttccatgaaaagactcgatcaaataagtctagccgcgtactgggtcatatatatgtaacgttctctgtaattttttatttgaaataaattggcgccctcgaactgg

SEQ ID NO: 25378 - protein, 600 aa, Panicum virgatum
  misc_feature: Ceres CLONE 1863308
  misc_feature (367)..(561): Pfam Name: AAA Pfam Description: ATPase family associated with various cellular activities (AAA)
  misc_feature: SWISSPROT Homolog: EC 3.6.4.3 Microtubule-severing ATPase
MMASTKQLATEAIRSSGWLFWGLWASLLTVYAPRGQNLPKMYFNMHLRRHARRLVPFLDPYVTIDIVNNKKSSNLLSPGDGEESCQSSNNAYKEVEAYLTKVCTRDALAFCAEGTVEDRSFTLSLRVGQEVTDHLRGITVWWLLEERCLRLMFPQRYRAFILDEYLPHVRQTGCDDLIVTVDIVEDKYDSINNEELKSIKAFEEVKAYLNSACSRDSLDLYADGTFRGDSFLFSLRTGEEVADSFRGVSLRWLSGKINTNNTQRPTRFLRLKFPQQHRALVLNEYLPHVRREGRNIMIGKRGQSLYTYEESMMGRLGPWRHTAFEHPATFDTLAMHPNKKRKIQEDLDNFRGNKEYYRRIGKPWKRGYLLYGPPGTGKSTMIAAMANHLKYDIYDVDLTSLKNNRDLRRLLVDITARSIVVIEDIDCSFDDVTGQRSNQGRRSGWMRYNNDNDTSKVTLSALLNFIDGVWSAQSGERIIVLTTNFPEKLEPALIRSGRMDVHIEMSYCCFEAFKTLANNYLEVEAHPLFQRVEELLQVVKITPADVAECLLCPQTDSPTGSDRGVETCIGRLINELEKKAALNELEEKAAEPKKRRRRRH

SEQ ID NO: 25379 - DNA, 355 bp, Panicum virgatum
  misc_feature: Ceres CLONE 1863310
  misc_feature: Encodes the peptide sequence at SEQ ID NO. 25380
accgagccatgggagtgacgggagcgcgagcgagcgatagccgatatcgaggcgggccatggcgggtgcgggcagaagtcgccgccgtcatcccgagtcgccgccggctacggtgaggctggcgctgctggtggcggtggccaccatggccggcgtcacggcggagggcacggcggtgctcgtgggggagccgcgcctgttgagcatgctgggcaactgcctccgctccgcccctcccatggggtggaacagctggaaccacttccagtgcggcggccaccgccaggtggtcatcagggagaccgctgactcgctcgtgtccaccgggctcgctgctctcggctacaaatacatc

SEQ ID NO: 25380 - protein, 98 aa, Panicum virgatum
  misc_feature: Ceres CLONE 1863310
  misc_feature: SWISSPROT Homolog: EC 3.2.1.22 Alpha-galactosidase
MAGAGRSRRRHPESPPATVRLALLVAVATMAGVTAEGTAVLVGEPRLLSMLGNCLRSAPPMGWNSWNHFQCGGHRQVVIRETADSLVSTGLAALGYKY

SEQ ID NO: 25381 - DNA, 671 bp, Panicum virgatum
  misc_feature: Ceres CLONE 1863328
  misc_feature: Encodes the peptide sequence at SEQ ID NO. 25382
tgagtatgatcttgatttgttcaacattgtcgttgttcctgatttcaatatgggagcaatggagaataagagcttaaatatatttcaatctagacttgtgcttgcatcacctgagactgccactgacggtgattatgctgcaattttgggtgttgttggacacgagtatttccacaactggactgggaatagagtaacttgccgtgattggttccagctaaccctgaaagaaggactgaccgtcttcagggatcaggagttctcgtcagatcttggttgtcgtacagtaaaacgcatcgctgatgtctccaaactcagaatctatcaattccctcaggatgctgggccgatggcacatcctattcgcccccattcctatatcaagatggacaacttctataccgtcacggtttacgagaagggtgctgaagttgtcagaatgtacaagaccatgtttggagcatcagggttccgaaagggcatggatctttacttccaaaggcatgatggacaagctgtcacttgtgaagacttctatgcagccatgtgtgatgcaaataatgcacaactgccaaactttttacaatggtactctcaagcaggtacacctacagtcaaggtgtcatcttcatatgatcctagttctcagaccttctctttgaaacttagcc

SEQ ID NO: 25382 - protein, 223 aa, Panicum virgatum
  misc_feature: Ceres CLONE 1863328
  misc_feature: SWISSPROT Homolog: EC 3.4.11.2 Membrane alanyl aminopeptidase
EYDLDLFNIVVVPDFNMGAMENKSLNIFQSRLVLASPETATDGDYAAILGVVGHEYFHNWTGNRVTCRDWFQLTLKEGLTVFRDQEFSSDLGCRTVKRIADVSKLRIYQFPQDAGPMAHPIRPHSYIKMDNFYTVTVYEKGAEVVRMYKTMFGASGFRKGMDLYFQRHDGQAVTCEDFYAAMCDANNAQLPNFLQWYSQAGTPTVKVSSSYDPSSQTFSLKLS

SEQ ID NO: 25383 - DNA, 1242 bp, Panicum virgatum
  misc_feature: Ceres CLONE 1863386
  misc_feature: Encodes the peptide sequence at SEQ ID NO. 25384
agcatcatggccatcgttcgcctctgttcttcctctcccctgcactcgtcgacgttccatctctgggcgctcacgagcacttcccgttcttcctcggttcgattcaattaagcataggccttttcgtgtggggctagcctgtgatcttcttgattcttgagaggcgaaagctctgcgccttttctggttgagtggtgagctgtcgcaatggccggcggcgtggtggtgaacaccggaggggccaaggactaccccggcaagctcaccatgtttgtgctcctcgcctgcatcgtcgccgccaccggcggcctcatcttcggatatgacatcgggatctccggtggcgtgacgtcgatgaacccgttcctgatgaagttcttcccgtcggtgtaccgcaaggagcaagaggcggagcgcaaccagagcaaccagtactgcaagttcgacagccagctgctgaccatgttcacctcctcgctctacctcgccgcgctggtggcctccttcttcgccgccacggtgacgcgcgtggccgggcgcaagtggtccatgttcggcggcggcgtgacgttcctgatcggcgccgcgctcaacggcgccgccaagaacgtggtcgtgctgatcctcggccgcgtcctgctcggcatcggcgtcggcttcgccaaccagtccgtgccggtgtacctgtcggagatggccccggcgcgcctccgcgggatgctcaacatcgggttccagctcatgatcaccatcggcatcctgtgcgccaacctcatcaactacggcaccgccaagatcaagggcggctggggctggcgcgtgagcctcgcgctcgccgccgtgccggcggccatcatcgccgtgggcgcgctgttcctgcccgacacccccaactccctcatcgaccgcggccacaccgccgccgccaagcggatgctcaagcgcgtgcgcggcacggaggacgtggaggaggagtacaacgacctggtggccgccagcgacgagtccaagctcgtggcgcacccgtggtgcaacatcctgcagccgcgctaccggccgcagctggtcatggccatcgtcatccccatgttccagcagctcaccggcatcaacgtcatcatgttctacgcgccggtgctcttcaagacgctgggcttcgccgacgacgcctcgctcatgtccgccgtcatcacgggcctcgtgaacgtcttcgccaccttagtctccatcgtcaccgtggac

SEQ ID NO: 25384 - protein, 344 aa, Panicum virgatum
  misc_feature: Ceres CLONE 1863386
  misc_feature (26)..(344): Pfam Name: Sugar_tr Pfam Description: Sugar (and other) transporter
MAGGVVVNTGGAKDYPGKLTMFVLLACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLIGAALNGAAKNVVVLILGRVLLGIGVGFANQSVPVYLSEMAPARLRGMLNIGFQLMITIGILCANLINYGTAKIKGGWGWRVSLALAAVPAAIIAVGALFLPDTPNSLIDRGHTAAAKRMLKRVRGTEDVEEEYNDLVAASDESKLVAHPWCNILQPRYRPQLVMAIVIPMFQQLTGINVIMFYAPVLFKTLGFADDASLMSAVITGLVNVFATLVSIVTV

SEQ ID NO: 25385 - DNA, 484 bp, Panicum virgatum
  misc_feature: Ceres CLONE 1863386-R
gtgatgactatcttcgtggcgctcttcctgccggagaccaagaacgtgcccatcgaggagatggtgctcgtgtggaagtcgcactggtactggggccgcttcatccgcgacgaggacgtgcacgtcggcgccgacctcgagatgcaaggcgccaacggcaacggcaagctctgaagctcggcggcggcgcgcagtagccggccggccgtgcgtccgtgacgcccggccgtcgctcgctgctgacggtgtcgggcaattatctactcatacggaattattattcttcgggtttagcgggaagttcaaaagttttaaggattcactgtattataaatcgtcgcattaggtagggtgactggatgttgaccaacggtcaacaagtcttcgtttcctgtcttcttttttctttgtttcggatactcgatgtggtgggtacggtgtggatcaaaatctgatttaaatatgaatgcaagttgcaaatttt

SEQ ID NO: 25386 - DNA, 729 bp, Panicum virgatum
  misc_feature: Ceres CLONE 1863391
  misc_feature: Encodes the peptide sequence at SEQ ID NO. 25387
accattgctgccaagtgccagcctgccagagcaacgagcgcgctagagcggagacgccatggcggcaggcggtggcagcaaccgtgccctgctcgcgctccgcgtcctcctcctctgcgccctcgccgccgccgcggctaccgccctgctccctcgcgccacgggcccgtgcgcacgctcgctgtcgaggagcatcctcgccgccacgggcctcgacccgtacctcctctcctgcgccggcggcgacgcctccggcggcgctccattgctgccccagcagcgcgccaacgggaccggcagcggcgccgcgggaggacccatcgtgaccgaccagcggtgcgtcaggggcaagttcccgccggacgcgctcccgcccctgcagtgctgcccgccggcgtccgcgtcggcgcccgtcaacttcacgctcccggaccccgcggggccgctccggacgcggcggccggtgcacgccgtcggcgcggagtacatggccaagtacgcgcgcgcggtggcgctgatgaaggcgctgccccggtcggacccgcggagcttctaccagcaggccaacgtccactgcgcttactgcaccggcgcgcaccgccaggcggggcgcccggacctgggcgtgcagatccacttctcctggctcttcttccccttccaccgcgcctacctctacttcttcgagcgcatcgcggccaagctgctgggggaccccggcttcgcgct

SEQ ID NO: 25387 - protein, 223 aa, Panicum virgatum
  misc_feature: Ceres CLONE 1863391
  misc_feature: SWISSPROT Homolog: EC 1.10.3.1 Catechol oxidase
MAAGGGSNRALLALRVLLLCALAAAAATALLPRATGPCARSLSRSILAATGLDPYLLSCAGGDASGGAPLLPQQRANGTGSGAAGGPIVTDQRCVRGKFPPDALPPLQCCPPASASAPVNFTLPDPAGPLRTRRPVHAVGAEYMAKYARAVALMKALPRSDPRSFYQQANVHCAYCTGAHRQAGRPDLGVQIHFSWLFFPFHRAYLYFFERIAAKLLGDPGFA

SEQ ID NO: 25388 - DNA, 397 bp, Panicum virgatum
  misc_feature: Ceres CLONE 1863396
  misc_feature: Encodes the peptide sequence at SEQ ID NO. 25389
  misc_feature (234)..(234): n is a, c, t, g, unknown, or other
ccccgagcgccaccaccccaacgacgcgcagccccggcagccggcccccggcaaggacgccgaggaagacaagcgcggcgagaacgacggcccccacagggagcgccgccccgacagcccccaggaccgccacggccccgccagccgcgaagacgcccaggaccgccacgagcaggcggcggagcacgagggcgaccgcaacgccgcgcgccacaaggagcgcgggaccaggcncgccgcgctttttttcgccgacgccagccccgccgcgggccccagccagcacaggcccaaccccgccaaccgcgccgaggagccgcagaccgccaaccgccgccggaacaagcacaagagcggggaccacgccgacgagggccccgccaccaccgagcccaac

SEQ ID NO: 25389 - protein, 131 aa, Panicum virgatum
  misc_feature: Ceres CLONE 1863396
  misc_feature: SWISSPROT Homolog: EC 4.1.1.31 Phosphoenolpyruvate carboxylase
  misc_feature (78)..(78): Xaa is any aa, unknown, or other
PERHHPNDAQPRQPAPGKDAEEDKRGENDGPHRERRPDSPQDRHGPASREDAQDRHEQAAEHEGDRNAARHKERGTRXAALFFADASPAAGPSQHRPNPANRAEEPQTANRRRNKHKSGDHADEGPATTEP

SEQ ID NO: 25390 - DNA, 614 bp, Panicum virgatum
  misc_feature: Ceres CLONE 1863404-R
  misc_feature: Encodes the peptide sequence at SEQ ID NO. 25391
ctcagttgtatgctgctaatgaactatacaataaagggtggttttaccacaaagactaccgtgtctggctcacaagagctcctaatgccgcgcctctggtgaaaactccacttcatgaacgagggtcctacatttgttttgatccaaacatctgggatactgtccataaggacaacttcgttctccattatgaggcagtggagaagagacccgtccttccttccgccgcccaaaatcttagatgggaactataagtttccctaggttctcctgaacttgaagttagtttgttttggttagtcttcagtagctggtgtcatagatcggatgagttcatagaaattcattctgacatgcatgctgttctggaaaatggagctccttcgttagccggcaagccctgccaggtggcagcagtagacatgtagctgagatctagtatgcttcataattcattggctttaatcagtagggctatattgtaactatgttttgagtttccctgcttttttggtgatgcagtctccatgacgactgtaaatgttttggtcatttgagttgcataaaagaaaattcggactttggattcaagaagtgcgcttcgttcttctttt

SEQ ID NO: 25391 - protein, 83 aa, Panicum virgatum
  misc_feature: Ceres CLONE 1863404-R
  misc_feature (1)..(67): Pfam Name: NOT2_3_5 Pfam Description: NOT2 / NOT3 / NOT5 family
QLYAANELYNKGWFYHKDYRVWLTRAPNAAPLVKTPLHERGSYICFDPNIWDTVHKDNFVLHYEAVEKRPVLPSAAQNLRWEL

SEQ ID NO: 25392 - DNA, 1217 bp, Panicum virgatum
  misc_feature: Ceres CLONE 1863404
accactcccctccctcaccccaccgcttcaccatctctgttccccgtcgccgccgtcgtcgtctccctctcgccggtcctccacgtcgagagatccgctcccgcaggccgcacggccgcgctccacgtcgattggataaacaatataatgccatttggtggataatatttgaggtgctccaggcttgttcatttttgggaatcatcaaaatgtcaggaccactgaattcaaacattagtggggctgcctcaaaccttcgcgattcaacaggaaggtcatttgcatcatcattttccggacaatctggatcacttccaggctcacacaacattcatggaaatctcaatctcacaaatatctctggatcattagcaccaagaaataattcaatggcaggtatcccgtcaccaggggttcaacagcctggtggtagtatttccagtggccgtttcccctcaaataatcttcaagcttccatgtctcagattccccatggtcattctggcatcagcaacagaggaggtatgaatgttgggggaaatcctggatttagtagtagcatgaatgctattggtgcttcaatacaaggtttatcctcaaacttggctaatgtgggtagccgaaattctgctcctgggttggcagcttctccagttttggggaatttaggcccacgaataacaaattcggggaatattgtgggtgggggcaatattgggataagtataagctctgcagggctgtctatgcctggtatagtgtctcgcatgaatttaagtgtcaactctggaagtggggctatcaatattcaaggatccaaccggatgagtagtatgcttcagcaagcatctcctcaattcatgaacttgcttggaagttcttacccgacacctggagcgtcattgtctcagaatcaagtacaggcaggaaacagttctttaggatcttctggaatgctacatgatggaagctcgggtgacaatgccccatttgatataaatgacttccctcagctaactggacggcctaattctgctggaggtggtcaaggccaatatgggtcactgcgaaagcatggagtaagtgtcaacaccatcgtgcaacaaaatcaagaattcagcattcagaatgaagattttccagctttaccaggatataaaggtagttcctcagattatgctatggatatgcatcacaaggaccaccttcatgagaat

SEQ ID NO: 25393 - DNA, 2697 bp, Panicum virgatum
  misc_feature: Ceres CLONE 1863419
  misc_feature: Encodes the peptide sequence at SEQ ID NO. 25394
gccgcaaacacgcacgccgcccacgccaactcttcgcacgaatccttctctcctcgatccactcctccatcttttcaattcctagcgatccatctctcctcctcagccgccgccgccgccgccgccgccgccccgggtggtgctgctgccctgcatttctgggagggatcccgcctcgtccgcgccgcgggcaactttgcggggcgagatttggcaggcctagtgtcccgccaggaggcgcaaattccggtcagcgtcgcgtggtttcgaagccgaccggttgatttgaatccgggggcacggattggttgggtgagacgtgagagggcaggctcgatttcgcggcgcgccgggagggtacggagtagcttgctcgggtcaggcggcgcgcggaggcttagctgcttggctgggctgcgttgatggcgggatctgtcggcgtgggcagggcggcgccgcggtcgtcgccgaagcggtacgcgggcaccgacccgccgttgtctctagccgggccgacgatggcggatctccagaggacggccgagctggagaagttcttggttgaagcaggcctttatgaagggaaggaggagtctgcgaagcgggaagagttgctgtccgagattggtcagatagtcaaagaatgggtgaagcagttgactcgtaagaaaggatatgctgagcaattggttgaacgagcaaatgtagtccttttcacttttggatcttacagattgggggttcatggacctggagctgatattgacaccctttgtgttggaccttcatatgtgaaccgagaggaggatttctttgtcacactgcatggcgtattagcagaaaaggaagaagtgactgagttgcaacctgtacctgaagctcatgtacctgttttgaaatttaagtttcgtgggatatcaattgaccttctctatgctagcctctcactttcagtaataccagcagattttgatatttctcaaggatctgtgctttctgatgttgatgaagcaactgttcgaagtcttaatgggtgcagagtggcagatcagattcttcggcttgttcccaatgctgagaacttccggacaacactcagatgcttgaagtactgggcaaagagaaggggtgtttattctaatattactggattccttgggggtgtcaactgggctctgctggttgctcgtgtctgccaactatatcctaatgctgtgccaagtatgctagtttctagattcttcagagtttttacccagtggcaatggccaaatccagtaatgctttgtgcgattgagaatgatgatcttggtttttctatatgggatccacgcaaaaatcctcgtgatagaaaccatctaatgcccatcatcactccagcctacccatgcatgaactctagttacaatgtttcaaccagcacgctgagggttataatggagcaatttcagtttggcaacaaactttgtcaggaaattgaccttaataaggccaattggagtgctttatttgagcctttccatttcttcgaggcatatagaaaatttctagtggttgacatagttgcggatgatgatgatgatcttcggctttggaagggatgggttgagtctcgtttgagacaacttactttaaagattgagcgggataccaaaggaattctgcagtgccatccttacccatgtgagtattcagatcctgcaatagaatgtgcacattgtgccttctacatgggcttatcaaggaaagaggggttgaaaaaacggggtcaacaatttgatatcaatgggacagtagatgaatttatgcgcgaaattggcatgtattcattgtggaagcctgggatggatctggctgtcacccatgtccgtagggagcaggtcccatcttatgtatttgagcaaggatacaagaaaccctctcctacgatgcatgcaaaccaacaggagcagtctgatggagatggcacactgagtccagatctggagggccagcttaagagaaagtacgattctgacggagatggccttgtggaactttgcaaacctgttaaaagggcttcagtaagcccacctggtcatgaaaccccacctcatcatggaaatagtgtcagtaaggtcctatgtgacagtccagtgaaattagtttccagtgcgctttgcagcgaggctcagacttctccgtcacatgatgatgtcacttttgaaccaacagcattaactagttcacatggatctgaggatacctcagcatcaggcacaagctgtgcagcagtgggagcagttgttttggcggatgaatctagcaagcttgttaacctgacatgcgatgttgaagttgacacagttcagatgatggaagtgcacacaacttcagaatgcctggctcagaagaatgggacaaagcttgagggaatcagaagcttggcgagcagcaattgtgctgagtttctagagagggaagttcttgctgagaacatgcacttgagtggagatgaagtgatttgaaacggcgtttcagatagagtcgacgaaacatgtgattcgagtggttttgaaaggtgatgcaggtcagaaattttatagagctcaagaggccagaaagcggagccgaggacttcactcatttggtgtcaacagtacaagggaccaatgcctgctggctgctggatggaagtgaatttgacgcctgtggtcg

SEQ ID NO: 25394 - protein, 694 aa, Panicum virgatum
  misc_feature: Ceres CLONE 1863419
  misc_feature (16)..(366): Pfam Name: PAP_central Pfam Description: Poly(A) polymerase central domain
  misc_feature (367)..(502): Pfam Name: PAP_RNA-bind Pfam Description: Poly(A) polymerase predicted RNA binding domain
  misc_feature: SWISSPROT Homolog: EC 2.7.7.19 Polynucleotide adenylyltransferase
MAGSVGVGRAAPRSSPKRYAGTDPPLSLAGPTMADLQRTAELEKFLVEAGLYEGKEESAKREELLSEIGQIVKEWVKQLTRKKGYAEQLVERANVVLFTFGSYRLGVHGPGADIDTLCVGPSYVNREEDFFVTLHGVLAEKEEVTELQPVPEAHVPVLKFKFRGISIDLLYASLSLSVIPADFDISQGSVLSDVDEATVRSLNGCRVADQILRLVPNAENFRTTLRCLKYWAKRRGVYSNITGFLGGVNWALLVARVCQLYPNAVPSMLVSRFFRVFTQWQWPNPVMLCAIENDDLGFSIWDPRKNPRDRNHLMPIITPAYPCMNSSYNVSTSTLRVIMEQFQFGNKLCQEIDLNKANWSALFEPFHFFEAYRKFLVVDIVADDDDDLRLWKGWVESRLRQLTLKIERDTKGILQCHPYPCEYSDPAIECAHCAFYMGLSRKEGLKKRGQQFDINGTVDEFMREIGMYSLWKPGMDLAVTHVRREQVPSYVFEQGYKKPSPTMHANQQEQSDGDGTLSPDLEGQLKRKYDSDGDGLVELCKPVKRASVSPPGHETPPHHGNSVSKVLCDSPVKLVSSALCSEAQTSPSHDDVTFEPTALTSSHGSEDTSASGTSCAAVGAVVLADESSKLVNLTCDVEVDTVQMMEVHTTSECLAQKNGTKLEGIRSLASSNCAEFLEREVLAENMHLSGDEVI

SEQ ID NO: 25395 - DNA, 2056 bp, Panicum virgatum
  misc_feature: Ceres CLONE 1863428
  misc_feature: Encodes the peptide sequence at SEQ ID NO. 25396
aacctctcccccaatctctgcaagcacaagctcgattgatcgaggaatggtagggcccgggctgacggtcggcgggtggttcgccggcgccgtgatctccaacttcgtggcgaaggcgcgctctatcttggaggcgaatcacgccctgcaggccgaagccggcgacatgttgtacagcgtgcaggccgcgctgccccggatcaggatactggtcgaggtgaccgagcgcaaggctatctccaacggtagctacgacgagtggctgcagcaattcaaggacgtcgtgtacgaggctgaggacctgctcgatgacttcgagaccaagaggatccaggacgagttgcgcaggaagagcagtaaggttggctcggctgcgtccttcgctctcaggtacatgagaaacctcctactttcggatgctgatctccagaggcttaaagatgtcctgaagaagctaaacaagattgtcaatgatgaccgtggtacccgcttccaaggcatcctggagtcatctgacgaacaggaggtgccagtgccaccaacacggcctcttgtcgtcggccgggataaggagaaacaggatctgctgagcctgatatgccctgctgtgccactgtcccgagatggcgtggaatccagcaagcagttttctgtcattgttgtagtaggagcagccggtgtgggcaaaactactcttgctcagataatctacaagaaccaaaatgtcacggaggcttttgcgttgagggggtgggtattggcctcccgtcgcagtcgtgataagcgggacattgtcaaagatattgttgattcttttggcatggggcagcacagcactctgttcagtgtcacagaaaacaagaggttcttccttgttcttgatgatgtacaagatgatctgcgtagactatggggttccctgaggtcaatcctggcaggtgcggcaaatgggagtgttgtgttgttaacaactcgatcagaagaggatgtatatactttcagagcaacagctcatgtttcactgaagcatctaccgttagaatccatgtgcagagtttttgagcatcatgcatttggaaggcaggaaaaaggttcactcgaatcaattggaaagaaaatagtgcaaaacctgcatggagtaccattactggcagaagcaattggaaggctactgagacaaaatctagacgagggccactggggaaaaatttccagaagtcattggtggctttattctgaagatgatgatagtcaaaatgttgctctaccttcagtaacaattttgtgtgaacatctaagtgatcatttgagaaagcgtttgtgttactgttcaatattcccttctggttatttgtttaaaaggaatgtgttgattcagatgtggaaagctaatttcatgcagcaacatgatgggattgagatggagaaaaaggaaaatcagtggtttgacgagcttttcaacagatcatttttccagcctacaatatgggaaaacaagtacataataccagatatgattaaagagccattataccgcattgctgaaaaagaatgccatgcagctacagattcacgggagctcaaaagaagtctccaactttatcgtcacctggctatagatagttctgattttagtgtgcacttggacttaaggaagaccaataagtggcgaacaattttattttttgatggacacagaacaaataagctacaagaagcacttgccaatgttttgtgcgaccctagtgccctacggttattagacttctcttactccaaagctaaattgggaaaggctcctgatttcattaacaaattcactcaccttcggtttctagatctctcctttactgagattaccataattccaggctccctctgtaagctgcgccttctgcaagtactcggtctacgagggtgccagctcacagaactacctagagctatgaataagttagttaacctccaatttttatatgcagaagctcagacagtttctctcatatacaagatagggcagctgacaaatctcctagggctcgaggagttccctgtg

SEQ ID NO: 25396 - protein, 669 aa, Panicum virgatum
  misc_feature: Ceres CLONE 1863428
  misc_feature (153)..(456): Pfam Name: NB-ARC Pfam Description: NB-ARC domain
  misc_feature: SWISSPROT Homolog: EC 2.7.11.1 Non-specific serine/threonine protein kinase
MVGPGLTVGGWFAGAVISNFVAKARSILEANHALQAEAGDMLYSVQAALPRIRILVEVTERKAISNGSYDEWLQQFKDVVYEAEDLLDDFETKRIQDELRRKSSKVGSAASFALRYMRNLLLSDADLQRLKDVLKKLNKIVNDDRGTRFQGILESSDEQEVPVPPTRPLVVGRDKEKQDLLSLICPAVPLSRDGVESSKQFSVIVVVGAAGVGKTTLAQIIYKNQNVTEAFALRGWVLASRRSRDKRDIVKDIVDSFGMGQHSTLFSVTENKRFFLVLDDVQDDLRRLWGSLRSILAGAANGSVVLLTTRSEEDVYTFRATAHVSLKHLPLESMCRVFEHHAFGRQEKGSLESIGKKIVQNLHGVPLLAEAIGRLLRQNLDEGHWGKISRSHWWLYSEDDDSQNVALPSVTILCEHLSDHLRKRLCYCSIFPSGYLFKRNVLIQMWKANFMQQHDGIEMEKKENQWFDELFNRSFFQPTIWENKYIIPDMIKEPLYRIAEKECHAATDSRELKRSLQLYRHLAIDSSDFSVHLDLRKTNKWRTILFFDGHRTNKLQEALANVLCDPSALRLLDFSYSKAKLGKAPDFINKFTHLRFLDLSFTEITIIPGSLCKLRLLQVLGLRGCQLTELPRAMNKLVNLQFLYAEAQTVSLIYKIGQLTNLLGLEEFP

SEQ ID NO: 25397 - DNA, 772 bp, Panicum virgatum
  misc_feature: Ceres CLONE 1863428-R
tgtagtccaatctgtttccgtggattaaaatccttgttgcgcttaaggatacaccattgtttgggcagaattcatcttccatgcaatttgttgtcatcgcttgaggttttgaatcttcaaaaatgtgaggtttacttccagggaggtatagaccagatcatcaaattgaagaggattttaacaagtgatttttgtgaactgaacttggatgaattgaaagaaataaggaaagggcagttagttcctgaagtatttacattctgaaggtttccactgttgaccaccatgctttctcaaaaactgcaatgttgaagcatttcattaaaaaaaaaagaatcctggagcaccagtttcctagaatggtgataatacttctatggtgcatgttagaatgtcaggctgttgaactcaaaaggcagaacagctcattcaaacatgtcatataaaaaaaaagattcatccagagggagaaacgtctctgattttttgtcttgtagaagatttacctcaggttcaaaccatgccgttcataggggttccctgattttttctcttaaaaaagatttacctcagctttgaacccaggccagtcataggggtttcatcaacccccggagatcacccctcgcgcatcgagaacctttttgtaacatgtcatacatattgcttctataatggggaatagaaatattatgtcatatgtatagctcctattctgaactattttttgttatttctaaaaattcaatgtattccaagaaaagaaaagcag

SEQ ID NO: 25398 - DNA, 2317 bp, Panicum virgatum
  misc_feature: Ceres CLONE 1863451
  misc_feature: Encodes the peptide sequence at SEQ ID NO. 25399
gcgtgtacgcctctgcctccctccctccctctctctctctcttctctctctacacacacagcgcgcagcgctctctctctctagacatctttctctctgcgaaggcaccgtggagcggcgggatgccggcggcttggtggaagggcaggggccggtgcaagtcttccagcaaggccggcgccgcggcggccggagaaattaaggaggcggcggggaaggggaagaagaaggcgagcagcttcgacgaggcgctgctcgccacgggggcccgcgggaagcagcagcagccggcggcggcggtcgtcgggctcccgctcccgcggccggcgtccttgccgtcgccgctgccgtccgcgccggcctcgggctccgcctcggcgtccagcggcggcggcggcgggtcctcgctggggtcctcggcggcgtccgacgagcagctggatctcggggtttacaggttgtcagaaacaagttgcactcttcccggcagaacagtagcaatcgaatctcggaaacaaagtcatgtcgtagcagaagggcgtattttcacagataatcaggctttggagcatccccgattttctgaaacctcagtttcaccaaggaaagaaattcaccttcaaaatttggatcttgcaaatgatcgaactacgtattgtcgtggtcggaaatcaacagaaattgtgttcagtacacaagtgccaagctctcctcctagctcaagagcacatcactattcaacctccccagtgccaccaagaacgtttgggcaatgccaagcatctcctactgcatggcaggatgactcgcgaagctcaagctcaccacaaccccttccccttcctccaggctccccatgcttgccttcccgttctctacagtggaagaaggggaagttgctaggtagtggaacctttgggcaagtatatctgggattcaacagtgaaggcggacaaatgtgcgcaattaaagaggttaaggtcatttctgatgattctaactcaagagagtgtctcaggcagctaaatcaggaaattgtgctgctgagtcagctgtcacatccaaacattgtgcagtactatggcagtgatctgtctaatgagacactctcggtctatctcgagtatgtttctgggggctctatccataagttacttcaagaatatggtccattcggggagacagttcttcggagttacacagcacaaatcctttctggccttgcatacttgcatgggcggaatacagtgcacagggatatcaaaggggcaaacatactcgtcgatcctaatggtgatatcaaacttgccgacttcggtatggccaagcatatatctgcgtacacatccatcagatccttcaaagggagcccttactggatggcaccagaggtcattatgaatagtaatggctacagcctttcagttgatatttggagccttggctgcaccattcttgagatggcaacagcaaaacctccttggagtcagtacgaaggggtggctgcaatatttaagattgggaacagcaaagacatacctgatatcccagatcatctttcttccgaggcgaaaagctttctgaaactctgtttgcagcgtgatcctgctgcccgccctacagctgctcagctaatggatcatccctttgtcaaggaccatgctacatttcggagttccagatctggcatcacaatggatgtgtttcctacttcaaccgagggaaaaaacaccgtggcacagacaagcattgcaatttcatcatacagaagtttatctcctctaagaaatcctgataccgtgataaggagaaacttgccaggcccaacatcccccattccttcaacatcaaatcgcaggattgcagctataaacccgtccaatgtgaggatgaatatgtccctgcctgtttctccttgctctagcccgctacggcagtacaggcagtccaaccgaagttgcttgccatcgcctcctcacccagcctattcagctggagcagccaactacagtcctatcaacaatgcgctctatctaatgcgaccaagcagcggtcacacggacccatggctagaaatctctcagttgaaaacacaaacttttgattccccaagaagattgtagaggttccaaaaggaagtaatactttgtatacaggaaggaaagaagtgttccatagattatctttgttagaaaaaccaaggaactccttttttttcgccctttctgtatgtatctttcacacatgatgcagttgcatcgcctttgtacaaattcagagaagagctctagtgaaaaagaatagcaattcagatggc

SEQ ID NO: 25399 - protein, 666 aa, Panicum virgatum
  misc_feature: Ceres CLONE 1863451
  misc_feature (254)..(510): Pfam Name: Pkinase Pfam Description: Protein kinase domain
  misc_feature: SWISSPROT Homolog: EC 2.7.11.25 Mitogen-activated protein kinase kinase kinase
MPAAWWKGRGRCKSSSKAGAAAAGEIKEAAGKGKKKASSFDEALLATGARGKQQQPAAAVVGLPLPRPASLPSPLPSAPASGSASASSGGGGGSSLGSSAASDEQLDLGVYRLSETSCTLPGRTVAIESRKQSHVVAEGRIFTDNQALEHPRFSETSVSPRKEIHLQNLDLANDRTTYCRGRKSTEIVFSTQVPSSPPSSRAHHYSTSPVPPRTFGQCQASPTAWQDDSRSSSSPQPLPLPPGSPCLPSRSLQWKKGKLLGSGTFGQVYLGFNSEGGQMCAIKEVKVISDDSNSRECLRQLNQEIVLLSQLSHPNIVQYYGSDLSNETLSVYLEYVSGGSIHKLLQEYGPFGETVLRSYTAQILSGLAYLHGRNTVHRDIKGANILVDPNGDIKLADFGMAKHISAYTSIRSFKGSPYWMAPEVIMNSNGYSLSVDIWSLGCTILEMATAKPPWSQYEGVAAIFKIGNSKDIPDIPDHLSSEAKSFLKLCLQRDPAARPTAAQLMDHPFVKDHATFRSSRSGITMDVFPTSTEGKNTVAQTSIAISSYRSLSPLRNPDTVIRRNLPGPTSPIPSTSNRRIAAINPSNVRMNMSLPVSPCSSPLRQYRQSNRSCLPSPPHPAYSAGAANYSPINNALYLMRPSSGHTDPWLEISQLKTQTFDSPRRL

SEQ ID NO: 25400 - DNA, 968 bp, Panicum virgatum
  misc_feature: Ceres CLONE 1863458
  misc_feature: Encodes the peptide sequence at SEQ ID NO. 25401
gtgctccaacttgacctatcggccctggcctaggctcacagtcctagctagccaaaagaaattaaaacattctgctagctctccccctcagctgcagagcgcacacggctcctcttccctgcgtccgaaagaaccaggttcctcgccagctctagccggcaccccaaatcaaaccacggcgagctagccggccgaccatggcggcgctcggcggcggcggcggcggcggcggcggcgcgcaggcgccgttcccgtgggggctggtggtgctgtgcacggtggcggcgtggtgcgcggtgcgcgcggtggagtgggcgtggtggcggccgcggcgcctggcgcgggcgctgcggtcgcaggggctccgcggcacggcgtaccgctccctcgcgggggacgcgccgctgacggagcggctcaaccgggaggccaggtcccggcccatgccgctggggtgccacgacgtcgcgccccgggcgatgccgctgttccaccagaccatgaaggagcacggtaaaacgtccatcacctggttcgggccggtgccaagggtgaccatcaccaagcccgagctggtgcgcgaggtcctgtccaacaagttcggccacttcgagaagctcaagttcggcaggcttcagaggctgctccacaacggcctgggcagccacgagggcgagaaatgggccaagcaccggaggatcatcaaccccgcgttccatgtcgagaagctcaagcggatgctgccggctttcgccgcgtgctgcacggacctggtgaggaggtgggagggcctggctgcggacgggcagccgcacgaggtggacgtgtggcccgagatgcagaacctgacgggggatgtcatctctcgcgccgcgtttggcagcagctacctgggaagcaggaggatcttccagcttcagggggagcaggtcaagctcgtggttcaggccatgcagaagcttcacatc

SEQ ID NO: 25401 - protein, 256 aa, Panicum virgatum
  misc_feature: Ceres CLONE 1863458
  misc_feature: SWISSPROT Homolog: EC 1.3.3.9 Secologanin synthase
MAALGGGGGGGGGAQAPFPWGLVVLCTVAAWCAVRAVEWAWWRPRRLARALRSQGLRGTAYRSLAGDAPLTERLNREARSRPMPLGCHDVAPRAMPLFHQTMKEHGKTSITWFGPVPRVTITKPELVREVLSNKFGHFEKLKFGRLQRLLHNGLGSHEGEKWAKHRRIINPAFHVEKLKRMLPAFAACCTDLVRRWEGLAADGQPHEVDVWPEMQNLTGDVISRAAFGSSYLGSRRIFQLQGEQVKLVVQAMQKLH

SEQ ID NO: 25402 - DNA, 700 bp, Panicum virgatum
  misc_feature: Ceres CLONE 1863458-R
  misc_feature: Encodes the peptide sequence at SEQ ID NO. 25403
tcggtgctgctcacctggaccatgatcgtgctctccatgcacccggagtggcaggaccgcgccagggaggaggtgctccacgtcttcggccggaggacgccggactacgacggcatgggccgcctcaggatcgtgaccatggtgctgtacgaggtgctgcggctgtacacgccgctgacggcgctccagcggcagacgtacaagcccatggagctcggcggcgtgaggtacccggcgggggtgatgctgatgctgccgctgctgtgcgtccaccacgacaaggacgtgtggggccccgacgcgagcgagttcaggccgcagaggttcgcggaggggatctccatggcgtccgcggacgcgccggccttcttccccttcgggtggggcccgcgcacctgcatcggccagaacttcgcgctgctcgaggccaagatggggctcgccatgatcctgcagagcttcgtcttcgagctctcgccggcctacacgcacgcgcccttcccgcacggcctgctgcagccggagcacggcgcgcagatcatgctcaggaggctcccctagctgagctgcctacactacacttgtgtggagttagtcaaaatcgatcacttaattatctgcatgtacagcacatagtacgtatgtagcggatgcaaatcaagcaaggaactacacttgcaaggcaaggcgctcttcttgt

SEQ ID NO: 25403 - protein, 186 aa, Panicum virgatum
  misc_feature: Ceres CLONE 1863458-R
  misc_feature: SWISSPROT Homolog: EC 1.3.3.9 Secologanin synthase
  misc_feature: Useful for making plants with modulated cold sensitivity
  misc_feature: Useful for biocontainment applications
  misc_feature: Useful for making plants with modulated biomass
  misc_feature: Useful for making plants with modulated flowering time
  misc_feature: Useful for making plants with modulated nitrogen use efficiency
  misc_feature: The sequence is a functional homolog of SEQ ID NO 2 in US patent 7034205
SVLLTWTMIVLSMHPEWQDRAREEVLHVFGRRTPDYDGMGRLRIVTMVLYEVLRLYTPLTALQRQTYKPMELGGVRYPAGVMLMLPLLCVHHDKDVWGPDASEFRPQRFAEGISMASADAPAFFPFGWGPRTCIGQNFALLEAKMGLAMILQSFVFELSPAYTHAPFPHGLLQPEHGAQIMLRRLP

SEQ ID NO: 25404 - DNA, 1246 bp, Panicum virgatum
  misc_feature: Ceres CLONE 1863461
  misc_feature: Encodes the peptide sequence at SEQ ID NO. 25405
accgcacacccatcgcgtgacgcccccgctcggccgcttcctcttcttccgcgaagcagcggcccggggcagaagcaccccttacctccccaagcgcgtcgcgattcttttgccgggatccggcgcggatcgaatccgctgcccgcccagccaccgccgccgccgccgccgccgggtcctcccccgatcgggtccccctcccgttcgctccccgcgccccgcgcatttgatgagtatttctctccccgccccttggtggatgcgagggagttgcccgggctcgacccgccgactccaccccgatctccccgccgcctcgccgcccaccgccatcccctgctcccgccgcccgtccccggacccatgggctaggggccccccgtgcttcgccctcgcaccgtcgcccgcccgcggatcggctccttttgatgcgggtactgtgctgcgcttcccggcgacgcgagcgtgctgctgctgctgctctctggggatgtgaacgctgccctgggtggggatccagctcgcgctagattttcaccccttttttgcctttcacttttcgctcgctcggggagggtagagatagagagcgagatagaccgggttccccgggtgattaacgccaatcgccgagaaggattattccgccgtatgttctgatttccagttccgtgctgttaatgcaagtgctggggaggcaaagtggggattgtattgccggtttcggggacatattcttgggacattcccgccctgtgcaaagatatccccggctccgggtttaattagtttcatgttcgtagtggtggtggggagggcgcatatcacgcattccggttattccaggcagctggggagatgggttcctcgcaggagtccaccttctcgtcggcctcggccgctgcacaggtggatgcttccgcgctggacttgctcccggtctatgccaaggagcttatcgcaggcggcgctgctggtgcattcgcaaagactgcggtggcgccgctggagagagtcaagatcttattacagacgagaactgaaggtttccagtccctggggatcctccagtccttgaggaagctgtggcagtataagggagttcgaggcttctacaaagggaacggtgcaagtgtgcttcgcattgttccttacgcggcattgcattacatgacatacgagcagtataggtgctggatattgaacaatttcgcttcatcagtaggtacagggcccgtcgttgatc

SEQ ID NO: 25405 - protein, 129 aa, Panicum virgatum
  misc_feature: Ceres CLONE 1863461
  misc_feature (28)..(118): Pfam Name: Mito_carr Pfam Description: Mitochondrial carrier protein
MGSSQESTFSSASAAAQVDASALDLLPVYAKELIAGGAAGAFAKTAVAPLERVKILLQTRTEGFQSLGILQSLRKLWQYKGVRGFYKGNGASVLRIVPYAALHYMTYEQYRCWILNNFASSVGTGPVVD

SEQ ID NO: 25406 - DNA, 538 bp, Panicum virgatum
  misc_feature: Ceres CLONE 1863461-R
ccggaggcaaatgcaagttcagagcaagcagcctcaaaattcaagtgatggcttccgaataagaggaactttccagggtctctcgctcatcattaggtgccaaggatggagacagctctttgccggcttgagccttaactatgttaaggttgtcccttcggtagcaatcggtttcacaacatatgacatgatgaaggcattgctaggagttcctccccgagagagagtccatgcatcaggtgctagcaaatgaagcaatgttcagcttccttgtgttaggaccaatgagctcgaggaactccagtctgtggcgttatcgttcttgttatgaatcatatctttatgttgcataggatggaaatcattgtatattggtcgattggatctgtgcatgtaacattcttatgaattgctcataacatcaagtatggtacttgtaatttgtaaccgtaaatacagtgacaacaagagattgctgtacattaactatactagattggtaccatgattggagattctgatcaggattttttaaccc

SEQ ID NO: 25407 - DNA, 1307 bp, Panicum virgatum
  misc_feature: Ceres CLONE 1863475
  misc_feature: Encodes the peptide sequence at SEQ ID NO. 25408
tcttttcgccccctccaataattttcgcatcacctttcgtcacctcgcctcccacacgccccgcccgcgccctctgtcgtgttcccgcagcgtcccttcgtaggctcccctcttcgctatccgcctagatctcgccgggatccgcagcgtcttgcctggatttcgccttcggaacccgcggctccgtccaggtgaggagccaggaagggtccttctttcccgggtggcggcggatcggtgtttttgggaggcggtttggcggggtcgcgtcgcgtcacgtcacgttcgtggtgctggttgtggcgccgtcggcgaggtgtgatttggaggggatttgtggtctacggagctgagacacggcatgaacttcgacggggctgtggacagcagcggaactgatgatgatctcccaccatcatatcagaacagaggtatgaaaggcagtgggcgtaccactggtaatggaagagatactattggtgctggaccatatactagagttcaacaatctcagacagatatggaaacacaaatatatcaccttgagcaagaagcatattgttccgttctccgagcattcaaggctcagtctgaagctataacatgggaaaaggaaagtctcattactgagcttaggaaggagctacgcgtatctgacaaaaaacacagggagttgctaaacagagttaatagtgatgatatcatccgaaaaataagggaatggagagagtcatcaggtggccttcagatgaatttggttaataatgcacagcgtttgcatgaccccgtgcccagtcctaccacctcttctcgcaagaggcaaaagacgtctcaacccattccctctgcatctgtacctgcgccatctgctatgcactcacaggctttacctgcaccaatgcaaccatcatcttcagaagctaaaaaggcagctccacctgtcacaaaagtgaaaaagaccaaaccaggccagaagatacctggtggctctgcagtcaaatctatgccattttctgctggtcctagtgggcggggatcagttattaatagaaatacttctggccttccttctgaaggagcacaattaaatccgttaatcggccgtaaagtcatgactcggtggcctgatgataatagtttttatgaagctgtaataactgattatgatgctgcaaaggatctctatgcacttgtttatgacatgaatacagcacacgagacatgggagtgggttgattttaaggagatggcacctgaggatgtaagatgggaaggtgaggagcctgatttagaccttctaggtcgtg

SEQ ID NO: 25408 - protein, 315 aa, Panicum virgatum
  misc_feature: Ceres CLONE 1863475
  misc_feature (54)..(127): Pfam Name: ENT Pfam Description: ENT domain
MNFDGAVDSSGTDDDLPPSYQNRGMKGSGRTTGNGRDTIGAGPYTRVQQSQTDMETQIYHLEQEAYCSVLRAFKAQSEAITWEKESLITELRKELRVSDKKHRELLNRVNSDDIIRKIREWRESSGGLQMNLVNNAQRLHDPVPSPTTSSRKRQKTSQPIPSASVPAPSAMHSQALPAPMQPSSSEAKKAAPPVTKVKKTKPGQKIPGGSAVKSMPFSAGPSGRGSVINRNTSGLPSEGAQLNPLIGRKVMTRWPDDNSFYEAVITDYDAAKDLYALVYDMNTAHETWEWVDFKEMAPEDVRWEGEEPDLDLLGR

SEQ ID NO: 25409 - DNA, 641 bp, Panicum virgatum
  misc_feature: Ceres CLONE 1863475-R
ctaggtcgtggtgctcccgttcatggtgttaagaagtcaaccagtcgtgttggccccatgttaggtgccggaagaggtaggggcccccaaaagaattcatttaagaaagattatccacctacgcaaaatggtgttgggaagaagagttctgactacatagaaattcttcatacagagacactcataaaggaggtggagcgggttttcagtgctggcaaccctgacccccttgagatggagagggccaagaaggtgctgaaggagcatgaacaatcattaatcgatgcaattgcaaggcttgctgaggcgactgatgatggccatgcacggtcttcggagcacaaccattgttggaggaaccaacatggagtatgatatgcagatggcatggctatcgatggcctcatgtctggagatgcagatgccatgtgaaccctcaccaaaatgtacaccactccctcattagttttttttttgcctgttgtaagatctggatgctgattttattctagatttggcatgtccgtttgagctatagttttctgaaagctggctttggttttgctcccgaaaagctggttttctaaaaaactgagaccatttggcaagctatttgaacgtcatgtggggacgtggggtcc

SEQ ID NO: 25410 - DNA, 297 bp, Panicum virgatum
  misc_feature: Ceres CLONE 1863479
  misc_feature: Encodes the peptide sequence at SEQ ID NO. 25411
cactgatgcacaagttcaatcatacattaacagccagagcacattcttctcggattttgtgacgggcatgataaagatgggtgacatcacaccattaaccggctccaatgggcagatcaggaagaactgcagaaggataaactaataagaggtgctgcacactatctagcaagggttttcagtgtgatgtccttaagtttgtaatatgtctgctttcacaaaattgtgagatcatcatgttgtaccaaggtgttgagaaattgttcatttgaataattaatccatcatttgttcttt

SEQ ID NO: 25411 - protein, 47 aa, Panicum virgatum
  misc_feature: Ceres CLONE 1863479
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
  misc_feature: Useful for making plants with modulated light quality response
  misc_feature: Useful for making plants with modulated nitrogen use efficiency
TDAQVQSYINSQSTFFSDFVTGMIKMGDITPLTGSNGQIRKNCRRIN

SEQ ID NO: 25412 - DNA, 736 bp, Panicum virgatum
  misc_feature: Ceres CLONE 1863480
  misc_feature: Encodes the peptide sequence at SEQ ID NO. 25413
tcgtggaggatgaacaaaaagcatggaatgggcacaatggtttacgccaactctgatacttatgaaggcttctggaatgagggtttgccagagggatttggtaaatatacatgggctaatggtagcacctacattggaagctggaagtccggcaaaatgaatggcagaggagtgatgaagtggacaaatggtgatactcttgactgtaattggcttaacggactggctcatggaaaaggtttttgcaaatatgcatcaggagcatgttacattggtacatgggacaggggactcaaggatgggcatggtatgttttatcaaccaggaagtaaaattccctgtaaccttgaagtctctgagtgtgtaacagaccatgatgtttctagtgcttcaagttccggtaatgaaaatgtcaatagtggactcttgtttctgttgcaaaaactttgcaacacgtggagaatacgcaaccttttccatcaacccaggcgtatttcaaatggcactgcaccagtttttgatgataattctggaaatcacttgtcagaagattcatctactgaacctttgacaactggtgggtgtctccaagatagtggagttgataaagtattagtctatgagcgggaatatgtacaaggagtacttatctcggaaaagccaaaaggtcatgattctggaatgccggatagtggtaaaacacaggagcatacttgggcaaaaacaagctggtggg

SEQ ID NO: 25413 - protein, 245 aa, Panicum virgatum
  misc_feature: Ceres CLONE 1863480
  misc_feature (21)..(43): Pfam Name: MORN Pfam Description: MORN repeat
  misc_feature (44)..(66): Pfam Name: MORN Pfam Description: MORN repeat
  misc_feature: SWISSPROT Homolog: EC 2.7.1.68 1-phosphatidylinositol-4-phosphate 5-kinase
SWRMNKKHGMGTMVYANSDTYEGFWNEGLPEGFGKYTWANGSTYIGSWKSGKMNGRGVMKWTNGDTLDCNWLNGLAHGKGFCKYASGACYIGTWDRGLKDGHGMFYQPGSKIPCNLEVSECVTDHDVSSASSSGNENVNSGLLFLLQKLCNTWRIRNLFHQPRRISNGTAPVFDDNSGNHLSEDSSTEPLTTGGCLQDSGVDKVLVYEREYVQGVLISEKPKGHDSGMPDSGKTQEHTWAKTSWW

SEQ ID NO: 25414 - DNA, 2027 bp, Panicum virgatum
  misc_feature: Ceres CLONE 1863481
  misc_feature: Encodes the peptide sequence at SEQ ID NO. 25415
gaaatagcctgcgggcctctaggccgtgggcagccgcaaacagtgtgccgcgcagcaaacgatacgcccgcggcggcaccaaaaaaaaaaaatccgcgggctcccgaaaccaagccgcgaattgcgatcccagggacaaattcaaaaatcacggcagaaataaagattcgaagcagcaaccgctggcagcagaaccaaacccgcacgcggcggagcagcagggctggcggaggcgggaagcgcacgaccgggctcgacccttgcccagtttcccgcctccgccttacccgcgctcacgcggcgacgggcgggtccgtttcccgccgccgcggcccgccggcgatgcggcgacgctggctctccgccgacggcgtcctcgctctgctccatctgcttgactgcttcttgtcgattcaggaacttgtatgggaaaggtggcaaggaccaaggtggtgcagcctccagccgggatggagagcgaggtagagagacaaatgggggaccttatcctatgcaatcgcatgtgctttctgagcttctgttccgattaatttattcccatcggatacccctgttattttctccttggtcgtcacgcccaaaagaggaagtttgatgaatatactccagactccaagaagagcccagatggggacatcatagactgcgtgcccatcacccaccagccagcgtttgatcatccttacctcaagaaccacactgtccagatgagaccgaactatcaccccgaaggcctgtatgacgaatccaagaccaatgtggcctccaccagcagtggcgagaagcctaaggttcagctctggcatcagaatggcaggtgtccggaaggcaccgtccccatcaggagaacgaagaaggacgacctgctcagggcaagctcaatgcggaggtacggcaggaaacggcacaccaccgcgaacccaatgtcggtcaatcccaccatgctcaatgagggtggccatcaggtacctcatgccatagcgtacgttcaaggcgacaagtactacggcgccaaggcgaccatcaatgtctgggagcccaagatcgagcagcctaatgagttcagcttgtcccagctctggatcttaggggggtcatttggggaggatcttaacagcatcgaggctggatggcaggttagtccggacctgtatggggacaacaacacgaggctgttcacctactggaccagtgatgcataccaagcaacagggtgctacaacatgttgtgctccgggttcgttcagattaacagcgagattgccatgggtgccagcatcttcccaacctcaagctactctggctcccaatatgatatcagtatactgatctggaaggacccaaaggagggcaactggtggatgcagttcggcaaggactacgtgctgggctactggccgtcgttcctcttctcatacctggcggacagcgcgtcgatgatcgagtggggcggggaggtggtgaactcgcagcctgatggcgtgcacacgtcgacgcagatgggcagcgggcacttcccggaggaagggttcagcaaggcgagctactgcaagaacatccaggtggtggacagcaccaacaacctcaaggtccccaaggggctgggcaccttcaccgagcagtccaactgctacgacgtgcagaacggcaacaatggcgactggggcacctacttctactatggcggccctgggaggagctccaactgccagtaactccgaaatcgtaacaaccattggaatgtaatacaccgcctgcaagcctcagttttctccttagtcctagatcaatagtgtgtcatgtgaatggggttgttttgtggtggtttgtagtagtttctctctgttgagtttcttctctctcttttcttttcttctattgttactgccaggaaggcttctgaagagaagcaatggcatgtggtggtgatgcgttgcccttatggtctccttttcctatatggtagattcacttgtccttgtgattatgggctgtttttttttctt

SEQ ID NO: 25415 - protein, 335 aa, Panicum virgatum
  misc_feature: Ceres CLONE 1863481
  misc_feature: Useful for biocontainment applications
MRPNYHPEGLYDESKTNVASTSSGEKPKVQLWHQNGRCPEGTVPIRRTKKDDLLRASSMRRYGRKRHTTANPMSVNPTMLNEGGHQVPHAIAYVQGDKYYGAKATINVWEPKIEQPNEFSLSQLWILGGSFGEDLNSIEAGWQVSPDLYGDNNTRLFTYWTSDAYQATGCYNMLCSGFVQINSEIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYCKNIQVVDSTNNLKVPKGLGTFTEQSNCYDVQNGNNGDWGTYFYYGGPGRSSNCQ

SEQ ID NO: 25416 - DNA, 480 bp, Panicum virgatum
  misc_feature: Ceres CLONE 1863489
  misc_feature: Encodes the peptide sequence at SEQ ID NO. 25417
  misc_feature (173)..(173): n is a, c, t, g, unknown, or other
gcgccccgagccgggaccgccaggcggggcaccgccgccgggcccgggcgcgccgaccgcccccaggcccagagggcgcgcgcccccgcccgcccccgcaggccgaggcaccggggacccgaccgggcgggggagaaccagcacgagggcaacccccacgcccagcagcggcncgccgccggccccccgcaggccggcgaccagttttttttcaacgaggaccgcaccgtcgtcgtcgtggccaatggggagatctacaaccacaagaagatccggaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgac

SEQ ID NO: 25417 - protein, 159 aa, Panicum virgatum
  misc_feature: Ceres CLONE 1863489
  misc_feature (10)..(151): Pfam Name: GATase_2 Pfam Description: Glutamine amidotransferases class-II
  misc_feature: SWISSPROT Homolog: EC 6.3.5.4 Asparagine synthase (glutamine-hydrolyzing)
  misc_feature (58)..(58): Xaa is any aa, unknown, or other
APRAGTARRGTAAGPGRADRPQAQRARAPARPRRPRHRGPDRAGENQHEGNPHAQQRXAAGPPQAGDQFFFNEDRTVVVVANGEIYNHKKIRKQFTGKHTFTTGSDCEVIIPLYEEYGENFVDMLDGVFAFVLYDTRNKTYMAARDAIGVNPLYIGWGG

SEQ ID NO: 25418 - DNA, 670 bp, Panicum virgatum
  misc_feature: Ceres CLONE 1863493
  misc_feature: Encodes the peptide sequence at SEQ ID NO. 25419
gttggcgccgccaattcattcaaggtttatcgaatccgatcgctcgcgttatcttcctcggccggccttgtcagttccatcccgctgctcccgccccaccccagcagtcttgtcttcccccgcacgcctcctcgcctccgcctcccccggcctccgatctccagggctccgcgccggcggcggcagggatggcggctccggtggtggacgccgagtacctgcgccaggtcgacagggcgcgccgccagctccgcgccctcatctccaacaagggatgcgccccaatcatgctccgcctcgcatggcatgatgctggaacttatgatgtgaaaacaaaaactggtggcgcaaatggttcgattagatttgaggaagagtacacccatggttctaatgctggtttaaagattgctatcgatcttcttgagcctatcaaagccaagaacccaaagataacatacgcagacctttatcagcttgctggagtggttgcagttgaagtgactggtgggccaactgttgagtttgttcctggccgacgcgattcatcagtctgcccccgtgaagggcgtctaccagatgctaagaaaggtacgttctagtattgtttcttgtgcttttcattgttttttgatcatttgatttggatgctattggtaagtatcaatcg

SEQ ID NO: 25419 - protein, 137 aa, Panicum virgatum
  misc_feature: Ceres CLONE 1863493
  misc_feature (17)..(136): Pfam Name: peroxidase Pfam Description: Peroxidase
  misc_feature: SWISSPROT Homolog: EC 1.11.1.11 L-ascorbate peroxidase
  misc_feature: Useful for making plants with altered carbohydrate content
  misc_feature: Useful for making plants with altered cell wall content and/or composition
  misc_feature: Useful for making plants with modulated heat sensitivity
  misc_feature: Useful for making plants with modulated water use efficiency
MAAPVVDAEYLRQVDRARRQLRALISNKGCAPIMLRLAWHDAGTYDVKTKTGGANGSIRFEEEYTHGSNAGLKIAIDLLEPIKAKNPKITYADLYQLAGVVAVEVTGGPTVEFVPGRRDSSVCPREGRLPDAKKGTF

SEQ ID NO: 25420 - DNA, 2037 bp, Panicum virgatum
  misc_feature: Ceres CLONE 1863502
  misc_feature: Encodes the peptide sequence at SEQ ID NO. 25421
gcgagagcccccagctgctctgctcccgagcgaagccgagggccgagggaggaggccggccgcggcaccacgcgcacgcggccttcgccgcgaccccctccccgttatcccctcccctaccatgcgcgaggccctcccgtcggaccccgagctcccgtgcctcccgacccgagatggcgagccgcgacaaggtcgggtgctccccggccgcgctgcccctcgaccgcgtccaggccgagctggcggccaaagccgagcagctcgggaggcggtgggaggccgcgcttcgcggccggtgcgggaagcgggacgggccggcggtcgggagggcggaggggagagcgcaggccatagagatgcacacgccgctgttctacgtcacctgcgcactcggcgggaccctcagcaccggcctcacccacctcgcggtcacgccgctcgacctcgtcaagtgcaacatgcaggtggatcctagcaagtacagggacattccgtctgcctttggcgtcatgctccaagagcaaggcctcggtgggttcttcaagggctggatggccacgctggttgggtacagctgccagggggcctgcaagtttgggttctacgagttcttcaagaagtgctactccaacattgctggtcccgagaatgctgaacggctcaagacattgatctaccttgcagcttcagcgtctgctgaggtgattgcagatgtagctctctgccccatggaggctgtcaagattcgagtccagacgcagccgggatttgctcggtgcctgatcgatgggcttcccaagattgtccaatctgaaggtgcctttgggctttacaaaggactgcttcctctttggggccgtcaagttccctacactatgatgaaatttgcttgctttgaaaccattgtcgagatggtctacaagcatgcggtgccaaagccgaaggatcaatgcagtaagccactccagctagcagtaagctttgcaggggggtatattgctggagtcttctgtgctgctatatctcatcctgcagataacctggtgtctttcctcaacaatgcaaaaggagccacagtggcagatgttgtaagaactcttggaatgtggggccttttcacgcgcggccttcctcttcgtattattatggttggtgctctcacaggagcacaatgggcaacatatgatgcgtttaaagtctttgttggattgccaacatctggtggagggagttctagttgtgctgctgccttccctttgcaccaagtgggtcatgaaaagcacaactgaccgctttgagaagatattgcgctgargtatctggtaccgaagactgaagtagatgagttgtgtgatttcgctcagattttcactagagtttgaagatcagaactaagttttagatggtagagcattctctttcaagggacttttcttccaaacctcttgactgacataacactgtagtgatcatacatcctttagaaatgcatttggccaattgccaagctgatctaatgtttgccggcctggtgcccagtctcgattaatcagggtaagaacacctgcttgtgcacttgctactcgtgattatggttatgcaggaagttaagcctgctgcttattttggaggggaagtgggggcattcaatccagtctgaaattttccttgtaccttaagtctctgttgtttattttggaggggaaagtggaggaattcaatctaattggaagaatcctatgcacggtgtacctaaaaagaaattttggtggccaaaagattcctccacattttcgagcggcatgagatcttaccacatgtttccaattacttcaaaaagtttcatgcgtctatggacccaaagattgtgagtagcacatgccttggcgggtctgaggacagcgtgtgcaactaatgctgatccaaatgtcagtttggctgaatgtaatgatctgatggtttaatggaattctcgtcccaaaagacaagttgcatgcacctttcctattgtgtaaatggtaacagtggttctcttct

SEQ ID NO: 25421 - protein, 371 aa, Panicum virgatum
  misc_feature: Ceres CLONE 1863502
  misc_feature (164)..(252): Pfam Name: Mito_carr Pfam Description: Mitochondrial carrier protein
  misc_feature (67)..(155): Pfam Name: Mito_carr Pfam Description: Mitochondrial carrier protein
MASRDKVGCSPAALPLDRVQAELAAKAEQLGRRWEAALRGRCGKRDGPAVGRAEGRAQAIEMHTPLFYVTCALGGTLSTGLTHLAVTPLDLVKCNMQVDPSKYRDIPSAFGVMLQEQGLGGFFKGWMATLVGYSCQGACKFGFYEFFKKCYSNIAGPENAERLKTLIYLAASASAEVIADVALCPMEAVKIRVQTQPGFARCLIDGLPKIVQSEGAFGLYKGLLPLWGRQVPYTMMKFACFETIVEMVYKHAVPKPKDQCSKPLQLAVSFAGGYIAGVFCAAISHPADNLVSFLNNAKGATVADVVRTLGMWGLFTRGLPLRIIMVGALTGAQWATYDAFKVFVGLPTSGGGSSSCAAAFPLHQVGHEKHN

SEQ ID NO: 25422 - DNA, 680 bp, Panicum virgatum
  misc_feature: Ceres CLONE 1863508
  misc_feature: Encodes the peptide sequence at SEQ ID NO. 25423
aagagagaaacgcacgcacccgagagagcgagcagagacacaagagcggccgcgcggcggcatcccgatctcgccatccccccgatgcgatctcgccaaaccctaatcccccgccccgccacgcggctcgcgccggagccctagccccgaatgcggcggtgacgcgcgcggggtagtgtcgcccgcgagcgagcgggcgcgcggccggcccatcctgcccgccgcgatgggcgccgccgacaagtggctgctcccactcgtctccgtctccttcgtctcgctcctgctcttcctctccgcgctctcgggcttctccgcctcctcctcgctcttcgcgcgcctcccgccgccctcctacgtgcgccggggcgccgccgcgccgccctccttcgcgtacctgctggccggcggccgcggggacggcaggaagctcctgcggctgctcctcgcggtctaccaccccaggaaccgctacctgctccacctctccgccgacgcgccggcctccgagcgcgccgagctcgccgcggccgtcgcgcgcgccgcccccgccgtgcgcgccttcgggaacgtcgacgtcgtcggcaggcccaccgccggcacgcccatggggtcctccggcctcgccggcacgctccgcgccgccgccgcgatgctccggctggatgcggagtgagact

SEQ ID NO: 25423 - protein, 149 aa, Panicum virgatum
  misc_feature: Ceres CLONE 1863508
  misc_feature: Useful for making plants with altered carbohydrate content
MGAADKWLLPLVSVSFVSLLLFLSALSGFSASSSLFARLPPPSYVRRGAAAPPSFAYLLAGGRGDGRKLLRLLLAVYHPRNRYLLHLSADAPASERAELAAAVARAAPAVRAFGNVDVVGRPTAGTPMGSSGLAGTLRAAAAMLRLDAE

SEQ ID NO: 25424 - DNA, 2244 bp, Panicum virgatum
  misc_feature: Ceres CLONE 1863523
  misc_feature: Encodes the peptide sequence at SEQ ID NO. 25425
caccacactcctgcagtgctgcgcggcgcatgccgaggagagcacgctcttaggcaggggcactccccactgggagcggcggcagtcggcaggagccggagcgagaggcaggcagggcagggcaggcgccagcgccatgggggtccgcttggcggcgacgaagctgcacatcccgccctcggccgcgcggcgccccaccttcctgccgttcgtcgccgtcctcctcctctgctccgcctcctacctcctcggcgtctggcagcacggcggcttcgcctccccgtccgagtcccccgccgtctccatcgccaccgccgtcgcctgcaccaccaccgccgccgccgccacggggaagaaggccccgtccgcccgcgccaggccccgctcctccccctcccagccatcccgggccctcgacttctccgcgcaccacgcggcggccacggacgaggcgctcgcctcctcctcctcctcctccggctcctcctcctcgtcgtcggcgtcgccgcggaggtaccccgcgtgccccgtcaagtactccgagtacaccccgtgcgaggacgtggagcggtcgctgcggtacccgcgggagcggctggtgtaccgggagcgccactgcccggcgtcggagcgggagcggctgcggtgcctcgtcccggcgccgcgcgggtaccgggtcccgttcccgtggcccgccagccgcgacgtcgcctggttcgccaacgtgccgcacaaggagctcaccgtcgagaaggcggtgcagaactggatccgcgtcgacggcgacaagctcaggttccccggcggcggcaccatgttccccaacggcgccgacgcctacatcgacgacattgccaagatcgtcccgctccacgacggctccatccgcaccgcgctcgacaccggatgcggggtggcgagctggggcgcgtacctgctgtcgcgggacatcctggccatgtcgttcgcgccgcgggactctcacgaggcgcaggtgcagttcgcgctggagcgcggcgtgccggccatgatcggcgtcctcgcgtccaaccgcctcacctacccggcgcgcgccttcgacatggcgcactgctcccgctgtctcatcccctggcaactgtacgatggactgtacctcatcgaggttgaccgcgtgctgcggccgggagggtactggatcctgtccggcccgccgatcaactggaggaagtactggaaggggtgggagcggaccaaggaggacctcaacgccgagcagcaggccatcgaggccgtcgccaggagcctctgctggaccaagctcaaggaggccggcgacatcgccgtctggcagaagccctacaaccacgccggctgcaaggcctcccgcaaggcggcgcccaagtccccgcctttctgctccggcaagaaccccgacgcggcatggtacgacaagatggaggcctgcatcacgccgctcccggaggtctccggcgcgaacgacgtcgcgggcggcgcggtgaagaagtggccgcagcggctcacggcggtgccgcccagggtgtcccgcggcttcgtcaggggcgtcacggccaagtcgttcgcgcaggacacggagctgtggcggaggagggtccggcactacaagtcggtggtcagccagttcgagcagaagggccggtaccgcaacgtgctggacatgaacgcgcgcctcggcggcttcgccgcggcgctggcggcggcgggcaaccccctgtgggtcatgaacatggtcccgacgctgggaaacacgaccacgctcggggccatctacgagcgcggcctcatcgggagctaccaggactggtgcgagggcatgtccacctacccgaggacctacgatctcatccacgcggactcggtgttcaccctgtacaagaacaggtgtgagatggacaggattctgctggagatggacaggatcctgaggccccggggcacggtgatcatcagggacgacgtggacatgctggtgaaggtcaagagcgtagcggacgggatgaggtgggacagccagatcgtcgaccacgaggacggcccgctcgtcagggagaagatcctcctggttgtgaagaagtactggactgcccaggaccaagaccagtagcagcaggaacgtgaagtgaactcctgtatgttgataagcacatttttcgtcgttgggtcgccatttctagctcctttgagctagtgtttttttcttctttacgttcttatatgctgttc

SEQ ID NO: 25425 - protein, 662 aa, Panicum virgatum
  misc_feature: Ceres CLONE 1863523
  misc_feature: The sequence is a functional homolog of SEQ ID NO 1593 in the 11/479,226 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: Useful for making plants with altered cell wall content and/or composition
  misc_feature: The sequence is a functional homolog of SEQ ID NO 560 in the 10/412,699 US patent application
MGVRLAATKLHIPPSAARRPTFLPFVAVLLLCSASYLLGVWQHGGFASPSESPAVSIATAVACTTTAAAATGKKAPSARARPRSSPSQPSRALDFSAHHAAATDEALASSSSSSGSSSSSSASPRRYPACPVKYSEYTPCEDVERSLRYPRERLVYRERHCPASERERLRCLVPAPRGYRVPFPWPASRDVAWFANVPHKELTVEKAVQNWIRVDGDKLRFPGGGTMFPNGADAYIDDIAKIVPLHDGSIRTALDTGCGVASWGAYLLSRDILAMSFAPRDSHEAQVQFALERGVPAMIGVLASNRLTYPARAFDMAHCSRCLIPWQLYDGLYLIEVDRVLRPGGYWILSGPPINWRKYWKGWERTKEDLNAEQQAIEAVARSLCWTKLKEAGDIAVWQKPYNHAGCKASRKAAPKSPPFCSGKNPDAAWYDKMEACITPLPEVSGANDVAGGAVKKWPQRLTAVPPRVSRGFVRGVTAKSFAQDTELWRRRVRHYKSVVSQFEQKGRYRNVLDMNARLGGFAAALAAAGNPLWVMNMVPTLGNTTTLGAIYERGLIGSYQDWCEGMSTYPRTYDLIHADSVFTLYKNRCEMDRILLEMDRILRPRGTVIIRDDVDMLVKVKSVADGMRWDSQIVDHEDGPLVREKILLVVKKYWTAQDQDQ

SEQ ID NO: 25426 - DNA, 591 bp, Panicum virgatum
  misc_feature: Ceres CLONE 1863526
  misc_feature: Encodes the peptide sequence at SEQ ID NO. 25427
ctgcaccgaccccgtcgtgctctcctgcgccctcctctgcctcctcctccacctcgcgctccgctcctcctccggccgcggcggcggccgccgcctcccgccggggcctcctggcctcccgatcctcggcgcgctcccgctcgtcggcccggccccgcacgccgggctcgccgcgctggcgcgccggtacggccctatcatgtacctgaagatgggcacggccggcgtggtggtggcgtcgtcccccgccgcggcgcgcacgttcctcaaggcgctggacgcgcggtacgccaaccgccccgccgtggcgagcgccgcggacatcacgtacgggtgccagaacatggtgttcgccaactacgggccccggtggaagctgatgcggaagctggccagcgtgcacctgctcggggcgcgcgcgctcgcggactgggcgggggtgcgccgcgacgaggccgggcacctgctgcgcggggtggcggaggcggcggccgccgggcggcccgtcgtcgtgccggaggtgctcgtgtgcgcgctcgccaacatcgtcgggcagatcaccgtcagcaggcgggtgttcgacgcgcaggc

SEQ ID NO: 25427 - protein, 196 aa, Panicum virgatum
  misc_feature: Ceres CLONE 1863526
  misc_feature: SWISSPROT Homolog: EC 1.14.13.88 Flavonoid 3',5'-hydroxylase
CTDPVVLSCALLCLLLHLALRSSSGRGGGRRLPPGPPGLPILGALPLVGPAPHAGLAALARRYGPIMYLKMGTAGVVVASSPAAARTFLKALDARYANRPAVASAADITYGCQNMVFANYGPRWKLMRKLASVHLLGARALADWAGVRRDEAGHLLRGVAEAAAAGRPVVVPEVLVCALANIVGQITVSRRVFDAQ

SEQ ID NO: 25428 - DNA, 581 bp, Panicum virgatum
  misc_feature: Ceres CLONE 1863544
  misc_feature: Encodes the peptide sequence at SEQ ID NO. 25429
tgtggtgcgaccgggtcggatctgagaccattccgctcaacttattacgatcccttccaatccccgggcttcctcctcctctccccccgccggatcggatcggatccgccgaccaccccccgccgccgccgccacaaaaacggcatcaccacatcagataacaggggcgcgcttgacaccttacgcttcagcgcggagtctgtgaacgagggaaaccgtgacaaggtctgcgatcaggtctcacatgccggggtcgatgctggccttgctgaggaccatgacggcaaggttgcttgctagacttgcatctagactagcatggccgaggtctttggtgagatcaccaccaaggccaatgtcgactacgaaaaaattgatgcggagacttgcctcaacgttggtttaggggcagcagatgtcgggtttgatgcagaccactgcctggtgctagtgaacattgaacactaataccctgatattgctcctggtgtgcatggtcacttcacaaagcgccctgaagagattggagctggggaccaccgacacatgtttgggtatgcgactgatgacactcctgagct

SEQ ID NO: 25429 - protein, 49 aa, Panicum virgatum
  misc_feature: Ceres CLONE 1863544
  misc_feature: SWISSPROT Homolog: EC 2.5.1.6 Methionine adenosyltransferase
MAEVFGEITTKANVDYEKIDAETCLNVGLGAADVGFDADHCLVLVNIEH

SEQ ID NO: 25430 - DNA, 356 bp, Panicum virgatum
  misc_feature: Ceres CLONE 1863551
  misc_feature: Encodes the peptide sequence at SEQ ID NO. 25431
aattttccgcgctgcgcttgtagacatctatccagcagaacgcagcaggatggtgtacgcgctcctgctggtcgccttggcggccgtcccccgcccagggggggctccccctctaccccccggtgctccgggggggtccccaaaggggagtctcggtgggccccctctacggaaaaaatatggtttccttcctccacacgcacccatccaacaccgccggctgcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgc

SEQ ID NO: 25431 - protein, 58 aa, Panicum virgatum
  misc_feature: Ceres CLONE 1863551
  misc_feature: SWISSPROT Homolog: EC 1.14.13.77 Taxane 13-alpha-hydroxylase
  misc_feature: Useful for making plants with modulated oxidative stress sensitivity
MVSFLHTHPSNTAGCFLKEHVARYGTVFKSHLFGSPAVVSCDEELNHFVLHNEERLFE

SEQ ID NO: 25432 - DNA, 2308 bp, Panicum virgatum
  misc_feature: Ceres CLONE 1863554
  misc_feature: Encodes the peptide sequence at SEQ ID NO. 25433
taaaggtttaactacccatgctgattctcatgacatcagagtgtcagaaacggagagcgtggtttctaataatatttgtgcagaacaaacaaagtctggatttgaggaaagtagtgatcgggcaatggcctcagctgagtggaaccgccagaaggaagctgagcttaatcagatgttattgaaaatgatggaggtcatgcctggaaagtttccaggtgctaatgcaactgctgctggcttcgattccaccaatcagaagaaaggtgttactcatggtcagcataaagagaagcgagacacaaaggttccagctgagaaaggcaaaaggcggcctacaaaagaggtgagctccaagcccttgaaggatacagttgggcagaagaagtcagcagtgacccccaaaactggcactgtaacagagaaacgcatttcaccagttccacaaaaggcacggcgaaattcatcacctccagtcctacccaaagaagttgcttcaaagacaccagtcagaaaaagctcaccaaaaccattaccttcacctgcacctgcgcctgctacacgtagttcatggtcaggaggttctttgactaaagcaactacaactcaaagaactaaaagctctcctgggatggcttcgacatctataccaactagccgaaggaggactccgacaacacatccgtcatctcagcctgcttcaaaagtggaaagaaccattcaaccagtgaagaacaagaaggaaactgtgtctgctatgaagccagctatcaagggacaagaagagaagaagccaaaaacagcagcaaagacaagtagaataactaaagtttcaccttcgtcagaagaaaaatcaagtgtaacaactaaggaaagcttgcgtaaggtttcaaagaaaagcagtgttgtaccactggagtccaaacccttgaagaaagccactgggattagtcaaattgttggttctggtacagtgaagaaaaaggtgccccaacttgatgagtcctataaagatagtggaagtgttaatcaagctgaagataaggagcaatctcctatgacaaccgagccaactactaaggtactggaggctgatcttgctcaaccagcacatgatgttgatgaaaatttagaaatttcgctcgataatgacttgaatattgaaaaaacagagaaaccggcctcgagtttaactgctacagaaatgggctccagtgaccaggttgagccctctaccaatgaggcagatgaggccatacaacttccggatgaggacatgggtatctcatcagctgcctgggtagaagtagagcatcaagaacaagaagtcactgaccctagtgaaaatgtagtggctgaggatgtgacttccccaggaattgcaccattgccatcatcaagcccaagaatccgtcattccttgtcacaaatgctgcaagcagatagcaatgaaccagaaattattgagtgggaaaatgctgaaaacccaccagcaatagtttttcaaaaggattctccaaaaggactcaagagacttctaaagtttgctcggaaaaataagggagacaacaacactaatggctgggcaagcccatcagtagtttctgaaggagaagatgaactagaagaatcaagaggcactagtgatggtgcaaatttgagccggagaacttttgatggttcaaagactaatagcatcttatcagctcaatcaaccattggcagcttcaactctatgaactcagataagcaacgggagaggcctggagctgccgcatcagcaaaagcatcaaggtcgttcttctccctctcaaacttccggagcagcagatcgaatgattcgaagcttcgatagcatatatgccttttgccctgcagatacatggatagttttcatcccaactccgttcaggatgcctaatagatgtaaaaagagaatggtttgcgatttgattgttgggacggtgccagcttgctgtgttgggctctggtcgcctgccatttgatatagcttccgcctatgagttgtcatactttgcttcagcttttctgtaaatttcttttacagtggttacgagctgattgagatgaccgatatgtttgcatggctcgtaagagacctgcttctaccaaaatcgttttggtttacccgtagttggtaccgggagctgatgtaaatttgtgttcgtatagccgcctactccaacttgtttgggaaaaaggctatgttgttgttgtatagcggcctgtgatgcgcccggccgtggcaaacccatagaaattctcaaactatcggaaactctgcaggtgc

SEQ ID NO: 25433 - protein, 616 aa, Panicum virgatum
  misc_feature: Ceres CLONE 1863554
  misc_feature: SWISSPROT Homolog: EC 3.4.21.72 IgA-specific serine endopeptidase
KGLTTHADSHDIRVSETESVVSNNICAEQTKSGFEESSDRAMASAEWNRQKEAELNQMLLKMMEVMPGKFPGANATAAGFDSTNQKKGVTHGQHKEKRDTKVPAEKGKRRPTKEVSSKPLKDTVGQKKSAVTPKTGTVTEKRISPVPQKARRNSSPPVLPKEVASKTPVRKSSPKPLPSPAPAPATRSSWSGGSLTKATTTQRTKSSPGMASTSIPTSRRRTPTTHPSSQPASKVERTIQPVKNKKETVSAMKPAIKGQEEKKPKTAAKTSRITKVSPSSEEKSSVTTKESLRKVSKKSSVVPLESKPLKKATGISQIVGSGTVKKKVPQLDESYKDSGSVNQAEDKEQSPMTTEPTTKVLEADLAQPAHDVDENLEISLDNDLNIEKTEKPASSLTATEMGSSDQVEPSTNEADEAIQLPDEDMGISSAAWVEVEHQEQEVTDPSENVVAEDVTSPGIAPLPSSSPRIRHSLSQMLQADSNEPEIIEWENAENPPAIVFQKDSPKGLKRLLKFARKNKGDNNTNGWASPSVVSEGEDELEESRGTSDGANLSRRTFDGSKTNSILSAQSTIGSFNSMNSDKQRERPGAAASAKASRSFFSLSNFRSSRSNDSKLR

SEQ ID NO: 25434 - DNA, 651 bp, Panicum virgatum
  misc_feature: Ceres CLONE 1863564
  misc_feature: Encodes the peptide sequence at SEQ ID NO. 25435
taatccgccgcttttcccctccccctttccccctcctcccccattcaagaagagaagcgaaccacctctctcccagtctccctcggggacgggacgggacgggacgggacgggacggacgccatggacgcctgggaggccaccaaggtggtgttcgaccgggtgcgcgcgctggacccggagaacgcctccaagatcatgggcctgctcctcatccaggacaacagcgtcaaggacctgatccgcctcgccttcggccccgagcacctgctcctcgccgtcgtcgcccgcgcgcgcgccgacctcgccgccaagcccgcgtccccgccgtcgcccgggctcggccagccgtgggggctcccgagccctagaggaggaggcgaccacctggcgccgttcggcgccgaccaggcggcgttcgacggcggtgccgacgcgttctaccctgaggagtacgagtgctggtcgccggcggccggcggccaccgccgcagcttctcgctgagcgacgacgaagtggccgcggccggcgcgtggaggccctgcatgtacttcgcacgcgggttctgcaagaacggctcctcctgccggttcttgcacggcctgcctgacgacgacgcggtggccgcggagcgggagatggtcgtcatgc

SEQ ID NO: 25435 - protein, 176 aa, Panicum virgatum
  misc_feature: Ceres CLONE 1863564
  misc_feature (136)..(161): Pfam Name: zf-CCCH Pfam Description: Zinc finger C-x8-C-x5-C-x3-H type (and similar)
MDAWEATKVVFDRVRALDPENASKIMGLLLIQDNSVKDLIRLAFGPEHLLLAVVARARADLAAKPASPPSPGLGQPWGLPSPRGGGDHLAPFGADQAAFDGGADAFYPEEYECWSPAAGGHRRSFSLSDDEVAAAGAWRPCMYFARGFCKNGSSCRFLHGLPDDDAVAAEREMVVM

SEQ ID NO: 25436 - DNA, 796 bp, Panicum virgatum
  misc_feature: Ceres CLONE 1863565-R
  misc_feature: Encodes the peptide sequence at SEQ ID NO. 25437
tgctggcaagcagctcgaggatggccgtaccctcgctgactacaatatccagaaggagtcgaccctccaccttgtgcttaggctcaggggtggaatgcagatcttcgtcaagactctcactggcaagaccatcactcttgaggtcgagtcatcggacacgattgacaatgtgaaggccaagatccaggacaaggagggcattcccccggaccagcagcgtctgatctttgctggcaagcagctggaggatggccgcacccttgctgactacaacattcagaaggaatccacccttcaccttgtgctcaggctcaggggtggtatgcagatctttgtgaagaccctcaccggcaagaccattaccctggaagttgagtcgtctgacactatcgacaatgtgaaggcgaagatccaggacaaggagggcatccccccggatcagcagcgtctgatttttgctggtaagcagctggaggatggccgcaccctggcggactacaacatccagaaggagtccaccctccacctggtgctccgcctccgtggtggccagtaagttctgagggccatggagatgctgctgtccctgggttcacaaatctggtgcctcctttgtcgctcctatggaggttgtctccgtgtaccgtggtctgtgtcctggtctagtggtgcgggtgtctttggcctgtcctgatgcaaagtcctatgtcgtctggttgtgtgtgaacatttcctgctgtgcagcaacttggttgaattgtgatgaataataagtgaaccctgaactttgtgtggc

SEQ ID NO: 25437 - protein, 184 aa, Panicum virgatum
  misc_feature: Ceres CLONE 1863565-R
  misc_feature (37)..(105): Pfam Name: ubiquitin Pfam Description: Ubiquitin family
  misc_feature (113)..(181): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
AGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 25438 - DNA, 1403 bp, Panicum virgatum
  misc_feature: Ceres CLONE 1863565
aagcaagaaattagaaacaagcacatgccctagaagtagaagctatgccagtcctagtagtgatgcggcttctccttacagcttccgccctagtagtttctctgcagctggtcccggcggcggcagtcactgccggtgactccaacacagcaccacggccaggctgccctagcaagtgcggcgacgtgaaaattccctacccattcggcatcggtgaaaactgttcttggccaggcatggatgacttcaccatcacttgcaaccatagcttcgaccctccgagaccatacaccggcaacgtcgaggttatcaacatttcggtggaaactggtgagatgcatgtcttcaccgtcgtttcttacacctgctacaactcgaccaacaccatagcatcctaccaagaaaacagcttgttactcgtgccgccgtttcttatctcgcctgcaaacaacatcttcacggccatcggctgtgatacactggcgtttctggattgtggagctgactggaactactactacaccggctgcatcaccaactgcctgagcttcaatgattcggcttttgacggagacccgtgcacggggctgggctgctgccaagtttcaatcccgcgcaaccttagaaagataaatgtcacctggaacaaccaggccaataattatgcgtgggagtacagcccttgtaactacgccttcgtggccgagaagaactggtacaacaacttcagccgaagagacttcaacggcatgggaaatgagagcttcctcaaccgggttggggatagaactgtcccgttggtgcttgactgggctatcaggggtaacgggtcttgccagatggcagcggaggccacaggggcggcagtgaaacggacagcacctgcctgtgccagcgcccacagttactgcatcgacgtcgacgccagacaagggggtggataccgatgcaattgctccgagggatacatgggaaatccctacatcccccatgggtgcacaaatatcaacgaatgccaacttcaattatattcctgtccaagtggcagcaattgcattgacacagatggtaagtacaggtgtcaatgcaaattcggccgaaaaggagaggactgtcgtcccatatttccggcgccagctgctgcaatattagcaacacttgtagcaagccttcttctatcgctcctgctatggtttgttcacgtggatcgaaagcggcgaatgaagactgccttcttcgacaaaaatggtggtaaaatattgcagggcgcagctggcatcaacatattcacagaagttcagctgaatatgttcacaaaccactacaaaacccttattggaagggggtctttcggcatggtgttcatgggaatcactgatgaaaagcaacaagttgcggttaaa

SEQ ID NO: 25439 - DNA, 1819 bp, Panicum virgatum
  misc_feature: Ceres CLONE 1863573
  misc_feature: Encodes the peptide sequence at SEQ ID NO. 25440
gccccctcactccctcatcgtccatccacaccaaatctgctccacgtcccctccctacattcgtccgcgcatcccaccaaccatggccgccgcctccgactccgacgccggcgcccagccgcgcgacgaccccagcctcctccccttcgcatccttctcgctctccctcaacatccgcgcgccgaccgcccccacactcgcctccgtcccgtccaccatccacctccccacccaaatctccacgctcgccgtctgcctccacccctccgccgcgcagtccccgtcccgccgccccacccgcctcaactccgctacctcctccgtcatctccccgctgcccgcctccacgccgggcctctcccgctccttcccgtccggcgcgcccgccgccgccgggcgccgccgcacgctcgtctggttccgcgccgacctccgcctccacgaccacgagccgttccacgccgcggccgaggcgtcgtcctccctcctccccgtcttcgtcttcgacccgcgggacttcggcaagtcaccctcgggttttgaccgcacgggtccgtaccgcgccaacttcctgctcgactctgtcgccgacctgcgtcggagcctccgcgcgcgcggcggggacctggtggtgcgcgtgggcaggcccgaggtggtcatccccgagctcgcgcgcgcggcgggcgcggaggccgtgtacgcgcacggggaggtgtcccgggacgagtgccgcgccgaggagagggtgcaaaaggccgtggagaaggagggcatcaacgtgaagtacttctggggtagcacgctttaccacgtggaagacctgccattccgcctcgaggacatgccatccaactatggcggcttcagggatgccgtgaagggcttggaggtcaggaaggtgctcgaggcacccgaggaggttaagtgcgttcccatgaagaatgtgctcgagcctggggatatccccacgctttccgaacttgggctcactgcgccacccgccatggcacaggactcaaaacctgctgttggctctactctcattggtggagagacagaggctctggagaggttgaagaagtttgctgccgaatgctctatgcagccaaacaaagcagacaaaagcaatacccgagatagcatatatggtgctaatttctcctgcaaaatttcaccatggcttgctacaggttgcctctctccacggttcatgtatgaagagttgaagaagcatgctactagagcaattccttctgggtcaacacccaaaaacgatgatggcacatccgatgctgggacaaattggttaatgtttgagttgctatggagagatttcttcaggttcatcacaaagaagtacagctctgtgcagaagacatctgaagttgccactggttgcactcccaccccggcgcttgcatgaacatagttagacaagctgattgccagctagattttgggacatgaacttgccatgaacttatgcacactttcaatggagatttaatctttttttccaccaataaatgttggtacttggtagtgaaagtggtagctgagtgcgctgttcttgcgtttttggttcgattgatctcagaagggatcttagtatctgtcgacattcctctaaataactgttcgatactttgtgagcgaccttgaatacccccttgtactttgttaattgacgtgtgtttatgttgtatgatttgatacgcacccagcaagacatcgaaaacaaaagacttgtagcatttggttctgtaagcggtaatgtaaatgaaaatcaaataacaagatataagatgtttggtgtgac

SEQ ID NO: 25440 - protein, 446 aa, Panicum virgatum
  misc_feature: Ceres CLONE 1863573
  misc_feature (107)..(283): Pfam Name: DNA_photolyase Pfam Description: DNA photolyase
  misc_feature: SWISSPROT Homolog: EC 4.1.99.3 Deoxyribodipyrimidine photo-lyase
MAAASDSDAGAQPRDDPSLLPFASFSLSLNIRAPTAPTLASVPSTIHLPTQISTLAVCLHPSAAQSPSRRPTRLNSATSSVISPLPASTPGLSRSFPSGAPAAAGRRRTLVWFRADLRLHDHEPFHAAAEASSSLLPVFVFDPRDFGKSPSGFDRTGPYRANFLLDSVADLRRSLRARGGDLVVRVGRPEVVIPELARAAGAEAVYAHGEVSRDECRAEERVQKAVEKEGINVKYFWGSTLYHVEDLPFRLEDMPSNYGGFRDAVKGLEVRKVLEAPEEVKCVPMKNVLEPGDIPTLSELGLTAPPAMAQDSKPAVGSTLIGGETEALERLKKFAAECSMQPNKADKSNTRDSIYGANFSCKISPWLATGCLSPRFMYEELKKHATRAIPSGSTPKNDDGTSDAGTNWLMFELLWRDFFRFITKKYSSVQKTSEVATGCTPTPALA

SEQ ID NO: 25441 - DNA, 1222 bp, Panicum virgatum
  misc_feature: Ceres CLONE 1863595
  misc_feature: Encodes the peptide sequence at SEQ ID NO. 25442
aagcttatcacatctccctctggctgctctcgctcgctactcttgtgctacttaaacaaacagctcttgcgatccgcaagggccagcggccagcggccagcacccccgcacgcgaccccaagccaggaatcgcttcccacccagcgcggccaccaccagcagcaagcaccgcaccgctcggctctctccctgtcggcaacggcaaatccggcctccctccctcccgctcgctcgctcgcagtccccctccctgtcggcaacggcaaatctggttcgtgatccggcgcgcggggatggtgtcgagatcctactccaacctcctggagctcgcctccggtggcggcgggggcggggagccgctgccgtcgctggggcgccgccgggtgccgcgcgtcgtcacggcgcccggcattgtgccgggcctcgacgcctccgacgacgacgacgacgccgacgcggcctccgaccgctcctcccacgcgccgcgggagcgcgtcatcatcgtcgccaaccagctccccgtgcgcgccgcgcaccgcgcgggcggcgccggttgggacttcgcgtgggacgaggacagcctcctgctgcaggtcaaggacagcctccgcgcgcaccacggccgcggggacgtcgagttcgtctacgtcggcgacctccgcgacgacgtgccccccgccgagcacgaccaggtcgcgcacgagctcctcgaggggttccgctgcgtgcccaccttcctgcccgccgacctccgctccaggttctaccacggcttctgcaagcagcagctctggccactgttccattacatgctgccactgtcgccggagctcggcggacgcttcgaccgcctgctctggcaggcctacgtctccgtcaacaagatcttcgcggacaagatccttgaggtgatcagccccgacgaggactttgtgtgggtgcacgattaccacctcatggtgctgcccacattcctgcgcaagcgcttcaaccgggtcaagctcggcttcttcctgcacagcccgttcccctcctcggagatctacaagaccctgcctgtgcgtgaggagctgctccggtcgctgctcaatgccgatctgattgggttccacacctttgactatgccagacacttcctgtcgtgctgcagcaggatgctcgggctcaagtacgagtcgcagaggggctacattgcactggagtactatggacgaacagtcac

SEQ ID NO: 25442 - protein, 309 aa, Panicum virgatum
  misc_feature: Ceres CLONE 1863595
  misc_feature (66)..(309): Pfam Name: Glyco_transf_20 Pfam Description: Glycosyltransferase family 20
  misc_feature: SWISSPROT Homolog: EC 2.4.1.15 Alpha,alpha-trehalose-phosphate synthase (UDP-forming)
  misc_feature: Useful for making plants with altered carbohydrate content
MVSRSYSNLLELASGGGGGGEPLPSLGRRRVPRVVTAPGIVPGLDASDDDDDADAASDRSSHAPRERVIIVANQLPVRAAHRAGGAGWDFAWDEDSLLLQVKDSLRAHHGRGDVEFVYVGDLRDDVPPAEHDQVAHELLEGFRCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTV

SEQ ID NO: 25443 - DNA, 644 bp, Panicum virgatum
  misc_feature: Ceres CLONE 1863595-R
  misc_feature: Encodes the peptide sequence at SEQ ID NO. 25444
accatctggagagtgtcctctcaaacgagccggtgtcggtgaaagctggcttgaaccatgttgaggtgaagccacagggcgtgagcaagggcctggtggcgaagcggatcttgtcgacgatgcaggagcgtggtgacctgccggacttcatcctgtgcgtgggcgacgaccggtccgacgaggacatgttcgaggtgatcaccacggcggcggcgcggggcccctcctccctgcacccggaggcggaggtgttcgcgtgcacggtggggcgcaagcccagcaaggccaagtactacctggacgaccccgcggacatcgtgcgcctcatccagggcctcgccaacgtctccaacgaccaggcgtcgcacggcggcagcggcgcgaccctgcccgacgatgccgcagcggccgccgccaccgtcctgaggtgacaccgcacctgcccgcccgcgcgcagttaagctcaagtaggcggtatgagagaccgacctctcggaagggggagggagcatcgctcggtcgttggtcccagatgtgtacattgttctaggaacgaactcgcgcaagtgcgtgctgtgcttgcgagtgcgctgcttcgtcgaactgtcagccgatgtgtacataaactcctccagatcatctcc

SEQ ID NO: 25444 - protein, 142 aa, Panicum virgatum
  misc_feature: Ceres CLONE 1863595-R
  misc_feature: SWISSPROT Homolog: EC 3.1.3.12 Trehalose-phosphatase
  misc_feature: Useful for making plants with altered carbohydrate content
HLESVLSNEPVSVKAGLNHVEVKPQGVSKGLVAKRILSTMQERGDLPDFILCVGDDRSDEDMFEVITTAAARGPSSLHPEAEVFACTVGRKPSKAKYYLDDPADIVRLIQGLANVSNDQASHGGSGATLPDDAAAAAATVLR

SEQ ID NO: 25445 - DNA, 580 bp, Panicum virgatum
  misc_feature: Ceres CLONE 1863596
  misc_feature: Encodes the peptide sequence at SEQ ID NO. 25446
gtctctcgttcgagaaaaaaaaagaaagtgtttcccacgcgaagcaatctctccgtaatcaaccatcaccgctcaatcaggtgtgcgaggcatcttccggttcgtgttaggaggaggaggaagagatggcgaagggggagggggaggggccggcgatcgggatcgacctggggacgacctactcgtgcgtcggcgtgtggcagcacgaccgcgtcgagatcatcgccaacgaccaagggaaccgcaccacgccgtcctacgtcgccttcaccgacaccgagcggctcatcggcgacgccgccaagaaccagatcgccatgaaccccaccaacaccgtcttcgacgcaaagcggttgatcggcaggaggttctccgacccgtccgtgcagagtgacatgaagctatggccgttcaaggtcgtggctggccctggcgacaagccgatgatcgtggtcaactacaagggcgaggagaagcagttctctgctgaggagatctcctccatggtgctgaccaagatcaaggagatcgctgaggcatacctcggctcccccatcaagaacgccgtggtcaccgtgtc

SEQ ID NO: 25446 - protein, 151 aa, Panicum virgatum
  misc_feature: Ceres CLONE 1863596
  misc_feature: Useful for making plants with modulated heat sensitivity
MAKGEGEGPAIGIDLGTTYSCVGVWQHDRVEIIANDQGNRTTPSYVAFTDTERLIGDAAKNQIAMNPTNTVFDAKRLIGRRFSDPSVQSDMKLWPFKVVAGPGDKPMIVVNYKGEEKQFSAEEISSMVLTKIKEIAEAYLGSPIKNAVVTV

SEQ ID NO: 25447 - DNA, 1479 bp, Panicum virgatum
  misc_feature: Ceres CLONE 1863601
  misc_feature: Encodes the peptide sequence at SEQ ID NO. 25448
cccggctgttgctgctgactgaggttcgtgttccacggggcggagagagagagagagagagagagagagagagagggcgaagccctcttccgtgtcgtctcgtcccctgctgtttctccccacccttccctgcctcggcttgcgcctccgaccttgccggtaagtcccccttcttccactctgtaggcgtgcttttgcccgagaattcaattttggggtttcgaggaaagaagagggtccgtttaaattttggattagcagttgtttattctgttccggttgcgttgcatgtggattgtggcgcgagacactgccatatgaggatttattgcggatgatgaggtggttgcatttttttaccgttcagatctgataaaattgcagtggtaaaggcagaggaggagtggggcagctaggtatttggttagcctttgtttaatatttggtaagaagaagatttctggtttgcctacacggtcgaaagggatggatgctgacttttgagggtcttattttttttgtttgtatatgcgagattttatatttctactttgcgaattttatattcgttaaggttcagtgccagctgttagctgtactgtccgtatctcagattcggtttggtgaaatgaaactcttacagtttcggccaaaattcgatgaaactcagattttattgtcaggcacatgagtgaaaacttctgcagatttatgacgcaggaattgggcgaaaatgtcacgaatctgctataatttattgctaattaggctcctgacaatacaattcccaattactttaaattattagtctgatgagttggctcagcagtagcatcaagaaatagcagtgtggtcaattgcagacttgcagtagctccaaaatagaactctgaaccattttttgttttgggttgcagaaacttccaccctcagaaccgaaaggggtctgtgaggagattttttgcagcagtgcaatggaggtatttggcaaatctgtgattgctgagcccagcaatgtgattttcttgtctgccattcttaacacagaagggtcaaaccctagtcacaagtgtgacaagaggtgccagactgaccgccaggcagcctctcccctcccgagccgccgtcacctgcgcctccgcctcatccccgcgccgccgaagcggttagtcttcacctgcagccatgggtaaggagaagtcccacatcaacattgtggtcattggccacgtcgactctggcaagtcgaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcatcgatgcccctggacaccgtgacttc

SEQ ID NO: 25448 - protein, 97 aa, Panicum virgatum
  misc_feature: Ceres CLONE 1863601
  misc_feature (5)..(97): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRD

SEQ ID NO: 25449 - DNA, 797 bp, Panicum virgatum
  misc_feature: Ceres CLONE 1863601-R
  misc_feature: Encodes the peptide sequence at SEQ ID NO. 25450
aggatgtgtacaagattggtggtattggaactgtccctgttggccgtgttgagaccggtatcatcaagcctggtatggttgttacctttggccctagcggcctgactactgaggtgaagtctgttgagatgcaccacgaggctctccaggaggcccttcctggtgacaatgttggcttcaacgtgaagaatgttgctgtgaaggatctgaagcgtgggtatgtggcctccaactccaaggatgaccctgccaaggaggctgccagcttcacctcacaagtcatcatcatgaaccaccctggccagatcggcaacggctatgccccagtgctggactgccacacctcccacattgctgtcaagtttgctgagctcattaccaagattgacaggcgatctggtaaggagcttgagaaggagcccaagttcctcaagaatggtgatgctggtatggtcaagatggttcccaccaagcccatggttgtggagaccttctctgagtaccctcctcttggtcgcttcgccgtccgtgacatgaggcaaacggttgctgttggagtcatcaagagcgtggagaagaaggaccctaccggcgccaaggtcaccaaggctgcagccaagaagaaatgatgtgtctggtggttgatagcgtacctagatgcgttattgtcgcttaagttttgttcatggtcattgctgttatctcgtgaactctcagctggcaatgtgtgccctcagtctgtgtgtcgttcacatacggttttaatattttattcggcaaaacttaaattacctgcc

SEQ ID NO: 25450 - protein, 208 aa, Panicum virgatum
  misc_feature: Ceres CLONE 1863601-R
  misc_feature (83)..(191): Pfam Name: GTP_EFTU_D3 Pfam Description: Elongation factor Tu C-terminal domain
  misc_feature (9)..(76): Pfam Name: GTP_EFTU_D2 Pfam Description: Elongation factor Tu domain 2
DVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 25451 - DNA, 2705 bp, Panicum virgatum
  misc_feature: Ceres CLONE 1863603
  misc_feature: Encodes the peptide sequence at SEQ ID NO. 25452
aagcattcaagagtggcttccttctgtactggcttggcccgctcatctgcttactctagttcaagatgagttcatgtcttattgcgatcagtttcgcctagcctaatttaacttatcctagtaaattgcgtccctccagtcagtagtcataaaagtgtgcaagtcttcagagagaatccactcagaatggattatttgacagcatctgaagaatatgcttcccaatccaagttattgcaagaattcaccaaagtcccaaccattgacagtgcttgggttctcaaaaataacaacgaaggcatatccacagcaatgttctccattagccagccagacctactggcgaacagcaccagaaaatacactatgtactgccatattacgggggctggtaccaactctcgggatttccagcggtctcctttccccactgaaatgcctggagtgtctgtcatcgtcccatctccttcggggtcgaagcttcttttagtgcgaaatggagagaaaggttgccctactaagcttgaaattgttgatcaatcacatgtggcaaaggacatacatgtaggtcagtctatgcatggtccgctttatactgatgaatggtttcatggtatttcctggaatcaagaagagaccttgatagcatacattgctgaagctccaccccaactaagaccagttttcagtgattctggatatagaaagggagactcttctgatgaagactgtaatacctggaaaggacaaggggattgggaagaggactggggtgaaagatactccaaaaaagggagaccctcattgtttgttcttgacattgccagtggagaagtgagagcggctgaaggcattgcaacatcattgagtgttggccaagttgtttgggctcccccttcttcaagtggcagtcaaaagtatttggttttcgttggatggtcagagcacaacgggtttcataacactgctagaaaacttggtatcaagtactgttctaacaggccatgtgctctttatgcaattgctagccctttcgaaagaccagagactaacaataaaccagtttgcgatgataaatcagactccgctgcatcagcacgcaacttaacagcaagcataagtagtgcttttttttttccacgtttcagccaggatggaaaaatcctactcttcctttctgcaaaacaggctgtaaatagtggagcacataatgcaacggattctctgcataagatcaactggctttctgattgggaaatggataaacaacttgatgttactgaagtggtacctattgtaatgtaccctgaagatgattgtttcccgggtctttactgctcatccattctatccaatccttggctttctgatggatgcacgatgatactaacatctgcttggagaagtaccgaagtaatattatcaatagatgttttaagtggaaaagtaacaagacttactccagaagactcgcattactcatggagtgctcttgcgatagatggtgacaatgttcttgctgtgtcaagtagtcccatcgaccctcatatcaggtatggacaccaagtgaaaccagagagtcaagcatgcagatggacttgggatgaagttgatagttcgttgatgacagccagcgatacggttaagtccttgttgtcgcatcacagtgtcactatacttcaaattcctgtcgctaacccctctgatgacctctctgaaggtggcaaacttccatttgaggccatttttgtgtcctgcaaggacagttcacacagtccaactgttgtaatccttcatggtggcccacactcagtgtctgtgtcaagctacgtgaaaccatcagcctttcttgcttcgcttggattcaacctgctaattgtaaattatcgaggtacaccgggttttggagaggaggctttacaatcgcttcctggaaaagtaggatctcaggacgtccaagactgtcttacagccatagatcacgtcatcaatgaaaagctaatagatgcttccaaagtagctgttgttgggatttcacatggtggattcttgacaactcatctgataggccaggctccagacagatttgtcgtgggagctgctcggaatcctgtgtgcaaccttgcgctgatgattggcaccactgacatcccagactggtgttacacggtggcctgcggaactgaagcgaagcaatatgcctctgaatccccttcacccgaccatcttcgcctcttctatgagaaatcgccgattgctcacatctcaaaagtgaaagcgccccttcttatgcttcttggaggagctgatcttcgagtacccgtttctaatggcctacagtacgcaagggctctcagagaaaggggtggccaggtcaaaattatgatgttcccagaggacatacacgaaatcatcataccacggtctgatttcgaaagtttcctcaacattggagtttggttcaagacacatctaaaataggtgcaaatgcagcggcatgaagcagagtctggtgatctaagctaaattttagattgtgttcttgctgatattatatgttctcgtgaaacaagcagtttcgtactgccctcgtacgtgaatccggctactttttagatttgatataaaagatgtaatgaattaaacaactgctccattaatatttttagctattcagtcatgatgctttaattcatgacttcgac

SEQ ID NO: 25452 - protein, 764 aa, Panicum virgatum
  misc_feature: Ceres CLONE 1863603
  misc_feature (545)..(764): Pfam Name: Peptidase_S9 Pfam Description: Prolyl oligopeptidase family
  misc_feature: SWISSPROT Homolog: EC 3.4.19.1 Acylaminoacyl-peptidase
MDYLTASEEYASQSKLLQEFTKVPTIDSAWVLKNNNEGISTAMFSISQPDLLANSTRKYTMYCHITGAGTNSRDFQRSPFPTEMPGVSVIVPSPSGSKLLLVRNGEKGCPTKLEIVDQSHVAKDIHVGQSMHGPLYTDEWFHGISWNQEETLIAYIAEAPPQLRPVFSDSGYRKGDSSDEDCNTWKGQGDWEEDWGERYSKKGRPSLFVLDIASGEVRAAEGIATSLSVGQVVWAPPSSSGSQKYLVFVGWSEHNGFHNTARKLGIKYCSNRPCALYAIASPFERPETNNKPVCDDKSDSAASARNLTASISSAFFFPRFSQDGKILLFLSAKQAVNSGAHNATDSLHKINWLSDWEMDKQLDVTEVVPIVMYPEDDCFPGLYCSSILSNPWLSDGCTMILTSAWRSTEVILSIDVLSGKVTRLTPEDSHYSWSALAIDGDNVLAVSSSPIDPHIRYGHQVKPESQACRWTWDEVDSSLMTASDTVKSLLSHHSVTILQIPVANPSDDLSEGGKLPFEAIFVSCKDSSHSPTVVILHGGPHSVSVSSYVKPSAFLASLGFNLLIVNYRGTPGFGEEALQSLPGKVGSQDVQDCLTAIDHVINEKLIDASKVAVVGISHGGFLTTHLIGQAPDRFVVGAARNPVCNLALMIGTTDIPDWCYTVACGTEAKQYASESPSPDHLRLFYEKSPIAHISKVKAPLLMLLGGADLRVPVSNGLQYARALRERGGQVKIMMFPEDIHEIIIPRSDFESFLNIGVWFKTHLK

SEQ ID NO: 25453 - DNA, 506 bp, Panicum virgatum
  misc_feature: Ceres CLONE 1863648
  misc_feature: Encodes the peptide sequence at SEQ ID NO. 25454
atctctcttcgccgcaaatttaaagctttctttgtttggacttgtggaagcgataaatcttgaagcttccttaccctgattgccttggtctctcctgctcccgtcgattggttgtccgggagttcagagctgttgagatcttcgcaggctccgatgagcgcgccgggatggcgaatctagccgcggcgcgcccgtggctctgcttgctggcggcaatggcggcggcctcgtggcccggcgtcgcgacggtggacgcgctgggcatgaactggggcacgcaggcgacgcaccccctgtcgcccaacgtcgtggtgcagatgctcaacgacaacggcatcaagaacgtgaacctgttccacccccaccacggcacgctccccgcgctcggcggcagccgcatctaggtcatggtcaccattcccaatgccctgcttgacaggatcaccgactacaacaccgcctaggagcgggtacggcacaacgtctcccgctacaacttcgactgc

SEQ ID NO: 25454 - protein, 78 aa, Panicum virgatum
  misc_feature: Ceres CLONE 1863648
  misc_feature: Useful for making plants with altered carbohydrate content
  misc_feature: Useful for making plants with altered cell wall content and/or composition
MANLAAARPWLCLLAAMAAASWPGVATVDALGMNWGTQATHPLSPNVVVQMLNDNGIKNVNLFHPHHGTLPALGGSRI

SEQ ID NO: 25455 - DNA, 1741 bp, Panicum virgatum
  misc_feature: Ceres CLONE 1863656
  misc_feature: Encodes the peptide sequence at SEQ ID NO. 25456
atccccccctgacgatcgccgaccgccgtttcgcggcttgctcgatcgtcgccggcggccggcggcggcggggagcacccttcgtcgtgacgctcgtagctgagcttagagagagaacacagcggtctggggccgtccaggcggagggatcaggcggcggcgctccccatcgtccccggcggccgcggcatggacagccccaagaggagcgcggccgcggtggcctcgctgctcgacgacgccatcgtggagatcctctcccgcgtcccggccagatccctctgccggttcaagtgcgtgtccaaggcgtggcgcgacctcatcgccgaccgccacaactgcaagaagctcccccaaaccctcgagggcttcttctgcgcctacgatggcgagatacacggcggcaaccgcggcgatggcggcggcgaggggggtcgcgtcgtccaggggcgcttcatcgacacgctgggtagatccatgcccctcgcgtctttctccttcctgagcgagcagccgggaattgaggaactcaatctcgtgcattcctgcaacggcctcatcctcttcagtcacatacgggattcggaaacctacgattcactgggctttatcgtgtgcaaccccgccaccgagcaatgggtgcccgtgcccaactccggctggaaccctaatctgtttcaccaagcggatgagaacgaggattcggattcggactggtactgtgatcctagcttcaggttcacctatttgattttcgatcctgctgtgtcctcgcactttaagttggtcgagttctggacgtacgatgagatttaagtatttagtgggagaggtgaacacctactcgtctgaggatttcgtgagagaggtgcacacctactcgtctgaaactggggtatggtctgaggggacaagtgagtggagttcaggtgaggacttatgtttcttcgcacaatgcgcctttgttaatggcatgctgcatttcaatgtcacccaccttgatatagaccaggaggcaggagcaaatagttgcagttgatggggaagggaagaagtgtaggatcatcagcgggccggagaagtctagtgatgtggtttttgttggtcaatcccaaggacagctgcattacatgagtcaacacagagacaaaactcgccagatgactgaactgtccatttgggttcttcaggactacaataaagaagaatgggttctgaagcacagtgtcctttttgcagctgtttggaagaacgagtttccaagttgaacatgattacaatgtggttgccattcacccggaccgcaatatgatcttctttgttaagcactgggacctgaaactgaaatcatatgacatggatagcaaggaagtgcgcactctctgtactctaggggttcgccgtcaggatattttaccatatgttccctatttcatggagtcatcggcacttgctagtaagcactgaaattgtgccttgtgagctactaagtcaaatttgatgttccaagtaatgtgttccagcacaggagcatctagcaacataaatatatctgtagaattaggtaatgtgttctgatggtgcttcgatgtactactgctcatgcattttgtgtgctagatactgcaaacaaatactcgaggcacatgtgtaagttaccattacatatgtatgctattgcctaagttgcagaatgtatgatgtttgaacttctaagttcctaagctctatttttcctgtt

SEQ ID NO: 25456 - protein, 208 aa, Panicum virgatum
  misc_feature: Ceres CLONE 1863656
  misc_feature (9)..(56): Pfam Name: F-box Pfam Description: F-box domain
MDSPKRSAAAVASLLDDAIVEILSRVPARSLCRFKCVSKAWRDLIADRHNCKKLPQTLEGFFCAYDGEIHGGNRGDGGGEGGRVVQGRFIDTLGRSMPLASFSFLSEQPGIEELNLVHSCNGLILFSHIRDSETYDSLGFIVCNPATEQWVPVPNSGWNPNLFHQADENEDSDSDWYCDPSFRFTYLIFDPAVSSHFKLVEFWTYDEI

SEQ ID NO: 25457 - DNA, 601 bp, Panicum virgatum
  misc_feature: Ceres CLONE 1863659
  misc_feature: Encodes the peptide sequence at SEQ ID NO. 25458
acacattcacaccccaaagcagcgcagccgcctcattcctcctctccatcctcctctctctctctctcgcgcgccgctcttcccgttccgttccaggagagcagtgaggggggaagtagggggcggggaggggaagaaaaaatgttcatcaagagctccggggggagagacccaaaagggggggcagggcccgggaaaaatagagtgagagtaccggaacaacacgacggagctggtgcacgagggcaaggacggcgcctcccggtgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcactcaggcctccaccatcagggttggcagctacaacggggaggagatctacgcgccgttcaagagcctcctgcccatggtaaaccctgatgacattgtgttcggaggctgggacatcagcaacatgaaactggccgaagccatg

SEQ ID NO: 25458 - protein, 88 aa, Panicum virgatum
  misc_feature: Ceres CLONE 1863659
  misc_feature: SWISSPROT Homolog: EC 5.5.1.4 Inositol-3-phosphate synthase
MLVGWGGNNGSTLTAGVIANREGISWATKDKVQQANYFGSLTQASTIRVGSYNGEEIYAPFKSLLPMVNPDDIVFGGWDISNMKLAEA

SEQ ID NO: 25459 - DNA, 697 bp, Panicum virgatum
  misc_feature: Ceres CLONE 1863668
  misc_feature: Encodes the peptide sequence at SEQ ID NO. 25460
atcgcatcccacccatcccccccaacacatcgcccgcctcggttccctccactcgacgcttctcccgctcctaacccctagtcccctcttctgctactccgccgccgccgccgccgcaacccccagcggccagatccgagcggcggggatcgtcccccacacggatcgagctcccgatccgcgcaggggagtggcggcgctggagcgccggggccccgagaggctggagccggaggaggggagtagttccgcggtggtagatccgccggccatggcgcccgagatggactcctcggtagagaaggggagcgggtcctcggatccggacgagcgcccggccgccggcgagcccaaggcctgcactgagtgccacaccaccaagaccccgctctggcgcggggggccctgcggacccatgtcgctgtgcaacgcgtgcgggatccggtatcggaagaagagaagggaggcgctgggcctcgatgccaacaagtccggcgccgccgagcagcaccagcagcggaagaagaaggccaccgccaccgcctccaagagggagagggaaaaggaggcggagacggatgaggtcaccgtagagctccgcacggtggggttcggcaaggaggtggtgctcaagcagcggcggcggatgcgccggaggaggcgcctcggcgaggaggagcgcgcagccatcctgctc

SEQ ID NO: 25460 - protein, 137 aa, Panicum virgatum
  misc_feature: Ceres CLONE 1863668
  misc_feature (26)..(61): Pfam Name: GATA Pfam Description: GATA zinc finger
MDSSVEKGSGSSDPDERPAAGEPKACTECHTTKTPLWRGGPCGPMSLCNACGIRYRKKRREALGLDANKSGAAEQHQQRKKKATATASKREREKEAETDEVTVELRTVGFGKEVVLKQRRRMRRRRRLGEEERAAIL

SEQ ID NO: 25461 - DNA, 641 bp, Panicum virgatum
  misc_feature: Ceres CLONE 1863676
  misc_feature: Encodes the peptide sequence at SEQ ID NO. 25462
gtaacccaattccgcaaaaaaaggggtcctcctactcccctctcttcccgcttccaaacttcttctccccttttccacccgcccccccccccaccctttccaacaacccctgaaggaatggctctccatccccctccggcaggccgggattccaggccgaaacccgtggtgggaactggaccggctccagcatgggattccacctgaagggcaaatggcccatgaacaaaaaggtggaagaagggaagaagccttccacaccttcttcaatgaaaatggggctgggaaacctggcccccctggtggggttggtgattctgaaccccctggccttgaagaagggaagaatgggacttaccccccgcttttcccccctgaacaactcaacaatgggaaggaagaagctgcccaccactttggccgtggtcactacacccttgggaaagaaaatggtgaactatgccttgaccccattaagaaacttggccaacactggactgggctcccagggttcctcctggtccacgctggtgggggaagaaacgggtccgggcttggttccctcctccttgaacgcctggctggtgaataagggaagaaatccaagcttcggttcactgggtacccatcttccccaggct

SEQ ID NO: 25462 - protein, 125 aa, Panicum virgatum
  misc_feature: Ceres CLONE 1863676
  misc_feature: Useful for making plants with altered cell wall content and/or composition
MAHEQKGGRREEAFHTFFNENGAGKPGPPGGVGDSEPPGLEEGKNGTYPPLFPPEQLNNGKEEAAHHFGRGHYTLGKENGELCLDPIKKLGQHWTGLPGFLLVHAGGGRNGSGLGSLLLERLAGE

SEQ ID NO: 25463 - DNA, 1466 bp, Panicum virgatum
  misc_feature: Ceres CLONE 1863682
  misc_feature: Encodes the peptide sequence at SEQ ID NO. 25464
  misc_feature (127)..(127): n is a, c, t, g, unknown, or other
accctcgcccgcggcggcgcatcccctgaaaggggcagatggggagtcccgacggcgacggacgcgggggcggcggcggctcccacccccaccaccagtaccactaccaggcgctcctcgccgcggngcagaaccccacccagggcctgcacccctttcccctccccttccacgttgggccacccgccgccgggccagcagctgatgcagccgcgtccacgcacaatgctgctccccactctcagcactcaagaggttttgccgactggagcgcttccagcagtgccttcgcgtccgtttctccgcagcccgcccccgccaccacttttttaccacccttcccatacaacctctcccagtcttacgcgctatggtcccattacatgcttagcaagaacgcgatgccctactcttcttatcccgcaccacatgaggacaacccccgctcactgcgccatactcacatcccgccggacaaggattcaggttctacatattctatggaaacagcaggttctgcatccagccttggatttgactctttcactacaatgtcccttggaccaaacatatgcgcccacttgtctcccatggaagcatctctacctgccaaagaagctgagaattcagaggatttgcctacagtggttagaaacagtgacgacatggacactataaacagtgaggaagtccatcatgacacagctgccgctcttcctgagtcgaagcctagtcatgagagctgcaccatgaagttcaactctggagagtaccaagtcgttttgcgcaaagagttgacaaagagtgatgttgcaaatgtcgggcgaattgtgcttcccaagaaggatgctgaggctagtcttccaccattggtgcaaggtgatcctctgatactgcagatggatgacatggtgcttcctgttacatggaaatttaagtatagattctggccaaataacaaaagcagaatgtatattctggaagctgcaggtgaatttgtgaagacgcatggtctccaggcaggggatgcactcattatctacaagaactccgtgcccggcaaatttattatccgtgcggagaaggccattcagcagacaaacccctaaacccaacttgatgatgtggctgtagcagcgccaaagatggcttttgaggatatgaattcaccataagttcagaactgaaggcattatcaactttcatgagtgggttaccatcacaatgggatgagtctaacttgttgattcctggtggatggagacgagaaattttgggagaacattggaagtgctgccaatgagcctacatctgagcaggacaagtagtttgcaatttttttccttctaattcggttgtatttggatgctcgagttctgcattgcattctgaacaacattcgcagtacttttttcttgtaaatattttgaacctataagataaaggaagtggtctggaacttatgc

SEQ ID NO: 25464 - protein, 241 aa, Panicum virgatum
  misc_feature: Ceres CLONE 1863682
  misc_feature (133)..(227): Pfam Name: B3 Pfam Description: B3 DNA binding domain
MLSKNAMPYSSYPAPHEDNPRSLRHTHIPPDKDSGSTYSMETAGSASSLGFDSFTTMSLGPNICAHLSPMEASLPAKEAENSEDLPTVVRNSDDMDTINSEEVHHDTAAALPESKPSHESCTMKFNSGEYQVVLRKELTKSDVANVGRIVLPKKDAEASLPPLVQGDPLILQMDDMVLPVTWKFKYRFWPNNKSRMYILEAAGEFVKTHGLQAGDALIIYKNSVPGKFIIRAEKAIQQTNP

SEQ ID NO: 25465 - DNA, 187 bp, Panicum virgatum
  misc_feature: Ceres CLONE 1863706
  misc_feature: Encodes the peptide sequence at SEQ ID NO. 25466
atcacgatggtgaggatctacgacaccgaccgtggggtgatcagagctctggccaacaccggcatcaagctcatggtgtcgctgcccaacgagcagctggcctccgcggcctccagcccgccgttcgcgcgccagtgggtgcaggacaacctgggggcgttccacccccccacgccgaaaacagcgg

SEQ ID NO: 25466 - protein, 62 aa, Panicum virgatum
  misc_feature: Ceres CLONE 1863706
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
ITMVRIYDTDRGVIRALANTGIKLMVSLPNEQLASAASSPPFARQWVQDNLGAFHPPTPKTA

SEQ ID NO: 25467 - DNA, 1295 bp, Panicum virgatum
  misc_feature: Ceres CLONE 1863728
  misc_feature: Encodes the peptide sequence at SEQ ID NO. 25468
actacggagtaggtctaagtaacaatctcctccaaaaatgatggggacaaacagagagataggacacggatcaaacgggctgctgttttgccggctcctcctgtccgcttccgccccttcccttcttgccagctcctcgcccacttctttcttcttccgccaaagtcccctcgccgccggccaccgtctcgccgggtttctccggaggcggcgtcgtcgggcgccgagcttcctctttttgcccccacatccggtggtccgctcctctgcgacgacgagctctgaagcgccacccctacaagctttcaatccaatccaatgaggcccaataggggtggactcttcggcccaacgacctaacggggcgcctcgctcctgatgaaatgatcaatttacagaaaggcccccaagatcgccgcccaagcccaacagtagcccagaagaatgcgaattcgaagaaggctacacggtgtcgttgggtgcgagcgagactcttaggagggcttccctgcaagtttccagaccggcaaagccctagaacctccacctcgtcgtcggcggcggctaccatgtcgaccccctccgggaacggcggcagcgcctccgcgtacttcgacgtctacggccatggcgctaagcctgatgttgtttttaaggaggctgctttaaactctacgttaaatctgcaggatgttcagggtctggtcacttgggttattggtgacggcatgcttccttcttgggtgtttgttaagaacaagcctcttataccgaaagtcatcctgctatatgttcctggccttgatgcagctttatatatgtcacagacgcgacttctttcttctctgaaagaattatgtggcaatccaaaacctgttctagcttcaagctgcatacctgatgagaggcataccattgatgcactcctaacctgcagagtaaagagaaaacgtgatgtaaaaacatcaactcagccgtctaaactggatggagaaggaaaattatcaagtctggatgatcttggggacataccatttcctgttacatattacacactttcggagaaagacttagaagacaatggctactctttaaatttgtcagattttgtccctactgtttcagctccttcaggttcttctccacataaaattcttgcacttgattgtgaaatgtgcgtgactggagctggatttgaacttacaagagtgacattagtcgatattaaaggaacggtggtgctagatagactagtaaagcctgccaatccaatcatcgattacaatacaaggttc

SEQ ID NO: 25468 - protein, 241 aa, Panicum virgatum
  misc_feature: Ceres CLONE 1863728
  misc_feature: SWISSPROT Homolog: EC 3.1.13.1 Exoribonuclease II
MSTPSGNGGSASAYFDVYGHGAKPDVVFKEAALNSTLNLQDVQGLVTWVIGDGMLPSWVFVKNKPLIPKVILLYVPGLDAALYMSQTRLLSSLKELCGNPKPVLASSCIPDERHTIDALLTCRVKRKRDVKTSTQPSKLDGEGKLSSLDDLGDIPFPVTYYTLSEKDLEDNGYSLNLSDFVPTVSAPSGSSPHKILALDCEMCVTGAGFELTRVTLVDIKGTVVLDRLVKPANPIIDYNTR

SEQ ID NO: 25469 - DNA, 1721 bp, Panicum virgatum
  misc_feature: Ceres CLONE 1863729
  misc_feature: Encodes the peptide sequence at SEQ ID NO. 25470
catatcactagacacttccaaagaatctgctatcgctcaagaagctgatcagagtgttagctctgcaaatgtcagttcttatgctcaagaagccataggagactctgattctgcatataacattgataatgctcaagatgatttggagatctccaaatacaacttggaagatgcttccaaagaatctgtcattgctcaagaagctgatcagagtcatagctctgcaaatgtcagttctgatccgcaaaatgaatctgagattatcacagatcagtcggcagttattgccatccgcggtggccatgaaaatgattccatgatttctaaatgcaaatcagaagatgtttttgaagaatctgttattggtctagaagctgatcatgatgagagctctgcatatgtcagtgatggcactcaaaatgaatatgaggataccacctgtcattcagaaggcactcaagtggaatcagatgtaattcaagaagatgaggatgggatcaaaactgcaggtggtcaaaataaatctgaaattacaccatgtgaatcaggaagtgcttctttaaaacctgctaagtctcatgaagctgatggagatattaatatcatacatgctagttatggtttgcaaaaggatactaccatgccaaaacttgatgcttgtgaaggtaatactgccactgaagaagcaggtttgcaaaaacttgatgcttatgaagatattcgtgctactgaagaagcagtccaatcttcgcaaataccagcagatttcgctgatgcaaaagaaccttctattgatgacatatgcggtgcattcagcgggatgaacctcaagggagatgtatattttgatcctgccgagtcagccacatgtccaaggaataaactgatcatctccaggaggaggagaacgcccgaagaggaggaatacctgcgaggtttcaatccgcgagcaccgaattttcttcctctggagttggatccagatgcagagaaggttgacctgaagcaccaaatgatggatgagcggaagaatgcagaggaatggatgatcgattatgctcttaggagggcagtgacaaatttagctcctgctcgaaagaagaaagtggaacttcttgtccaggcctttgaaaccgtcctgccgcatgatgaggatgataagaaaagcatcacacccacaaggcctgtccaagcctgcaactgatgacactagagttagtggttacactaatggcgatgttgacgctcgcaagctactaactcggaggtcactgcaatattagtgccagtgacctgctccaagtttgaatgagagagctgctatgtaatttaagtgtgtatatgtctcgtgtgctaatgtcgtctgatattgtactgacggctctgtgaggcttgaaaactgtcgagggcgatgaggtgccctttggcaaagatcaaataaaactcatcttgagtgcacaactgtttctactgaagatgattctgtgtatcaattgcagcccatataacgtgtttgcatttgtaaatcttgaattacatagcagcaaatcttgagagccgtgtgtctttgtaactgcacaagcatatgatttctcgcgaacagagttggtgcagcaaattgttagttaccgagtcatctgtagattgtcaggtcgtcgttgtactcgaaaatgaactcatcaaccgatctgacggttgcagctaaattgtttcagttctag

SEQ ID NO: 25470 - protein, 400 aa, Panicum virgatum
  misc_feature: Ceres CLONE 1863729
  misc_feature (266)..(381): Pfam Name: CaM_binding Pfam Description: Plant calmodulin-binding domain
ISLDTSKESAIAQEADQSVSSANVSSYAQEAIGDSDSAYNIDNAQDDLEISKYNLEDASKESVIAQEADQSHSSANVSSDPQNESEIITDQSAVIAIRGGHENDSMISKCKSEDVFEESVIGLEADHDESSAYVSDGTQNEYEDTTCHSEGTQVESDVIQEDEDGIKTAGGQNKSEITPCESGSASLKPAKSHEADGDINIIHASYGLQKDTTMPKLDACEGNTATEEAGLQKLDAYEDIRATEEAVQSSQIPADFADAKEPSIDDICGAFSGMNLKGDVYFDPAESATCPRNKLIISRRRRTPEEEEYLRGFNPRAPNFLPLELDPDAEKVDLKHQMMDERKNAEEWMIDYALRRAVTNLAPARKKKVELLVQAFETVLPHDEDDKKSITPTRPVQACN

SEQ ID NO: 25471 - DNA, 541 bp, Panicum virgatum
  misc_feature: Ceres CLONE 1863742
  misc_feature: Encodes the peptide sequence at SEQ ID NO. 25472
catctgtccgctacaccgcagatcgatggtgtaagccctcctggtggtcgccttggcagccgtctccgccgcttcggcgctccgcccctacctcccgctgctccgcggcgagcctccccctgggtaccttcgcgttggtcccttcatccgtgagaccatctgcttcctccactgcgcacccgtccaacagcgcccgcggcttcctcaaggaccatctcgccaggtacgggaacgtgttcaagtcctacctcttcggctcgccggcggtggtctcctggcacgagcacctcacccacttcatgctgcacaacgaggagcgcctgttccagtgctgctaccccggcgccatccgcaccatcctcggcgagtcctccgcgctggaggtcaccgactaccgccaccgccagatccggagcatgttcctcgccctcctgccctccccggggactcaacgcctcctacgcctgcagcgtctactagtccgcccgctccctcatcgcgtcctggcgcgctcccaataccatcaccttctgcgagaagt

SEQ ID NO: 25472 - protein, 179 aa, Panicum virgatum
  misc_feature: Ceres CLONE 1863742
  misc_feature: SWISSPROT Homolog: EC 1.14.13.77 Taxane 13-alpha-hydroxylase
SVRYTADRWCKPSWWSPWQPSPPLRRSAPTSRCSAASLPLGTFALVPSSVRPSASSTAHPSNSARGFLKDHLARYGNVFKSYLFGSPAVVSWHEHLTHFMLHNEERLFQCCYPGAIRTILGESSALEVTDYRHRQIRSMFLALLPSPGTQRLLRLQRLLVRPLPHRVLARSQYHHLLRE

SEQ ID NO: 25473 - DNA, 1376 bp, Panicum virgatum
  misc_feature: Ceres CLONE 1863785
  misc_feature: Encodes the peptide sequence at SEQ ID NO. 25474
agcgaactccgatctggttgctgcgcgcctcgacttttccaccttcctcccctccgacgcggcggcgaccgggacccgaggagagccggaggaacgaggaggccgcttgcgccaccgtacgagagcaggcgagggagggagggatccaatggctcccaagagggagctgttcgtggcggccggcgatggcggggcggcgctgcctcaggagaagcgcctgcgagtggaagcggctcccggcagcagcagcagccgccccaacccgccgtcgtcgccgaggcactttctggccatcgtgctcgtcgtcctcttcttgaaacggccgaagggtaggagcacggacgccatcgcaatctccgcctccaagtttggtcgcatgatgcgggaccagatttgtcgtttcattaatcccttgtttagcaaactggaaaatatggatagcaaactggaaactatgggtaccaaactgggaagaatggaggagcagattcaggatatcaccgtgaaagtggacaatatagcacggccctctcctgaccaccacaatcatgagcagttcaggtaagggatttctttttgtcctggtggagcaaaagttagtttcttaaagtaactaaacctcattttactatgctttcttgtttttatttcaggcaagagacaaaccaggaagtcaaacctgctgaagctgaaggattggccagtactgaaggcaagggtgaaaacacaagcattcggctgcgcttcctcaatggaatgaacacgcaagtttaccatgacgatgagataaaatctgaccgcaatacagccattagtattggcatattcaatggagagaaaatgattgaatcaggcgagctttcgaatgtgcaaattgagatcttcgcccttgagggtgactttccttatgcttccccaaagagttggactgctaagaagttcaataaacatagagccaatgctcgggatggaagaggacatgtgttggcaggtgaaggaataaaggcccagctgaagaatggacagtgcgatcttggcagcatcaaattcacagaaaattcaagcaaggcacacagagggaagttcatcattggggcacgagtttgtgagggtgaggtatgtggtttccgtgttcaagaggctgtcatggaccctgtggttgtgcaggatcgcagaaacaaattcaatgaaaaacgacaccttcctaagctcaatgatccggtgcatcgtttgaaagaaattgccaaagatgggatttactgcaagaggcttgagaaggagaagatccttactgtgcaggacttcttgaaggctctgaataaggaccctgagaatcttgccaaagttctccagataaaaaaagaacacaggaactg

SEQ ID NO: 25474 - protein, 248 aa, Panicum virgatum
  misc_feature: Ceres CLONE 1863785
  misc_feature (33)..(248): Pfam Name: Calmodulin_bind Pfam Description: Calmodulin binding protein-like
MLSCFYFRQETNQEVKPAEAEGLASTEGKGENTSIRLRFLNGMNTQVYHDDEIKSDRNTAISIGIFNGEKMIESGELSNVQIEIFALEGDFPYASPKSWTAKKFNKHRANARDGRGHVLAGEGIKAQLKNGQCDLGSIKFTENSSKAHRGKFIIGARVCEGEVCGFRVQEAVMDPVVVQDRRNKFNEKRHLPKLNDPVHRLKEIAKDGIYCKRLEKEKILTVQDFLKALNKDPENLAKVLQIKKEHRN

SEQ ID NO: 25475 - DNA, 704 bp, Panicum virgatum
  misc_feature: Ceres CLONE 1863786
  misc_feature: Encodes the peptide sequence at SEQ ID NO. 25476
ctctcctcccaattccttcgcttctcgatttcacagcagcctttgcagccgagctgaatcgtctggttcaaatcatctcccctctctctctctctctctctctctctctctctctcgcagcctcccttgttggttggttggttttcgcctccgatccaaagggaagagagccatggcgctgatgacgctgcgttccaccacgtcgttcctgtcgcccgtcgaccccagctccaagctcctccacaagcccggcgccgacgacgcgccgccgagctgcgccgccgtgcccgccccgccccacgccgccgcgccgagccgcaggctgcgcctcgtcagggcgggcgccgccgcggcgcccgcgccggcggcggaccgcgcgccggccggggccgccgccgagctgctgcacgccggcggcgcgggccaggaccacgggcgcgcgcgcggcggggtccccgtctacgtgatgctgccgctggacacggtggggcccggcggtcagctgtcgcggcagcgcgcggtggcggcgagtctgatggcgctgcggggcgccggggtggagggcgtcatggtggacgtctggtggggcgtcgtggagcgggagggccccggccgctacgactgggaggcctacgccgagctcgtgcgcatggtggagcgcgccggcctgcggctccaggccgtcatgtccttcaccagtgcgg

SEQ ID NO: 25476 - protein, 177 aa, Panicum virgatum
  misc_feature: Ceres CLONE 1863786
  misc_feature: SWISSPROT Homolog: EC 3.2.1.2 Beta-amylase
MALMTLRSTTSFLSPVDPSSKLLHKPGADDAPPSCAAVPAPPHAAAPSRRLRLVRAGAAAAPAPAADRAPAGAAAELLHAGGAGQDHGRARGGVPVYVMLPLDTVGPGGQLSRQRAVAASLMALRGAGVEGVMVDVWWGVVEREGPGRYDWEAYAELVRMVERAGLRLQAVMSFTSA

SEQ ID NO: 25477 - DNA, 471 bp, Panicum virgatum
  misc_feature: Ceres CLONE 1863805
  misc_feature: Encodes the peptide sequence at SEQ ID NO. 25478
gtaccctctccctgtaccaccaccaccacgcgacacaccactgtaccctctccctgtaccaccaccaccacacaggcccaaacaaccaaccccaacaaccacaagggagccttggtgctctcgcacgcgagctccatcgcccgggacgccgatgccgtggtccccgcccccttccccccccgcgctacgtgcgcgagcacctgccgcggtgacgcccgccggcccgggcacggtttcgcttgtgccgccgccgctgctgatctgacctggtgcgtgctctgttctgtccccccccccccccccccctcctcgctgcaggtaccggatgccggagcggtcgatcccgcgggaggcggcgtaccagatcatcaacgacgagctgatgctggacggcaacccgcggctgaacctggcgtccttcgtcaccacctggatggagcccgagtgcaacaagctcatcatggggtccat

SEQ ID NO: 25478 - protein, 48 aa, Panicum virgatum
  misc_feature: Ceres CLONE 1863805
  misc_feature: SWISSPROT Homolog: EC 4.1.1.15 Glutamate decarboxylase
  misc_feature: Useful for making plants with modulated nitrogen use efficiency
MPERSIPREAAYQIINDELMLDGNPRLNLASFVTTWMEPECNKLIMGS

SEQ ID NO: 25479 - DNA, 3075 bp, Panicum virgatum
  misc_feature: Ceres CLONE 1863815
  misc_feature: Encodes the peptide sequence at SEQ ID NO. 25480
gcccgttacgctgccggggccgctgccgcgctgctccgctccgtcgccatcttcctcccgactccaccgccgcttcccggtcgccggcgcgcgccttgcttagctcccgtaccctcgcctccaccggtcagggcatcctcctcctccgtcgagatccgcgaggccacggcgcccccgcctcgtcggcccctcagatccgcaggtgctcctcccccgccgcggcctcgacccgccaccgccgcgccggcgccgcagccgctcgctggtggcgatccgccgcccggagctcctcgtcgcgccgtctccagcttctaatattctactacagtactattagtgaagcaagcttgggtagcattctggtgtctacttcattcttgtgcctgccaatataagccactggagcgaaggatgtgtgaaattaacccaatgaaataaaggctcccatattggtccaagcattcgcctatcaaacttcacaatgctggaaatttttctcaggaacacctatatggtgttcttgtcatctactgctgtgtttctgtgctatggaaatttgaagagcgctgatgtcacttgtagtgttctctaaatttggaccatggagcatgcaccacttagtagaaggtttccaactaatcccaatgaatataagttatatgaggaaattggagaaggtgttagtgccacagtataccgagctctttgtgtcccacttgacattatggttgccatcaaagctctggaccttgagaaatgcaacaatgacctggatgggataagacgggaagtgcaaacaatgagtttgcttgaccacccaaaccttcttcgtgcatattgctcatttacaaatgggcatcagctttgggttgtgatgccttacatggctgctggatccgctctccacattatgaaaacttcttttccagaagggtttgatgagccggtcattgctactctgttgcgcgaagttctgaaagctctcgtctatctacattctcaaggacttattcatagagatgtaaaggctggaaatatcttaatagatacaaatggagctgtgaagctaggagactttggagtgtcagcctgcatgttcgatactggaaataggcaaagggcaagaaatacatttgtagggacgccttgctggatggctcccgaagtcatgcaacaattgcatggttatgattacaaagctgacatatggtcctttgggattacggcattagaacttgcacatggtcacgctcctttttcaaaataccccccaatgaaggtgttgcttatgaccttgcaaaatgcaccaccaggtctagactacgagagggacaagcgtttttcaaagtctttcaaggatttggttgcgacatgcttagtcaaggatccacgcaagcgtcctccttcagaaaagctcttgaagcattcgttctttaagcaggctcgctcagctgaatatctggcacggagtattcttgatggcctccctccactgggtgaacgctttagggaactgaagagcaaagaagctgagttgcttctcaataacaagcttggtcaagagagcaaggagcagctatcacagaaagagtacatacgaggcattagtggttggaacttcaatctagaggacttgaaaaatgcagctgcccttatagacagttcgaatggcacttgtcatttagatgtcagggataacaaagttaaagatgactcacaagatgcttacaatgatccaaaacatatttaccaggaaagggtcgaccatgttgcttcagaaaggcctgaagaggatgagatacaagaagtcgaagagttgaatgatgctctctcctcttcttttccaagccgcccacttgaggcactaaaatcttgttttgatgtttgtggtgctgatgatcatggccctactgcttctgattcgagagtgcaaccaagtgttggattggtacctttcctgcagttcccgaaaatcgagcattgtaaaagtgccaactgcaatggtgaaactttggaaagaagtgtttctgtacccatgaatcttggcactagtggaaaccacaaacattcaagtggttctcttatacccgagcaagttctttctccttacatgaatgctgatttggaaagggatgaatttcgtcagaaaaatccaagcatcaggaaccgtagtggcccgttattgttccgccaaatgaaggattcacgcacacatctatctgttgcacctgaggagccatcagaaggaaaatttatccgtcgaaggggacgtttccaggttatgtcagatagtatttctcaaaaggcagctacatcagcctgcagcagcagcagcaggtcaaatctaccaattggagcaacacgctcaaatctcaagccgtctgcaattcttccaacattgcagtttttgatgcagcaaaatactatgcaaaaggaagtattaagtcggctgatttcttcgattgaggaaacatctgatgattctgaagcaagtactagtgtttcatatcagtcttctggagggcctggcagagagaaggaattgcagtcgtatgttgtccaattgcagcgaagcatcactgaactcgctgacgaagttcaaagattaaagctccgaaacaatcagcttgaacagcagatcaatgcattgtcaaaaaaagatgaaaggcctcaaacagaggataaccaacgatgatgacatgccccttctaccccccgctgtataattcaaatccccaattttgcgcttgtttagaaaattatttgtattttggtctgccttcagggtcgcggtatcattgtaagttgtaagtatttagcaaaggtgaaatcatagtaattttgatttgtacagctttatttcgtttaccggggaggaacagtttttctttcttttaaggtaatgtgtcgataatgtttagtgaatagtttgtgaaagttcatttgaacatcgagcattatgtttgtgtggagttggttgtaggtagtatagtacttgcgctggcacctcgcagtggtgttgggtccgatcatagccagaactattctcaattttattccctatttattattctg

SEQ ID NO: 25480 - protein, 697 aa, Panicum virgatum
  misc_feature: Ceres CLONE 1863815
  misc_feature (17)..(278): Pfam Name: Pkinase Pfam Description: Protein kinase domain
  misc_feature: SWISSPROT Homolog: EC 2.7.11.1 Non-specific serine/threonine protein kinase
MEHAPLSRRFPTNPNEYKLYEEIGEGVSATVYRALCVPLDIMVAIKALDLEKCNNDLDGIRREVQTMSLLDHPNLLRAYCSFTNGHQLWVVMPYMAAGSALHIMKTSFPEGFDEPVIATLLREVLKALVYLHSQGLIHRDVKAGNILIDTNGAVKLGDFGVSACMFDTGNRQRARNTFVGTPCWMAPEVMQQLHGYDYKADIWSFGITALELAHGHAPFSKYPPMKVLLMTLQNAPPGLDYERDKRFSKSFKDLVATCLVKDPRKRPPSEKLLKHSFFKQARSAEYLARSILDGLPPLGERFRELKSKEAELLLNNKLGQESKEQLSQKEYIRGISGWNFNLEDLKNAAALIDSSNGTCHLDVRDNKVKDDSQDAYNDPKHIYQERVDHVASERPEEDEIQEVEELNDALSSSFPSRPLEALKSCFDVCGADDHGPTASDSRVQPSVGLVPFLQFPKIEHCKSANCNGETLERSVSVPMNLGTSGNHKHSSGSLIPEQVLSPYMNADLERDEFRQKNPSIRNRSGPLLFRQMKDSRTHLSVAPEEPSEGKFIRRRGRFQVMSDSISQKAATSACSSSSRSNLPIGATRSNLKPSAILPTLQFLMQQNTMQKEVLSRLISSIEETSDDSEASTSVSYQSSGGPGREKELQSYVVQLQRSITELADEVQRLKLRNNQLEQQINALSKKDERPQTEDNQR

SEQ ID NO: 25481 - DNA, 1297 bp, Panicum virgatum
  misc_feature: Ceres CLONE 1863823
  misc_feature: Encodes the peptide sequence at SEQ ID NO. 25482
gacggacctgctctgttccctggcccccaggctctccctcccctgaccgcggcggcgcggcgcatccgaacgcgcctcggtctagaattccatcctgggcagtctgcacccgcaaccacgtctctcatccaccttccgccgccgccattctcatctcccccgcactgtcgtggaacgggatccatctggactcgaaatttcctctctctcgctgattaggtttttaaattggctgaaataaaattctttgcccgacggatataacaaggcctacctgagaaggaggtgctcttgtgcaaggcgaaaagttgctttctgtttttgccttgttggtctctttgcagctgcagggacagggacagtaaacactttagtgggggacactatcagtatatcttccttttgctgttgcaggggttgtacctttggtgttaactatttgtacggtgtgcagagtttaggctaagtaacagaatgcagatattcatttatcctttgcagtaggagaaatgttaaattctcccatgtcgtttacaatttatgctcattttattctgttattaacaatttgagttagtgtgcagattaggccataggaagcggttgggattagtgttattttgcaagaactccagacctgttatgtcttgggactgcaggtctgagtagctgctccttttttgggcagttaacctctgttcaaaatgaatgggtaaatatgcttgatgctaatgtgttggtaatattgtaaactaaatacagttcatggacatagttgaacttactttgctgatgatattttctcttttgtcatcttcacatgtgtggtgacaacatcacttgaagcatatcttgtgttgatgtcactgatatcttgtgttattacattgtccatcaatactgcaaagaccaattaaagtttggggggctttcatgtatcagggagcaatccgctgcatttagagggttaatgatctgttaacatattctctgcaggcttctaatcagttggacctattctgaatcatggcggagcacttggcttcgatatttggtacagagaaagacagagtcaattgcccattttacttcaagattggggcttgccgtcatggtgatcgttgctcccgtctccataacaggccaaccatatcaccgactcttgtgctggttaacatgtatcaacgccctgacatgatcacccctggggttgatgctcaaggccagccaattgatcctcgcaagatgcaggagcattttgaagatttttatgaggatatctttgaagaactgagca

SEQ ID NO: 25482 - protein, 90 aa, Panicum virgatum
  misc_feature: Ceres CLONE 1863823
  misc_feature (13)..(39): Pfam Name: zf-CCCH Pfam Description: Zinc finger C-x8-C-x5-C-x3-H type (and similar)
MAEHLASIFGTEKDRVNCPFYFKIGACRHGDRCSRLHNRPTISPTLVLVNMYQRPDMITPGVDAQGQPIDPRKMQEHFEDFYEDIFEELS

SEQ ID NO: 25483 - DNA, 593 bp, Panicum virgatum
  misc_feature: Ceres CLONE 1863823-R
cattacaggagaccaaacaggggaaggagccgcagccctagcccacatcacaggagggagcgtcgtgaccgagatgattaccgtggcggcggtggccgtggccgtgatgactaccatggtggcggtggtcgtggccgtgatgactaccatggtggcggcggtgggcgcaggggtggaggcagcaggtctgaaaggtacgatgatggagggaggcgcaggcatgatggcagcccccctcccaggcgtgcaagaagccctgtcagggagagcagtgaggagcgcagggctaagattgagcagtggaaccgtgagagggaggaaaaacaagggtgagcattgctagtgcctagtgcccttcaaggcaggcaaggcagacattaagttgtcgaaatgtttactggtagtgccgttctatgctgtgtgtgcctgtgtggcctgtgggagattgctatgttgtcagaattgtgttagtttgatgatgcgaagtgtagggcaaggattctaatttattttgcccattaagactcggaaactgccatttgtgtgttgcaaaaaacattgttgtttggcgcttgtgcgtttcacacaattct

SEQ ID NO: 25484 - DNA, 2087 bp, Panicum virgatum
  misc_feature: Ceres CLONE 1863829
  misc_feature: Encodes the peptide sequence at SEQ ID NO. 25485
gtatgagactttgaacaatctacccaactactgaattttgcccaagcttcgctttctcgctagtcgctcccgctcccgctcccgctcgctcgccgacagcgccgccgcccagatggctgctgcgccggaggagcgcctcgatgtcctcaacgccgccggggagaagaccggcgtctccaagccaaggtcggaggtgcacagggacggcgactaccaccgggcggtgcacgtgtggatctacagcgagagtaccggggagcttctgctgcagcgccgcgccgactgcaaggactcgtggcctgggaagtgggacatctctagcgccggccacatctccgccggcgactcctcgctcttctccgcacagagggagctcgaggaagaactaggcatcaagcttccagtcaatgccttcgagatattatttgtatttcttgaggaatgtgttacaaacaatgggacattcataaacaatgagtacagtgatgtttaccttgtgactactttaactccaattccacttgaggccttcactctccaagaaagtgaagtatctgcagttaggtatatgcgttgtgatgagtacaagagctgccttgcaaaagaaagtggagaatatgttccttatgatgtgaatgggcaatatggccaactttttaatatcattgaagaaaggtacaaagacaatacagtatcccgcagtttaactttacaaaagcaaatcaaccgttatgctcccatccatttggaaccagatttgactactctatctgaaggagacagggaagccttgggatatattcttaaagcagcaatagttattgatgacatattttatgagcaggtatggaatagcaacagaacgcttagagactggctgaaaggacattcggaatcctcagcctttgataaattgaagtgggcatattattctattaataagagtccctggtcctgcctcgatgaaaataaggcttttctatcgactgcagattctgctgtgaaattactcacagatgccaccaagccagtttcaggatggaagggggttgagtatcgtgcagcatttcctctagataagcctcctggtgctaacttctatcctcctgatatggacaaaatggagtttgaactttggaagagcagactgactgataaagaacaaaaagatgccgctgggttttttaccatcataaaacggcatgactctctatcctctccatcattaaaacagtcagatggatcagaccaaaccaaaacttcagatgatctttttatagttccatactccaaggagtacagatcatcccttgagaaagcagctgaacttcttgagaaagcatcagtgtgctctaattctccaagcctcaagaacttgctgagaaccaaggcaaacgctttcctctcaaatgattactatgaatctgatatagcttggatggagttggactccaacttagatgtcacaattggcccatatgaaacatatgaagatggcctatttagttataaggcaactttcgaagcatttgttggaatacgcgacgacacagctacttctcaagttaaactctttggcgaccagctccaggatttggagagaaaccttccgatggacaatattttcaaatcagacagcgtatctgctgctccaattcgtgtgataaatcttctctacaattctggggatgtgaaaggtccacaaaccattgctttcaatttgcccaatgatgaacggattgtgaatgaacgaggaacttccatggttatgcttaaaaacatttcagaagccaagttcaagcatatcttaaagcctatagctgatacctgcatcagagaggagcagaaggaatatgttaatttcgagccttattatacacatattgtttgccatgagtgctgccatggaattggacctcattctattacccttccgagtggtaaaaagtcaacagtaagattggaacttcaagaattccattcagcattggaggaggcaaaagctgatatagttggtctctgggcactgaatttccttattaagaagggattgctttcctaagagcctatcacaatccatgtatgtc

SEQ ID NO: 25485 - protein, 649 aa, Panicum virgatum
  misc_feature: Ceres CLONE 1863829
  misc_feature (34)..(176): Pfam Name: NUDIX Pfam Description: NUDIX domain
  misc_feature: SWISSPROT Homolog: EC 5.3.3.2 Isopentenyl-diphosphate Delta-isomerase
MAAAPEERLDVLNAAGEKTGVSKPRSEVHRDGDYHRAVHVWIYSESTGELLLQRRADCKDSWPGKWDISSAGHISAGDSSLFSAQRELEEELGIKLPVNAFEILFVFLEECVTNNGTFINNEYSDVYLVTTLTPIPLEAFTLQESEVSAVRYMRCDEYKSCLAKESGEYVPYDVNGQYGQLFNIIEERYKDNTVSRSLTLQKQINRYAPIHLEPDLTTLSEGDREALGYILKAAIVIDDIFYEQVWNSNRTLRDWLKGHSESSAFDKLKWAYYSINKSPWSCLDENKAFLSTADSAVKLLTDATKPVSGWKGVEYRAAFPLDKPPGANFYPPDMDKMEFELWKSRLTDKEQKDAAGFFTIIKRHDSLSSPSLKQSDGSDQTKTSDDLFIVPYSKEYRSSLEKAAELLEKASVCSNSPSLKNLLRTKANAFLSNDYYESDIAWMELDSNLDVTIGPYETYEDGLFSYKATFEAFVGIRDDTATSQVKLFGDQLQDLERNLPMDNIFKSDSVSAAPIRVINLLYNSGDVKGPQTIAFNLPNDERIVNERGTSMVMLKNISEAKFKHILKPIADTCIREEQKEYVNFEPYYTHIVCHECCHGIGPHSITLPSGKKSTVRLELQEFHSALEEAKADIVGLWALNFLIKKGLLS

SEQ ID NO: 25486 - DNA, 1392 bp, Panicum virgatum
  misc_feature: Ceres CLONE 1863837
  misc_feature: Encodes the peptide sequence at SEQ ID NO. 25487
aagcgaactcgagcaaggttttagggaggccgccgacggccatggcggcgcggctgctacggagaacgctgcgagcaaccgaggtagcacctcgatttctatctcatggtgtggtacagcgagctgcatacacctctggaggaatagtcgatattggacaaccgacgccccagtcacaccctgagttattagctgatggagagatcacaccaggcatcacaaatgaggagtacatctctagaagaaaaaagcttttggaggtgctgccagaaaagagcttggccattattgcctctgctgatcagcagatgatgaccgatgttgtgccatatccattcagacagaatggtgattacctgtacattactggctgtacgcaacctggtggcatagcagttttgagtgaagaaaccggactatgcatgttcatgcctgataaaaataaggaggatgtagtttggcaaggtcaaactgctggagttgaggcagctgtggaattctttaaagcggataaagcatttccacttagtcagatgcaaaagatccttcctgaaatgatcgagcggtcaaagggggtatatcacaatgtgaaggcatcgtcatcttcttacaagaacttggatgccttccgtcgggcatcactcaacaataaagtaaaagatcttgcatgttacaccgatgaattacggtggatcaagtcaaaatctgaaattaagttgatgagggaatcggcatctattgtttctcagtcacttctacaaacaatgttgctatcgaggacccgcagggaggaaaaccagctggcagctaagattgaatatgagtgcaaaatgagaggtgcccaaagaatggcgttccatcctgtagttggtggaggtgcgaatggcagcgttatacactactcaagaaacgatagaaaaatcaaagcaggtgatcttctgctcatggatgttggctgtgagtatcatggctaccttagcgacctgactcgaacatggccaccctgtggcaggttttcacctgctcaggaagagctgtacagcctaatactggagacgaataaggagtgcataaagctctgtaaaccaggtgccagcataaacgagatacacaatcattcagtgaagatgctgataaagggattccaggagctgggggtcctggagaaggggaaatccatccaatacaactacctgaacccgaccgcgataggtcactcgttaggcatggacattcatgactcggtgacactccccaaggacaagcccttggagcccggcgtggtaagtagcctttcggtgccctctcttagtctcttcctccctcctaccctagttattctgcttcccgtccacttacgtcggttttgcactggatcttcgtacactaatc

SEQ ID NO: 25487 - protein, 450 aa, Panicum virgatum
  misc_feature: Ceres CLONE 1863837
  misc_feature (59)..(190): Pfam Name: AMP_N Pfam Description: Aminopeptidase P, N-terminal domain
  misc_feature (225)..(437): Pfam Name: Peptidase_M24 Pfam Description: metallopeptidase family M24
MAARLLRRTLRATEVAPRFLSHGVVQRAAYTSGGIVDIGQPTPQSHPELLADGEITPGITNEEYISRRKKLLEVLPEKSLAIIASADQQMMTDVVPYPFRQNGDYLYITGCTQPGGIAVLSEETGLCMFMPDKNKEDVVWQGQTAGVEAAVEFFKADKAFPLSQMQKILPEMIERSKGVYHNVKASSSSYKNLDAFRRASLNNKVKDLACYTDELRWIKSKSEIKLMRESASIVSQSLLQTMLLSRTRREENQLAAKIEYECKMRGAQRMAFHPVVGGGANGSVIHYSRNDRKIKAGDLLLMDVGCEYHGYLSDLTRTWPPCGRFSPAQEELYSLILETNKECIKLCKPGASINEIHNHSVKMLIKGFQELGVLEKGKSIQYNYLNPTAIGHSLGMDIHDSVTLPKDKPLEPGVVSSLSVPSLSLFLPPTLVILLPVHLRRFCTGSSYTN

SEQ ID NO: 25488 - DNA, 228 bp, Panicum virgatum
  misc_feature: Ceres CLONE 1863837-R
accatattcaaccccacccaaaattaatatatttagatacacaactccacccaacccaattagttaatttctcaactctaaccaacccgccccattataagcgggtaacccataaaaactcatgggttctactatgtagaggaatttagtggttctacacttaatgtggggaccacatatatgtctagccacactactttacacagtatctgtcagtcatattgactc

SEQ ID NO: 25489 - DNA, 701 bp, Panicum virgatum
  misc_feature: Ceres CLONE 1863850
  misc_feature: Encodes the peptide sequence at SEQ ID NO. 25490
gaccccaggccgagaaaatcgacagcctgggtttgctgcctggctcaggcagctgatcggaggcaagaaccaaacaagccctacctgcaccggctcccccatcccatccaccacctcctcctcctcgtcctcctgctgctcggccctgagctgaccgcgacgggagggcgctgagctaccgagacagctccccggtcggctcggctcgggtcaacgcgtgccgcgtgctcggcgaagggcggaggaggagagggagggctcccccgcggtgatgccggcgctgctgggtacctaggtagctcgccgcggcggcgatggaggggacgaagcgcggcggggggggaggcggcgggccggtggctgcggtggcgctgtggctgctggtcggcgtctcgctgagccgcggcgcggcggggctcaatgccgacggggcgctgctcatgtccttcagggccgcggtcaccgcggacccgctgggcgcgctggccgggtggggctacgacgccgcggagccctgcgcctggaacggcgtcgtctgcaagggctacccgcagcccgacgccgccgtcaacgtgacctcggcctccgccaccgacggcgccggcgccaactcgacggcggccgcgtggaacggcaccgcggcggcgggcgcgggcggcctcaacgcgtccctggcggcggccacggtgtcgcgggtcatc

SEQ ID NO: 25490 - protein, 128 aa, Panicum virgatum
  misc_feature: Ceres CLONE 1863850
  misc_feature (35)..(76): Pfam Name: LRRNT_2 Pfam Description: Leucine rich repeat N-terminal domain
MEGTKRGGGGGGGPVAAVALWLLVGVSLSRGAAGLNADGALLMSFRAAVTADPLGALAGWGYDAAEPCAWNGVVCKGYPQPDAAVNVTSASATDGAGANSTAAAWNGTAAAGAGGLNASLAAATVSRV

SEQ ID NO: 25491 - DNA, 661 bp, Panicum virgatum
  misc_feature: Ceres CLONE 1863873
  misc_feature: Encodes the peptide sequence at SEQ ID NO. 25492
attctctcgacccgaccagatcgctgactcgcaggccgcctctcctctgcctcctcctttcccctccacctcctctacggtgtacggctccgacgagatggccgccccgctccggcggagcctcccttccctcggccgcgcgctcctctcgccggcgccggtgcggatggtctccgcggaggcctccgacgccctggtcgagatcaaaccgggggagatcgggatggtctccggcatccccgaggagcacctccgccgtaaggttgtaatttattcacctgctaggactgcatcccagcaaggttcaggcaaagtcgggaggtggaaaattaactttttgtcaacccaaaagtgggagaacccgttgatggggtggacatctactggggatccatatgctaatgttggtgaagcaggacttgcgttcgacagtgcggagtcagcaaaggcatttgctgaaaaacatggatggaattatgtggttcggaaacgccatacacctcttttgaaggtctgtatgtctcacctcatatccttaattgactttgttagcttttcttttaccatgcatatagatcttacaatgtttgtcttggtgcatcttcttgaatgcttatcttgcagctctatattgttgacaggcatctttctttctttcttt

SEQ ID NO: 25492 - protein, 187 aa, Panicum virgatum
  misc_feature: Ceres CLONE 1863873
  misc_feature (54)..(163): Pfam Name: ETC_C1_NDUFA4 Pfam Description: ETC complex I subunit conserved region
MAAPLRRSLPSLGRALLSPAPVRMVSAEASDALVEIKPGEIGMVSGIPEEHLRRKVVIYSPARTASQQGSGKVGRWKINFLSTQKWENPLMGWTSTGDPYANVGEAGLAFDSAESAKAFAEKHGWNYVVRKRHTPLLKVCMSHLISLIDFVSFSFTMHIDLTMFVLVHLLECLSCSSILLTGIFLSF

SEQ ID NO: 25493 - DNA, 516 bp, Panicum virgatum
  misc_feature: Ceres CLONE 1863909
  misc_feature: Encodes the peptide sequence at SEQ ID NO. 25494
atctcggatgctgtcaaagattctctttgcatctctctcactcaatctcacttcccgacacccgcacgcgctccctccgctgatccatccactcgctctcgctccccacccagccgaagccaagccgcgcacgcccacgccgcccatggacgcgaacgcgagcgggccgccgctgctcctggccgctgcggccgcgctgctcctcgccgcggccgcgctggggtggcacctcgccgcgcggccggcgccgggcagcacggggctgccgctcgccggggagacgctgcgcctcgtctgcgcctacaagacccccaacccggagcccttcatcgacgaccgcgtggcgcgccacggtagcggcgtcttccccacccacgtcttcggtgagcgcaccgccttctccgccgacccggccttccaccgcctcccccacgtcgccgagggccgcgccgtcggctgcacctacccgtcctccatcgacacgctgctcagcccgcactcgctgatcctcaccag

SEQ ID NO: 25494 - protein, 123 aa, Panicum virgatum
  misc_feature: Ceres CLONE 1863909
  misc_feature: SWISSPROT Homolog: EC 1.14.13.77 Taxane 13-alpha-hydroxylase
MDANASGPPLLLAAAAALLLAAAALGWHLAARPAPGSTGLPLAGETLRLVCAYKTPNPEPFIDDRVARHGSGVFPTHVFGERTAFSADPAFHRLPHVAEGRAVGCTYPSSIDTLLSPHSLILT

SEQ ID NO: 25495 - DNA, 1388 bp, Panicum virgatum
  misc_feature: Ceres CLONE 1863920
  misc_feature: Encodes the peptide sequence at SEQ ID NO. 25496
acctgattgccaacccgcgccggcggggcagctagcactgccgagaacaagttgaggaagttggccagaacccagtagcgcggcgaggcctcaaaactcgatgccgggcactcccagccatggcgagcaagcctaacaacttcaccattccgttcctcgccgccgctacggagcacggaggccagagagacatgcccgtgcgcgcgccgacaccctcgcctcccgtgcgccgccccacgggcagtgcgagtacggcacgccatacacttgattgatgattggtgaacacaccagtccgtgaaccatgtccacggcgtgtcctgctccgacgcccgatcccgcacccacctcggcctctagctgccaccggccctgctgcgcctctgctacaaagcgagaaagcgcacggcgcgaactcccccaattccccggacgccagcaggccacgccgctacgctccgctcccccccagccggcagccgcccgatccgtcctatccagcgggcggcggccatgggattcgacaaggaggcgagctcctcgtcctcgcggctcgacgcggcggcgccgctgctcccgcagcacggcggcgcgggcgggcacctgacgtcgcagcccaagacgttcgccaacgtcttcatcgcggtggtcggctcgggcgtgctgggcctcccctacaccttctcccgcacgggctgggcggcggggacgctgctcctcctcgccgtcgccgcgctcaccttccactgcatgatgctgctcgtcgccgcgcgccgccggatcgccgacgagcaccccaagatcgcctctttcggggacctgggccacgccgtctacggcgcgcccgggaggcacgccgtcgacgccatgctcgtgctcagccaggccagcttctgcgtcggctacctcatcttcatctccaacaccatggcgcacctctaccccatcggggctggctccccggactccccgctcctcaccgccaaggcgctcttcatctgggccatgctaccgttccagctcggcctcaactccatcaagacgctcacgctcctcgcgccgctcagcatcttcgccgacgtcgtcgacctcggcgccatgggcgtcgtcctgggccaggacgcctccatctggctcgccaacaagccccccgtgttcgccttcgccggccccgccgagatcctctacgggctcggcgtcgccgtctacgccttcgaggggatcggcatggtcctgccgctggaggcggaggccgcggacaagcgcaggttcggcgccacgctctcgctgtccatggcgttcatcgccgtcatgtacgggctgttcggagcgatgggctacctcgcgttcggcgccgccacgcgggacatcatcaccaccaacctcgg

SEQ ID NO: 25496 - protein, 291 aa, Panicum virgatum
  misc_feature: Ceres CLONE 1863920
  misc_feature (30)..(291): Pfam Name: Aa_trans Pfam Description: Transmembrane amino acid transporter protein
  misc_feature: Useful for making plants with modulated nitrogen use efficiency
MGFDKEASSSSSRLDAAAPLLPQHGGAGGHLTSQPKTFANVFIAVVGSGVLGLPYTFSRTGWAAGTLLLLAVAALTFHCMMLLVAARRRIADEHPKIASFGDLGHAVYGAPGRHAVDAMLVLSQASFCVGYLIFISNTMAHLYPIGAGSPDSPLLTAKALFIWAMLPFQLGLNSIKTLTLLAPLSIFADVVDLGAMGVVLGQDASIWLANKPPVFAFAGPAEILYGLGVAVYAFEGIGMVLPLEAEAADKRRFGATLSLSMAFIAVMYGLFGAMGYLAFGAATRDIITTNL

SEQ ID NO: 25497 - DNA, 653 bp, Panicum virgatum
  misc_feature: Ceres CLONE 1863920-R
  misc_feature: Encodes the peptide sequence at SEQ ID NO. 25498
gccgagcgcttgctctgcggcaagcgctacgcctggtggctgcgctggatcctcgtcgtggtcgtcgggctcctggcgatgctagtgcccaatttcgccgacttcctctcgctcgtcgggagcagcgtctgcgtcgtgctcgggttcgtgctgcccgccgtgttccacctcaaggtgttcggctccgagatcgggtgggcggcgctcgttgccgacgttgccgtcatcgtcatcggggttgcgcttgcggtgtctgggacatggacatcgctcgttcaaatcttcgcttcttcttccaatgtgtaagcattgacagcttctcatcttgtaaatggatcatgccttgctactgcatggggaacgctcgattgtacattgattcgagaagattgaggcccaattcagctgccatgttgatctgggcatacttgcagtgcttcaaaatatgcgatggcatacgcaattgaaatctatataagcttttgttcaggtataggttccaattgtaactctgtagcatgtccatgtgtgtatatcctatgtgaccttgaaagagaaaaaagaaagaaagaggaatcaaatggatgcatgtaaaaatgcacgagtagcatgttatgactttattaaaaagagttgtaatagtgtgtttcagt

SEQ ID NO: 25498 - protein, 101 aa, Panicum virgatum
  misc_feature: Ceres CLONE 1863920-R
  misc_feature: Useful for making plants with modulated nitrogen use efficiency
AERLLCGKRYAWWLRWILVVVVGLLAMLVPNFADFLSLVGSSVCVVLGFVLPAVFHLKVFGSEIGWAALVADVAVIVIGVALAVSGTWTSLVQIFASSSNV

SEQ ID NO: 25499 - DNA, 641 bp, Panicum virgatum
  misc_feature: Ceres CLONE 1863931
  misc_feature: Encodes the peptide sequence at SEQ ID NO. 25500
cgtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcgggcggcggtggcggcggcggctacggcggcggtcgtcagggtggctacggcggcggcggcggcggctacggaggcggtggtggccttgcaccacctcctctcctggtggcgcctgcaggccccccggctgcccccgggcccgacgagcctcccggtgatcgggcacctccacctgctccggccgccggtccaccgcaccttccaggagctggcgtcccgcgtgggcccgctgatccacatccgcctgggctccacgcactgcgtggtggccagcaccgccgaggtggccggcgagctgat

SEQ ID NO: 25500 - protein, 139 aa, Panicum virgatum
  misc_feature: Ceres CLONE 1863931
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MAAADVEYRCFVGGLAWATDNASLQQAFASYGDVLDSKVITDRETGRSRGFGFVTFSSEQSMLDAIEAMNGKDLDGRNITVNQAQSRGRRWRRRLRRRSSGWLRRRRRRLRRRWWPCTTSSPGGACRPPGCPRARRASR

SEQ ID NO: 25501 - DNA, 1614 bp, Panicum virgatum
  misc_feature: Ceres CLONE 1863940
  misc_feature: Encodes the peptide sequence at SEQ ID NO. 25502
ctctagttccgcccgcccaagcccaccaccgaagctgccgagctttgcttccagcactcatccgctcgatccgtaccaacaaacaaaacgaactcagactcgatctctcacacgttactaatcgcctgctcgctagctatagctcacctcaccatgcaggcgcagtcccgcctcggcgtgatgagcggcggcggcggcagcatgtcggcgtcggagggcgagcacgaggcggtgatccgcgagctgacgcgcgggcggcagctgacggcgcggctgcgggcggaggccctgcgcgcgctgcgcgggcagggccaggccgaggccaccgccgcattaatcctgcaggaggtgtcccgcgccttcactgtctgcctcaacatcatgggctcgcccgccggcgccccgccgcccccgcctgaaatgcccactgggctgggcgccgtcgtggacgccgccgcggccgcgccttccctgctcggcccgccgcgccggagccgggaggacagcatccccagacagcagacggtgacaccctcgccgcactacgacgggtaccagtggaggaagtacggccagaagaggatcaccaacacgcgctacccaaggtgctactacaggtgcagcttccaccgcgagcgcggctgccgcgccaccaagcaggtgcagcagtgcagcggcggcgaccagccccagtacctcgtcctgtacttcaacgaccacacgtgcgacacggcggcggcccgggagcccgaggcggcggcgacgacgcggctcgacctgctgcgcggggccgccctgctggcgccgcgccgcggcggcctgctggacgaacgcggcgtccaggaggagcacgagcgccaggtgctcgtctcgtcgctcgcgcgcgtgctggggggccagcaccagttccaccagcaggctcctcccgcacctgatgctgcggcggcggccaccagcgccgccgtcgccgtcagcgtggagccggcgccggtcgttgacgcggcttcggggatgccgcggattgacgtggacgtggtggggctggatgtcatggactacgacgacgtggcgggcgagctgtgcttcggctattcctacggcctacctggcggcggcggcttgttgccgttttgagggcgcaggcggcggcgccaactattctcgcgcaacgcgggttggtcagagtgtcagactcgggagggttcagagacttcagaccaggcccgacgacggatcactgaatcttcggtgtacagtgatctgcaatgactactgctgctacagatacacgtttgggcataccgtgtcgtagaaaagtactgtaattagtgcaagagttaagttatagtacttgcactagagtacgaccgggggttgcgtctctccagtttaagttttggtcaggctggcgtgattaatttcgcacgtgcttttgtgtctcatcaaccagcacgtagtagtatacccgtttcatgtcaagtagtagttctttatcgtttggctataatttttttttttttttgcaatgttttacatgcaccgctacgggcaaaagaaaaggtataccagcatatatatgcataatcttaaaccttgtcaattttgttgccattc

SEQ ID NO: 25502 - protein, 326 aa, Panicum virgatum
  misc_feature: Ceres CLONE 1863940
  misc_feature (130)..(193): Pfam Name: WRKY Pfam Description: WRKY DNA -binding domain
MQAQSRLGVMSGGGGSMSASEGEHEAVIRELTRGRQLTARLRAEALRALRGQGQAEATAALILQEVSRAFTVCLNIMGSPAGAPPPPPEMPTGLGAVVDAAAAAPSLLGPPRRSREDSIPRQQTVTPSPHYDGYQWRKYGQKRITNTRYPRCYYRCSFHRERGCRATKQVQQCSGGDQPQYLVLYFNDHTCDTAAAREPEAAATTRLDLLRGAALLAPRRGGLLDERGVQEEHERQVLVSSLARVLGGQHQFHQQAPPAPDAAAAATSAAVAVSVEPAPVVDAASGMPRIDVDVVGLDVMDYDDVAGELCFGYSYGLPGGGGLLPF

SEQ ID NO: 25503 - DNA, 478 bp, Panicum virgatum
  misc_feature: Ceres CLONE 1863944
  misc_feature: Encodes the peptide sequence at SEQ ID NO. 25504
actggctcctgctgtcgtctgagaccggcttcgccgccatctgcaccgtcgtcccgcgtatggtcaatatggtcgaggactccacccactgcttgctccgcttcttcgtccccggaatggtggagagggatcggttctcgtggttccgggacgaggagttcgcgcggcagactctggcggggctcaacccggtgtgcatccagctggtcgccgagttcgccatcaggagcaagctcgacccggtggtgtacggcccggcggattccgccatcaccagggaggtcctcgagaagcagatgggcggcaacctcaccgtcgaggaggcgctggtggcgaatcagctcttcgtcctcgactaccacgacgtgttcctgccctacgtgcacagggtgcgggagcagcgggccgcgacgctctacggctcccgcaccgtcttcttcctcaccgacctgggcaccctcatgccgctggacatcga

SEQ ID NO: 25504 - protein, 158 aa, Panicum virgatum
  misc_feature: Ceres CLONE 1863944
  misc_feature: SWISSPROT Homolog: EC 1.13.11.12 Lipoxygenase
WLLLSSETGFAAICTVVPRMVNMVEDSTHCLLRFFVPGMVERDRFSWFRDEEFARQTLAGLNPVCIQLVAEFAIRSKLDPVVYGPADSAITREVLEKQMGGNLTVEEALVANQLFVLDYHDVFLPYVHRVREQRAATLYGSRTVFFLTDLGTLMPLDI

SEQ ID NO: 25505 - DNA, 686 bp, Panicum virgatum
  misc_feature: Ceres CLONE 1863952
  misc_feature: Encodes the peptide sequence at SEQ ID NO. 25506
cttttccgcgagcgccctcccagccgccaagccttcgagaaccctccggagctcgctcgatccgatcgcaccccgcgcgggctgccgccatggccgacgaggcgaaggccaagggtaatgcggcgttctccgccggccgctacgaggaggcggcgcggcacttctcggacgccatcgcgctcgccccgggcaaccacgtcctctactccaaccgctccgccgcgctcgcctcgctccaccgctactccgacgctctcgccgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaagaaggccgccgccgccgccgccccgccgcgccgcgggccgtccgggcccgacgccatcggccagatgttccagggccccgagctgtggaccaagatcgcggccgaccccaccacacgcgcctaccttgaccagcccgactttatgcagatgctgcgcgaggtgcagaggaacccaagcagcctcaacatgtacctctccgatccccgcatgatgcaggttctcagcctcatgcttaaacatcagatccagagatcc

SEQ ID NO: 25506 - protein, 198 aa, Panicum virgatum
  misc_feature: Ceres CLONE 1863952
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRYEEAARHFSDAIALAPGNHVLYSNRSAALASLHRYSDALADAQKTVELKPDWAKGYSRLGAAHLGLGDAASAVAAYEKGLALDPTNEGLKAGLEDAKKAAAAAAPPRRGPSGPDAIGQMFQGPELWTKIAADPTTRAYLDQPDFMQMLREVQRNPSSLNMYLSDPRMMQVLSLMLKHQIQR

SEQ ID NO: 25507 - DNA, 1825 bp, Panicum virgatum
  misc_feature: Ceres CLONE 1863953
  misc_feature: Encodes the peptide sequence at SEQ ID NO. 25508
gaggagagggagagcgggcaaggcgggacaggcagcgagtggagaggagacacagcccatccatcccttccctctctcctccctcttgcttgccatccacaccacaccaaagccaagaacccaactcatcgaaggcagagaccacaggcagcagggaaaaggcgacgaggggggaggagaaatcatggagccgatttgctgtggagattcggccgcgtgatccggtcggtcggatcttgctttcctggggggcgacggtgccatggtggtcgcctcctatatcctcctcctccccctccgcgctgcttcccccgagatgccgcattagccaccaacgcctcccagcgaagagacttcattctttcatcggtgtctagttcctgccgtgcgttccgcggccatgacggtggccgatgccgagttgcggttccacgtcctcgcggtggacgacagcctcatcgacaggaagctcatcgagatgctgctcaagaactcgtcctaccaagtgaccaccgtcgattccgggagcaaggccttggagctgctgggattgagggacgaggctgccgagtcatcatcgccttcctcctcccctgaccaccaggagattgctgtgaacctgatcatcactgactactgcatgccgggcatgacagggtatgatctgctgaggagggtgaaggggtcctcctcgttgaaggacattcctgtggtgatcatgtcgtctgagaacgtgccggcccggatcaacagtggtcaaaatttctacgcaaatagggaggggtatggccgtatgggaagcacgatcatgcgccggggctgcgctgagtcaaaagggctctgaaattcaagagactggatcttttccttgtggtagcaaagatctctgacaagtctgctgtgtccttggagtgatgtgatcactcgtctctgagcggagaaaccaaaggggggcaagaagaggatttttgtttccgcccttccacgcaatctgttttgcttccctcccattttgcgctaacgattggactgccttgccaaaaattccaggtgcttggaagatggcgcagaggagttcttcctgaaacccgtcaagctcgccgacatgaagaagctcaagtctcatctcctgaagaagaagcagcccaagaagtgtcagccgcagatacagccagagcccgaggacgaggagcggctggaggcaccgccacagccggcgcacaagccggaggcgcccgtggcacaagtgaccgctgacgcaacaacggcagccatcagcgactgcagcggcagcaacaagaggaaggcggcggccatggagcagcaggaggggctgacgtcgccggagagcaccaagccaaggatgtccaatagcagcctggcagtggagacctgaaaaggcaaccagaaacccctaccctactaagaaatttcttcttttgctgtttttttttgtggtggctaatcatgggatggatgagtcattagctccttggggggagggtggttttagctcgaagtgaaaaacaattacggcatacttatatagtagctgcttcggcctgcaaattttgttgtgctcaggaacaccctttgtgtgttcgttagaaagacgaaggggatggggaaaaaaggaagttgtagataaaggcagcgcctttggggtgctcttgtttaggctaattttaatttgatgatggcttattatgccactgactggctcaaaggctgtgtggcctgtgatgtgttttgcacaggtcgatggatcgagcaatcggttaatgtggctcatgtcttccttttactgataaaaactgttgtgttc

SEQ ID NO: 25508 - protein, 147 aa, Panicum virgatum
  misc_feature: Ceres CLONE 1863953
  misc_feature (10)..(117): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: Useful for making plants with modulated low light sensitivity
  misc_feature: Useful for making plants with modulated nitrogen use efficiency
  misc_feature: Useful for making plants with altered carotene content
  misc_feature: Useful for making plants with altered lignin content
  misc_feature: Useful for making plants with altered terpenoid content
MTVADAELRFHVLAVDDSLIDRKLIEMLLKNSSYQVTTVDSGSKALELLGLRDEAAESSSPSSSPDHQEIAVNLIITDYCMPGMTGYDLLRRVKGSSSLKDIPVVIMSSENVPARINSGQNFYANREGYGRMGSTIMRRGCAESKGL

SEQ ID NO: 25509 - DNA, 775 bp, Panicum virgatum
  misc_feature: Ceres CLONE 1863961
  misc_feature: Encodes the peptide sequence at SEQ ID NO. 25510
ggccaacccagagccccctcccctcccgtcgctgcgagctatcgcaatttgctattgcccgccagcgcagttgtgcaaccacagcgcaatccaatgcgagattaagccctacccttccttcgatccaacccgatgctcgcctactcgagcacatcgagaccatggccgcagcgccacccgtcgtcaccgagccaaggcgcgggcgccgccgcgcgccttgtggcgctggcggccaggagcaagcggtggggcgcgggcgccgcggcggcggagggggtggacgaggcggctgaggcggcagagctggtgcgctcgtttctgcggaggacgggcggcggcaaggagaggatggtcccggtactggaccggcacgtgcgggtggtccgcaccgagcactgcttcctcctcttcgaggagctcggccgccgcgacgcatggctccagtgtctcgaggttttcagatggatgcagaaacaaaggtggtatgttgctgacaatggcatctactccaagttaatatcagtaatgggaaggaaaggccagatacgtatggcaatgtggctgttctctcagatgcggaacagcgggtgcaagccagacacttctgtgtataactctcttatcggtgcgcatctgcattcccgagataagagtaaagctttggcgaaagctcttgggtattttgagaagatgaagtgtatagagagatgccaaccatcgattgtgacatacaaacattcttttagagcttttgctcaggctggtgatacaaagc

SEQ ID NO: 25510 - protein, 214 aa, Panicum virgatum
  misc_feature: Ceres CLONE 1863961
  misc_feature (123)..(157): Pfam Name: PPR Pfam Description: PPR repeat
MLAYSSTSRPWPQRHPSSPSQGAGAAARLVALAARSKRWGAGAAAAEGVDEAAEAAELVRSFLRRTGGGKERMVPVLDRHVRVVRTEHCFLLFEELGRRDAWLQCLEVFRWMQKQRWYVADNGIYSKLISVMGRKGQIRMAMWLFSQMRNSGCKPDTSVYNSLIGAHLHSRDKSKALAKALGYFEKMKCIERCQPSIVTYKHSFRAFAQAGDTK

SEQ ID NO: 25511 - DNA, 725 bp, Panicum virgatum
  misc_feature: Ceres CLONE 1863961-R
  misc_feature: Encodes the peptide sequence at SEQ ID NO. 25512
cgtcaaggaattgaatgtgaatttcaaggaggaactaataaattggtggacggttgctactcctttgagcagggtgctgccatcgctttaacacaaaaactagttatgattattgatgagcaattgaaattattatactcctgcaaaaatccatcaggagaggatgcatgtggcaccagttcatctgggtgcacttcagaaaaatcttcctctgctgtggattaagcaaagtttggatttgattttatacaacggagcaaccaaatcggcccactgttccacaacattgccctgcaacaatacatcctgctttgtgctcaggttctagagggaggattgagggataagcctggaaagaacagagatcactaccactcatgctactgcctcagtggcctttcagttagccagtacagtgccacgacagattatgattcatgccccttaccgcagcatgtgcttggcccatactccaatttgctggagcccatccatccactctacaatattgtactggataaataccatacggcctatgagttcttttcacaagagggatggtgtgaaattttagagcaaagttggatacggcaaatgtccgattgtattgtttgcacggatagtattggccccaagtattgtgacattacattacatttccggtatgcataccttactagtgttctatcaggtggtcagccccattatctggttttgatgatttc

SEQ ID NO: 25512 - protein, 74 aa, Panicum virgatum
  misc_feature: Ceres CLONE 1863961-R
  misc_feature: SWISSPROT Homolog: EC 2.5.1.58 Protein farnesyltransferase
  misc_feature: The sequence is a functional homolog of SEQ ID NO 12 in US patent 7109391
RQGIECEFQGGTNKLVDGCYSFEQGAAIALTQKLVMIIDEQLKLLYSCKNPSGEDACGTSSSGCTSEKSSSAVD

SEQ ID NO: 25513 - DNA, 608 bp, Panicum virgatum
  misc_feature: Ceres CLONE 1863964
  misc_feature: Encodes the peptide sequence at SEQ ID NO. 25514
ctcccaattccttcgcttctcgatttcacagcagcctttgcagccgagctgaatcgtctggttcaaatcatctcccctctctctctctctctctctctctctctctctctcgcagcctcccttgttggttggttggttttcgcctccgatccaaagggaagagagccatggcgctgatgacgctgcgttccaccacgtcgttcctgtcgcccgtcgaccccagctccaagctcctccacaagcccggcgccgacgacgcgccgccgagctgcgccgccgtgcccgccccgccccacgccgccgcgtcgagccgcaggctgcgccgcatatggtcggggaccaccgcatcaagaaggtgaagctgttcgacgccgaccagggcacgctcagcgcgctcgccggcagcggcatcgaggtcatggtcgccattcccaatgtcctgcttgacaggatcaccgactacgacaccgccaaggagtgggtacggcacaacgtctcgcgctacaacttcgacggcggcgtcaacatcaagtacgtggccgtgggcaacgagccgttcctggaggcgtacaacggcacgttcgacaaggtgaccttcccggcgctgc

SEQ ID NO: 25514 - protein, 93 aa, Panicum virgatum
  misc_feature: Ceres CLONE 1863964
  misc_feature: SWISSPROT Homolog: EC 3.2.1.39 Glucan endo-1,3-beta-D-glucosidase
  misc_feature: Useful for making plants with altered cell wall content and/or composition
  misc_feature: Useful for making plants with altered carbohydrate content
MVGDHRIKKVKLFDADQGTLSALAGSGIEVMVAIPNVLLDRITDYDTAKEWVRHNVSRYNFDGGVNIKYVAVGNEPFLEAYNGTFDKVTFPAL

SEQ ID NO: 25515 - DNA, 747 bp, Panicum virgatum
  misc_feature: Ceres CLONE 1863983-R
  misc_feature: Encodes the peptide sequence at SEQ ID NO. 25516
cgttcgcgcgccgcctcacgggcaccgagatgggcatcagccacctccagcgcatcgggaccgggctcatcctctccattgtcgccatggcggtggccgccgtcgtcgaggtgaagcgcaagaacgtggccgccgacagcggcatgctggactcgccgaagccgctgcccatcagcttcttctggatcgcgttccagtacctgttcctggggtcggcggacctgttcacgctggcggggctcctcgagttcttcttcagcgaggcgccgtcgcggatgcgctcgctggcgacgtcgctgtcgtgggcgtcgctggcgctgggctactacctcagctccgtgctcgtgtccatcgtgaacagcgcgacggggcgcggcggccaccggccgtggctgcggggtgccagcctgaaccactaccatctcgaaaggttctactgggtcatgtgcgtgctcagcactctcaactacctcttcttcctgttctgggcgatcaggtacaaatacagaaacgcaggggtcatcaaagggtaatgccatagccaatcggcattgccgttgatcgccacggtagcgagaactgctgggtgttactgtttatattggtggcaagcagagagtaaaaaaaaaggtactaggttaacttctgcaggatgtggggattatattggtggtggtggtttatcaggttgtcatgaatttggttgattggttcaacaagtgaatcaagaggtggctcagttaatcc

SEQ ID NO: 25516 - protein, 176 aa, Panicum virgatum
  misc_feature: Ceres CLONE 1863983-R
  misc_feature: Useful for making plants with modulated nitrogen use efficiency
FARRLTGTEMGISHLQRIGTGLILSIVAMAVAAVVEVKRKNVAADSGMLDSPKPLPISFFWIAFQYLFLGSADLFTLAGLLEFFFSEAPSRMRSLATSLSWASLALGYYLSSVLVSIVNSATGRGGHRPWLRGASLNHYHLERFYWVMCVLSTLNYLFFLFWAIRYKYRNAGVIKG

SEQ ID NO: 25517 - DNA, 727 bp, Panicum virgatum
  misc_feature: Ceres CLONE 1863983
ctaccgccgctcttgtcctgtcctgacacggagtgaccccgccagccgctgccactgcacacgcacagacacactcctctcccacactctgcccgcatctcttcttcttctctgttctctctctctagaagaggaacaagcagctgaggtgagccgaagccgagcgcagctgccccatctctctccctccctccctggaggtctctcgcgttctcacagggacaggggcgttcctcggccgggcgagcttcggtagcggcggaccatgaaggcgctggtggtggcggtgctgcttctgctctcctccaccctcgccgcgtcacgtgagccccctttcgttttctaacctttctctcctcttctctcagattttgtaagctttgacttccacaatgcttgcggacgcttcttttctctttgtttggggagcttgttgtgtggaaacctggggggttctcgctggctatgttcgcccgaatcacctcaagttcttctttctactgttctctgtgttctaaaatgtgggaccctccacagttctggttcttccgcttgttgtcgtgtattcttgtttttgaaacgataaaaaagttttcacatttttttcttgtttctgtggacgaaccagatgatgcacctgagatgtactgtttttttttcattacaattttttaagccgcggtagtcatccgctgcataccatttcagcatctccaccccccccccc

SEQ ID NO: 25518 - DNA, 698 bp, Panicum virgatum
  misc_feature: Ceres CLONE 1864004
  misc_feature: Encodes the peptide sequence at SEQ ID NO. 25519
attcccgcagtttctctggtgctagggttcggtccgaatcggcgaatggtcgccaaccaggaggcggaggcggcatcggcggcagcgcccggggcagggacgccggtggacccgatgcgtctggcgtcgcggtggcggtccccggcggagtgggagtgtgcggcggcggagctggatgctgagccgctcccgtccgagctcaacaccgtcaacagctctggacttttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaagcgaaagcttcaagatgcggcgacaaccgggttgggagcctaacagttgtggataccacggtgatgatggccatctttaccgaggtcaagggaaaggtgaaccattcggggccaaatttacatctggcgacacaatcggtgctggcatcaactacttgtcacaagaatttttcttgacgaaaaatggatctctggttggagcctttccaaaagaaataaaggtccactatatcctaccgttgcagttcatagtcagggtgaagaattgactgtgaactttggtaaagaccattct

SEQ ID NO: 25519 - protein, 208 aa, Panicum virgatum
  misc_feature: Ceres CLONE 1864004
  misc_feature (96)..(201): Pfam Name: SPRY Pfam Description: SPRY domain
  misc_feature: SWISSPROT Homolog: EC 2.7.10.2 Non-specific protein-tyrosine kinase
MVANQEAEAASAAAPGAGTPVDPMRLASRWRSPAEWECAAAELDAEPLPSELNTVNSSGLFAVVSTDKLSVKYLGSHHHGHDVGVVQADRPAPTRRAVYYFEMRVKNAGYKGQTSIGFTSESFKMRRQPGWEPNSCGYHGDDGHLYRGQGKGEPFGAKFTSGDTIGAGINYLSQEFFLTKNGSLVGAFPKEIKVHYILPLQFIVRVKN

SEQ ID NO: 25520 - DNA, 1434 bp, Panicum virgatum
  misc_feature: Ceres CLONE 1864014
  misc_feature: Encodes the peptide sequence at SEQ ID NO. 25521
agaaagagagagcaaaagggaaataaaggaactcttgcaggtactcaacactgacatgagtgatctcatgctcttgataccttggtactcttacatcaacctcctccttcttgctcctcctgcttcctctttctagctaggatcttcaacggccttctctttctatatcacagagagagagagagagagagacgcacagcaagataattttctttgtgcagcaagggacagcacgtgcaggagctcatgagctgcatcaattcttgaggcgaaaccacaagcttgtgatattgcactgaagctaattgaggataatttttggtgccctgaagcccaaagccaagatttttgggcgtcgtcgatctgtcggcgatggcggcgtactaccacggcggcgccggcacggacatccaggccagcgccgacggcctgcagacgctgtacctcatgaacccgggctacgccagctacggtgacgccggcgcgtcgccgcccggcgcgaccaacatgatgctcctcaactcggcggtgagcaccatgaccccggcgtccttcggccaccaccaccagcagtcgccgtcggcggcgcagcagcacttcgtcggcatccctctgcaggcggcgccgtcgggctacaacctctggaccccggccacgagcggcgccgccgcggacatgtcgccgccgcaggcgcagactcccggcgccgccggggtcagcgccgtgctcagcctgtcgtcccgcgaggcgccgccgccggtcaccgtggccgccgtcggaggcgccggcgacgagggaaagtaccaccagctgagcgcgtcggccacgccgcagggccagatggtgatgagctccaagtacctcaaggcggcgcaggagctgctcgacgaggtggtgagcgtcagcaagggcgtggaggacgccaaggccgccgcgacggccaagagccttgcggcagtgaagaagaaggaggactcggagggcgtctccggcggcggcacagatgacggcggcggggccaagagcggcggcgcggtgccggagttgtccacggccgagcggcaggagctgcagatgaagaagagcaagctcatcaacatgctcgacgaggtggagcagcggtaccggcagtaccacgggcagatgcaggcggtgtcgtcgtcgttcgaggcggcggcgggggccgggtcggcgcgcacgtacacggcgctggcgctgcgcaccatctcgcggcagttccggtgcctgcgggacgcgatcgtggcgcaggtgcgcgcggcgagccgcgccctgggcgaggacgccgacgccgccgtcgccggcggccgcaccgtcggctcccgcctccgctacatcgaccatcagctccggcagcagcgcgccctgcagcagctcggcatgatgcagggcggcgcctggcgcccccagcgcggc

SEQ ID NO: 25521 - protein, 353 aa, Panicum virgatum
  misc_feature: Ceres CLONE 1864014
  misc_feature (156)..(298): Pfam Name: POX Pfam Description: Associated with HOX
MAAYYHGGAGTDIQASADGLQTLYLMNPGYASYGDAGASPPGATNMMLLNSAVSTMTPASFGHHHQQSPSAAQQHFVGIPLQAAPSGYNLWTPATSGAAADMSPPQAQTPGAAGVSAVLSLSSREAPPPVTVAAVGGAGDEGKYHQLSASATPQGQMVMSSKYLKAAQELLDEVVSVSKGVEDAKAAATAKSLAAVKKKEDSEGVSGGGTDDGGGAKSGGAVPELSTAERQELQMKKSKLINMLDEVEQRYRQYHGQMQAVSSSFEAAAGAGSARTYTALALRTISRQFRCLRDAIVAQVRAASRALGEDADAAVAGGRTVGSRLRYIDHQLRQQRALQQLGMMQGGAWRPQR

SEQ ID NO: 25522 - DNA, 620 bp, Panicum virgatum
  misc_feature: Ceres CLONE 1864014-R
cccgggaccaccacccaccaccaccaggacggcggcggcggcgggtactctctcttcgccccagggccgtacgggcagttcagctcggagccgttcgcgttcacggggaacggcggggtgtcgctgacccttggcctcccgcacggcgccggcggcggcggcgccgagcagacggcgtcgttcctcatgggcagcagcgccgccggcgacagcggcagcaacggcggcgccgccggcgggtacgacatgaacatgcagagcaccaagtcctttgcggcgcagctcatgagggacttcgtggcctagctggtagcatagctgtcgtcgaccatgccattaatcaactccatccatggattaatcggtttagggcttgtatagaaataaaaaggtccaagcctaaacatgctcttacatgggtaagaagcagttaagcttgggctataggttttgggcatgtaaagatgggatatttatcatggtgcgatgtatataggtataggatgatagtcaactagttgatacccaaattaaacattgtacaagattttatatgtcatagggattggggggcaatacggtacaatatgtgaaaggggtatattggaattggaacttgg

SEQ ID NO: 25523 - DNA, 681 bp, Panicum virgatum
  misc_feature: Ceres CLONE 1864019
  misc_feature: Encodes the peptide sequence at SEQ ID NO. 25524
attctcctcctcccgccccgggcgccgaatcccggataaatagcggcccgacgcccgacgcccgacgccgggggaacttttccatttccagagctgcaaaggctcctgctttaccttgcctttttttgcttcgcgcgctgcctgcccatggcggcggcggcggcggcgtgggtgcgggcagtgttcctggccgccgtggccgcgtccgcggcggaggcgctgggcctggacgtccaccaccggtactcggcgaccgtgcgggagtgggcggggcaccgcgcgccgccgcgcgggacgccggggtactacgccgcgctggccggccacgacggcctccgccgccggtcgctcgcctccgccgcggggggaggggaggtggccttcgccgacggcaacgacacctaccggctcaacgatttcggattcttgcattacgcggtggtggcgctggggacgccgaacgtgacgttcctggtggcgctcgacaccggcagcgacctcttctgggtgccctgcgactgcatcaagtgcgccccgctcgtctcccccaactacgggaatttgaagttcgacgtgtacagccctcagaagtcgagtactagccgaaaggtcccttgcagtagcaatttgtgcgatgagcagagcgcgtgccaatcagcaagcaacagctgcccgtacaat

SEQ ID NO: 25524 - protein, 177 aa, Panicum virgatum
  misc_feature: Ceres CLONE 1864019
  misc_feature: SWISSPROT Homolog: EC 3.4.23.12 Nepenthesin
MAAAAAAWVRAVFLAAVAASAAEALGLDVHHRYSATVREWAGHRAPPRGTPGYYAALAGHDGLRRRSLASAAGGGEVAFADGNDTYRLNDFGFLHYAVVALGTPNVTFLVALDTGSDLFWVPCDCIKCAPLVSPNYGNLKFDVYSPQKSSTSRKVPCSSNLCDEQSACQSASNSCPY

SEQ ID NO: 25525 - DNA, 1400 bp, Panicum virgatum
  misc_feature: Ceres CLONE 1864023
  misc_feature: Encodes the peptide sequence at SEQ ID NO. 25526
gtctatgcctaagcgcccactcctcccttcccttgccaccacccctctcaccagagcgcagaagctgctcgcagcttcagctcccacgaggtccgctgaagctagcctctaggctcgccatggcgtctggggaagcagagccgctgcagtacacgaccacccttctgcgggtgtccatccactgcgaggggtgcaagaagaaggtcaagaaggtgctccacaacatcgaaggagtgtacaaggtgacggtggacgcggcgcagcacaaggtgaccgtcaccggcagcgtcggcgccgacgcgctcatcaggcgcctgcacaaggccggcaagcaggccgcgctgtggccggcgccggccccggccgctttcgtcgaggcggccaagaagcctgaggagctcgccccggcgccgccagcaggagacggggagggcaccaaggtcaaggaaggcgcggacgccaagcccaaggaggcagccaaggacaagaagcagcagcctgaagccgagggcaaggacaagaagccggagaaggcctccgacaacaagcccgagaagcccgaggccgcgaaacccaaggacgaggccaccaaggacgccgaggtgactgcacccaaggaaaagggctcccctgagccggcgaaggaagccgccgccgccgaggacaaggcgggcggggaggaggccagcagcggcaagaagggcaagaagaagaagaagaagaacaagcagatggacggcggcgaggctgaggccgcgccggcggagaagacgccgcagccgtcggtggcagcgccggtcccggcgcccgctcccgcgctgggtccggagcgcccgcccggcgggttcccgtactacgcggcgcagccggtgatgagctacaacgtggcgcacccgagctccagcgtgtcgtactatgcgcccacgccggttgggcccatgccgccaatgccaacgccgccgccatcgcagatggcgccgtacgggtacccgcccatgatgccgccgccggtgccggagttcctgtacggcccgctgggcatgcggtcgtccccgccgcaggagtcgtacaacatgttcaacgaggagaacgccaactcgtgcagcgtcatgtgatttccgcgccttcgccgccgccgcctcgccggactccggtcgttaggtggtcccacccgctgtgcgctgcacggcgtcgagtcacagatagagagaggctgctttcgtaatagaggaggcctctcttgtggatcgtggttactagctagagagtactggagtactgtcaattaggtggtcaaagctcctcttgaccagattttctctctctctccttataaactaaattgctcttagtgcatgcaccatgtaatcagatgatcatatgctagtatcactacttgc

SEQ ID NO: 25526 - protein, 331 aa, Panicum virgatum
  misc_feature: Ceres CLONE 1864023
  misc_feature (15)..(75): Pfam Name: HMA Pfam Description: Heavy-metal-associated domain
MASGEAEPLQYTTTLLRVSIHCEGCKKKVKKVLHNIEGVYKVTVDAAQHKVTVTGSVGADALIRRLHKAGKQAALWPAPAPAAFVEAAKKPEELAPAPPAGDGEGTKVKEGADAKPKEAAKDKKQQPEAEGKDKKPEKASDNKPEKPEAAKPKDEATKDAEVTAPKEKGSPEPAKEAAAAEDKAGGEEASSGKKGKKKKKKNKQMDGGEAEAAPAEKTPQPSVAAPVPAPAPALGPERPPGGFPYYAAQPVMSYNVAHPSSSVSYYAPTPVGPMPPMPTPPPSQMAPYGYPPMMPPPVPEFLYGPLGMRSSPPQESYNMFNEENANSCSVM

SEQ ID NO: 25527 - DNA, 1914 bp, Panicum virgatum
  misc_feature: Ceres CLONE 1864033
  misc_feature: Encodes the peptide sequence at SEQ ID NO. 25528
accttccccccggcccgctccctcgccagctttgcgggaaaccagagccgccagcagacaaacccctctctccgcctcgctccccctcctccccaaaaccataacccctccgcccccgatggcgtcgccgccgccgccgccgccgccgccgcccgccggagccgccgcgcccggatcgccgccgccggcgcaagtggtgggcaacgcgttcgtgaaccagtactacaacatcctgcaccagtcgccggagctcgtccaccggttctaccaggacgccagccgcctcggccggcccgccggcgccggcgccgacggcatggacaccgtcaccaccatggacgcgattagcgacaagatcgtgtccatgggcatcacgcgcgcggagatcaaggcggtggacgcgcaggagtcgctcggcggcggcgtcaccgtgctcgtcatgggccacctcacggggaggaccggcgtcggccgcgagttcgtgcagtccttcttcctcgcgccgcaggagaagggctacttcgtgctcaacgacatactgcgctacgtcggggacggggaaggggaggagggagccgggcacccgccgccgccaccgcagcagccggtgcaggagacagtcacgggcgcggaggccgtccctgctcccatcctggccaatggcactgtcgggggagacaacgagaccctgccttgcgaacaggatgcttcaccgcagcctgagcagcctgcagctgagtccgcacctcctactccagaggaggaagatctctacggagaggaggtttacaacccgccgaatgatatggagaagcctgttgttcaggaaacaccggttgccgaggtcataaatgaagtgccgaataatgtagcagtggctgcgccaagttcgtctccctctataccgatcgaggaggccccaaagaagtcatatgcttcgattgtaaaagtcatgaaagaatatccaccaccagctcctgcagttccctccaggcctgcacccccaaaaccagagaaacaagcccctcctgcaccttctctggttgctgatgctccagctttcagtcctaacactcagggtggcagctttcaagatccagaagttgatgcacatgccatatatgtgcggaatctgcctttaaacgccacaccacaacaattagaagaagaattcaagcgatttggcaccattaagcatgaaggcatccaagttagaagcaacaagatccaagggttttgttatggctttgtagaatttgaggatgccaacgcagtccaaactgcaatagaggcttctcctgttatgattagtgaacggcaatgttatgttgaagagaaaagaactactggttctcgtggcagtaaccgaggaggaaggtttgcaccaggtagaggtggtaacttccgaggtgaaggccttaggggccgtggtacttacaatggaggcagaggctatgggaggggcgagttcagttaccgatctgattatggcggccgaggtggtggcaggggtggctcatcgcgcggagaagttggctatcagcgggttgaccactctggtacagccggtggccgtggcacccggccagcatctgctgctactgctgcaaagtgagttcttggtagctgtgcgtcagtaatagttcagagttctacggccaccatcatggttgaccaaaagcgtggcaggtgtggtgtatttgggttcatgtgaggtttatcagcaaaagttgggtcataaattgatgcttatccttgttttgtggcaaggtaaagcagtggttatatcggttactaattgtagaatatacgtctattgagcttcgttgagcagctgatttgtgttttcccgtttttttaacttgttccgaaattagaggggttgatttgaggtgccagtgatttatagctttc

SEQ ID NO: 25528 - protein, 498 aa, Panicum virgatum
  misc_feature: Ceres CLONE 1864033
  misc_feature (27)..(143): Pfam Name: NTF2 Pfam Description: Nuclear transport factor 2 (NTF2) domain
  misc_feature (334)..(404): Pfam Name: RRM_1 Pfam Description: RNA recognition motif. (a.k.a. RRM, RBD, or RNP domain)
MASPPPPPPPPPAGAAAPGSPPPAQVVGNAFVNQYYNILHQSPELVHRFYQDASRLGRPAGAGADGMDTVTTMDAISDKIVSMGITRAEIKAVDAQESLGGGVTVLVMGHLTGRTGVGREFVQSFFLAPQEKGYFVLNDILRYVGDGEGEEGAGHPPPPPQQPVQETVTGAEAVPAPILANGTVGGDNETLPCEQDASPQPEQPAAESAPPTPEEEDLYGEEVYNPPNDMEKPVVQETPVAEVINEVPNNVAVAAPSSSPSIPIEEAPKKSYASIVKVMKEYPPPAPAVPSRPAPPKPEKQAPPAPSLVADAPAFSPNTQGGSFQDPEVDAHAIYVRNLPLNATPQQLEEEFKRFGTIKHEGIQVRSNKIQGFCYGFVEFEDANAVQTAIEASPVMISERQCYVEEKRTTGSRGSNRGGRFAPGRGGNFRGEGLRGRGTYNGGRGYGRGEFSYRSDYGGRGGGRGGSSRGEVGYQRVDHSGTAGGRGTRPASAATAAK

SEQ ID NO: 25529 - DNA, 346 bp, Panicum virgatum
  misc_feature: Ceres CLONE 1864035
  misc_feature: Encodes the peptide sequence at SEQ ID NO. 25530
atcagctcaactcatcactcgaccacccaggcacccacatcaatccttccattccatttccatcaccaccacaggcaccagcggctgccggctgcgtcagcaagtcagcaacgccgcagcccctatagctcgtgcgtacgtcccgatggagcttccaccatgggcggcttttctcggcgtggtgctcgccaccgtgatgcttctcaaggccgtcctcggccgccgcgggcgccgcgcgtacaacctcccgccggggcccaagccgtggccgatcatcggcaacctcgacctgatgggcgcgctcccgcaccgctccatccacgaactgtcaaagaaagaacggccc

SEQ ID NO: 25530 - protein, 66 aa, Panicum virgatum
  misc_feature: Ceres CLONE 1864035
  misc_feature: SWISSPROT Homolog: EC 1.14.13.21 Flavonoid 3'-monooxygenase
  misc_feature: Useful for making plants with altered carbohydrate content
MELPPWAAFLGVVLATVMLLKAVLGRRGRRAYNLPPGPKPWPIIGNLDLMGALPHRSIHELSKKER

SEQ ID NO: 25531 - DNA, 565 bp, Panicum virgatum
  misc_feature: Ceres CLONE 1864041
  misc_feature: Encodes the peptide sequence at SEQ ID NO. 25532
atgcgaaagctcgagcttccaacaacatgggcctcgtcggcactcctatcgagcaccaaacagcctccagatttccagacagagctctcccacccgtagcctctgcttcgagatggatcccgagctcgccggcaagatgaccgccccggccgccgccgccgccgcggtgaagcccgctaccagggcgtgcgtgacgttcctggcgggcgacggcgactactggaagggcgtggtgggtctgggctacggcctgcgcaaggtccgctcggcgtacccgctggtggtctccgtgctgcccgacgtgccggagtcccgccgccgcatcctcctctcgcacggctgcatgttccgagagatagagcccgtgcacccgccggagagccagacacagctcgccatggcctactacgtcatccactactccgagctccgcctcgtgggaggtagttgactagcgaactgatgctgctttctcttgcttaattattcttcgataatgctgtgctcatcactaacatgacggcggccggtcgggctcttcttggcgcctcatttcgtggagtac

SEQ ID NO: 25532 - protein, 112 aa, Panicum virgatum
  misc_feature: Ceres CLONE 1864041
  misc_feature: Useful for making plants with altered carbohydrate content
  misc_feature: Useful for making plants with altered cell wall content and/or composition
  misc_feature: Useful for making plants with modulated water use efficiency
MDPELAGKMTAPAAAAAAVKPATRACVTFLAGDGDYWKGVVGLGYGLRKVRSAYPLVVSVLPDVPESRRRILLSHGCMFREIEPVHPPESQTQLAMAYYVIHYSELRLVGGS

SEQ ID NO: 25533 - DNA, 1743 bp, Panicum virgatum
  misc_feature: Ceres CLONE 1864049
  misc_feature: Encodes the peptide sequence at SEQ ID NO. 25534
aatctcccgcgccgaccaccgaggctgcagctttgccgtcgcggggccagggcgcggccgggtgcggagcggcgacgagcttgagcagaggcggggaggaggatcgctgcgggggagccgggcgcgcttgctagccgagtcgacaggaggatcggaggcggaggcgcgcaagtggttggcgaggcgtgcgctgtcagggggagcggccggcggacgtgcgccatggggggctacgagcgcgtccgcagcgacgacgcaaccgccctcgcggtggatctggaggccggctgcggcggcggcggacccgcgaagcgcgccgctggggcctccccggcgccggcgcctgcgcggcagcggctcgtctcgctcgacgtcttccgagggatcaccgtgctgctgatgatcatcgtggatgacgccggagcattcattacggcgctgaaccactcgccgtgggacggcgtaacagtggccgacttcgtcatgcctttcttcctcttcatcgtcggagtggccctggcgctcgcgtacaagagagtgccggacaagttggacgccacgaaaaaggcggtgctccgtgcgctgaagctgttttgtcttggtcttgttttacaaggtggattcttccatggtgttcgtagtctaacttttgggattgaccttcaagaaatacggctcatgggtattctgcagagaattgcaatagcttatctattgactgccctatgtgaaatttggctcaaaggagatgaagatgtagattatggattcgatttgctcaagagataccgctaccaactgttcgtaggcgcaattgtggcaatcacatacatggccctgttgtatggtacctatgttcctgattgggagtatcagacatcaggtcctggatctgcagagaagtctttcttggtgaaatgcggagtaagaggtgacaccagcccagcttgtaatgcggttggcatgatcgaccggaaaatcttaggcatccaacatctctatggtcgaccggtctacgcgcggtcaaagcaatgcagcatcaattcaccggaaaatgggccccttcctccggacgccccctcttggtgccaggctccttttgaccctgaaggccttctcagttccgtgatggccattgttacatgcttgattgggctccagtacggacacgtcattgtacatttccagaaacacaaggataggatcatgaactggttaatcccttccctcagcatgctagtcctagccttctccatggacttctttggaatgcacatgaacaagccactgtacaccctgagctacaccttggccaccgccggcgcggcgggcctccttttcgctggaatctatgcgctggtcgacctgtttggctaccggcggccgaccgtcgccatggagtggatggggctgcacgccctgatgatctacgtcctcatcgcgtgcaacatcctgcccatcttcgtccatggcttctactggaaagagcccaagaacaaccttctgaagttcatcggaattggggcatgaggtggtggtgaccatacacggatacagatattgtttaggaatctattcgggcaggcagagatagagaagcacgtgcattcaggcctagttttgctacacggccagtgcatcattgttgctgcacagagtgcctctctctgtgagctcttgtatatgataaagaagccttgtgtatatgacaatacgatttttatataaagaaaatagaatagt

SEQ ID NO: 25534 - protein, 435 aa, Panicum virgatum
  misc_feature: Ceres CLONE 1864049
  misc_feature: SWISSPROT Homolog: EC 2.3.1.78 Heparan-alpha-glucosaminide N-acetyltransferase
MGGYERVRSDDATALAVDLEAGCGGGGPAKRAAGASPAPAPARQRLVSLDVFRGITVLLMIIVDDAGAFITALNHSPWDGVTVADFVMPFFLFIVGVALALAYKRVPDKLDATKKAVLRALKLFCLGLVLQGGFFHGVRSLTFGIDLQEIRLMGILQRIAIAYLLTALCEIWLKGDEDVDYGFDLLKRYRYQLFVGAIVAITYMALLYGTYVPDWEYQTSGPGSAEKSFLVKCGVRGDTSPACNAVGMIDRKILGIQHLYGRPVYARSKQCSINSPENGPLPPDAPSWCQAPFDPEGLLSSVMAIVTCLIGLQYGHVIVHFQKHKDRIMNWLIPSLSMLVLAFSMDFFGMHMNKPLYTLSYTLATAGAAGLLFAGIYALVDLFGYRRPTVAMEWMGLHALMIYVLIACNILPIFVHGFYWKEPKNNLLKFIGIGA

SEQ ID NO: 25535 - DNA, 527 bp, Panicum virgatum
  misc_feature: Ceres CLONE 1864054
  misc_feature: Encodes the peptide sequence at SEQ ID NO. 25536
atccatcgccaccaccatggccatggcctttgctccgccgccgctcctcctcccgttgctcctcctccctcttctctccaccgccgcgcccaccacgacgctccctctataccgccacctcccgcacgtcgccgagaccgcgcaccaccacccgctctcccgcctggccgccgcatcgctcgcccgcgcctcgcacctcaggcgcgcccaccacaaacaggggcaacctggtaccgcctccgccaccgcgctctacccgcactcgtacggcggctacgccttcaccgcctccctcggcacgccgccgcagccgctacccgtcctcctcgacaccggcagccacctcacctgggtgccctgcacctccaactaccagtgccgcaactgccccaccgccgccgtccccaccttccaccccaggaactcgtcctcctcccgcctcatcggctgccgcaacccctcctgcctctgggtccactccgccgtgcgcctcgccgccgccggcaccaactggaggaaaaaaagaa

SEQ ID NO: 25536 - protein, 170 aa, Panicum virgatum
  misc_feature: Ceres CLONE 1864054
  misc_feature: SWISSPROT Homolog: EC 3.4.23.12 Nepenthesin
MAMAFAPPPLLLPLLLLPLLSTAAPTTTLPLYRHLPHVAETAHHHPLSRLAAASLARASHLRRAHHKQGQPGTASATALYPHSYGGYAFTASLGTPPQPLPVLLDTGSHLTWVPCTSNYQCRNCPTAAVPTFHPRNSSSSRLIGCRNPSCLWVHSAVRLAAAGTNWRKKR

SEQ ID NO: 25537 - DNA, 643 bp, Panicum virgatum
  misc_feature: Ceres CLONE 1864069
  misc_feature: Encodes the peptide sequence at SEQ ID NO. 25538
gctcagacagcagtcagtcgcacacaggagagagacaggctcacctcagagacccatccgccgcgtccgaaccgaaacgaaagcagcagcagccagcagccggcagccgagcgaggatgaaggtggaggtggtggagacgacgctggtgccgccgagcgaggcgacgccgcggcacgcgctgtggctgtccaacctcgacctggcggtgcccaagacccacacgccgctcgtctactactaccccaggcccaagcccgccggcgacggcaacggcgacggcgagggcgtgggcggcggggcccctttcttcgacccggcgcggctgcgggacgcgctggcccgggcgctggtgcccttctacccgctggcggggcggctggcgtcgggccccggcgggcgggtcgagatcgactgcacgggcgagggcgcgctcttcgccgtcgcgcgcgccgacttcgccggcgacgaggtgttccgggacttcgagccgtcccccgaggcgcgccgcctcctcgtgcccttcaccgagtccggcgagccaccctgcgtgctcggcatggtccaagtcaccttcctcaagtgcggcggcgtcacggtgggcacgagcatgcaccacgtgaccatggacggtgccggcgcgtt

SEQ ID NO: 25538 - protein, 175 aa, Panicum virgatum
  misc_feature: Ceres CLONE 1864069
  misc_feature: SWISSPROT Homolog: EC 2.3.1.144 Anthranilate N-benzoyltransferase
  misc_feature: Useful for making plants with altered carbohydrate content
MKVEVVETTLVPPSEATPRHALWLSNLDLAVPKTHTPLVYYYPRPKPAGDGNGDGEGVGGGAPFFDPARLRDALARALVPFYPLAGRLASGPGGRVEIDCTGEGALFAVARADFAGDEVFRDFEPSPEARRLLVPFTESGEPPCVLGMVQVTFLKCGGVTVGTSMHHVTMDGAGA

SEQ ID NO: 25539 - DNA, 2047 bp, Panicum virgatum
  misc_feature: Ceres CLONE 1864080
  misc_feature: Encodes the peptide sequence at SEQ ID NO. 25540
acaccatccctttcccgagttcaaacaaccactgatccagaggaaggccggcgtcccatgtcgccgccgccgccacggggaccagctcaccgccgaggtgccccctctcggcttccctgagcggcgctcccggccgcgggaaatggtccaggcgcggcgccgcggcggcagctaccggtgcccgcgccgcgccgcgctggcggcggcggcgctcctgctcttcctcctcgccgccgtcgcgctgctctacgtctccccgccgccggtctcggaccaccccgtgctgaacagctccggtggcggcagcatggacgagtccgagcgccgcgaaatttctcgtgttccaacgaatggttcgaccgtcagggacaacctttggggttcaaagcttgctagcaaattttatgggtgcagcaactcaagcagcaagttccttgattcaaatattactacacaaacagaccgctgtttgatgattgttacaagtggaggcctgaatcaacagagaacagggataattgatgctgtcgttgctgcgcgcattttaaatgccacacttgttgttcccaaactggaccaggcatccttctggaaagattcaagcaatttttctgaaatttttgatgccaactggtttatctcatccctatcaaaggatgtaaagattgtgaaagagcttcctgagataggaggtaaacttcgggctcctcacagaatgcgtgttcctcgaaaatgtactgagcggtgttacttgaaccgtgtgttacctgcacttcttaagaaacatgttatacgattgacgaaatttgattatagattagcaaacaggttgcaaactgacttgcaaaagttgagatgcagagtcaactatcatgcattgagatttactgctccaatacaggagatgggtgaaaagctaatacaaagaatgagggagaggagcaagtattttattgctcttcatttaagattcgaacctgatatgcttgccttttcgggatgttattatggtggtggagaaaaagagaggagagaacttggtgctataaggaagaggtggaaaggcttgcatcctaacccagagaaaggaagaaggcaaggtagatgcccgctaactcctgaagaggtgggtctgatgttgagagcactgggctacagtaaggatgtccacatttatgtggcttctggagagatatatggaggtgcaaggactctggcaccgcttaaagctctcttccccaatctccacacaaaagaaacaatatctagcaaagaggagctggctccattctctaagtattcatctcgcatggctgcacttgatttcattgtctgtgatgaaagtgatgcttttgtggctaacaacaacggcaacatggctaaaattttggctgggcgaaggagatattttgggcataagagaacaatccgaccaaatgccaaaaggctctatcccttatttttgagcagaggaaacatgtcatgggatgcattctcctcaaaagtacacatgtttcagaaagggtttatgggagagcccaaagagcttaggccagggaggggggagtttcatgagaacccctctagctgtatctgtgaaaggactgatggcaaagccaaatctcgcaacaatcaaattttggatattagtagtgaccgaggcaaagccatggatgagccagcagttcctaattatattggcgaagaggtgggcgaatttgatgatgacgacgaagatgctcctgcagagaaagggatggttgacttggaaatggacgacgatgcgttggtcagaccagaggatcctgagctggaacagattctttcagactagctgctaagttgtaaaaccggcgtcaaagtaatttcccaagcaattttgggctgagtgattagcgaattttgaccccttgaaattgtacatatttctttttttgcaatgtaaatgtacgtcctccaaccagacttagccttgcatctcagtagtgcagtgtctgattcctcagtttgtaacatttgtggtttgttgcctgttttagattgtagc

SEQ ID NO: 25540 - protein, 563 aa, Panicum virgatum
  misc_feature: Ceres CLONE 1864080
  misc_feature: Useful for making plants with modulated nitrogen use efficiency
MVQARRRGGSYRCPRRAALAAAALLLFLLAAVALLYVSPPPVSDHPVLNSSGGGSMDESERREISRVPTNGSTVRDNLWGSKLASKFYGCSNSSSKFLDSNITTQTDRCLMIVTSGGLNQQRTGIIDAVVAARILNATLVVPKLDQASFWKDSSNFSEIFDANWFISSLSKDVKIVKELPEIGGKLRAPHRMRVPRKCTERCYLNRVLPALLKKHVIRLTKFDYRLANRLQTDLQKLRCRVNYHALRFTAPIQEMGEKLIQRMRERSKYFIALHLRFEPDMLAFSGCYYGGGEKERRELGAIRKRWKGLHPNPEKGRRQGRCPLTPEEVGLMLRALGYSKDVHIYVASGEIYGGARTLAPLKALFPNLHTKETISSKEELAPFSKYSSRMAALDFIVCDESDAFVANNNGNMAKILAGRRRYFGHKRTIRPNAKRLYPLFLSRGNMSWDAFSSKVHMFQKGFMGEPKELRPGRGEFHENPSSCICERTDGKAKSRNNQILDISSDRGKAMDEPAVPNYIGEEVGEFDDDDEDAPAEKGMVDLEMDDDALVRPEDPELEQILSD

SEQ ID NO: 25541 - DNA, 2262 bp, Panicum virgatum
  misc_feature: Ceres CLONE 1864087
  misc_feature: Encodes the peptide sequence at SEQ ID NO. 25542
aacagagcccagtgcgggcagcctcacgccctctccatccccgtcgctcctcccttccccatccgctccatccgctaatccgcatcgtgctgcccttcccatgctctctcctcctccgcccgactgcccccatgcgctttgcctccgcagggaggaggttctccttcggggatggcagtgccgcgaccggggacacgcacgctgagcaagggagcgtggagatggaggcggatcggggacgagatcgcgcagatggacgcgtgcatcgcgcggagatggcgtcggccgggggcgttagcgacggcgacggccttctctccggttttggtggaactggaaaaaccttcctttggaattgcatcctttctaaattaagatcacaagtttcaagagtcacatcacaagaaggcctgaagatattaatcgaaaatgaagatggaacatctgggactgctacaaagaatattgtctataggatgacctgcattccattaaaggatatcaaccaaggatcatacaaaacaaaaatctgtgcaagactaacaaggctttctgaatttatccttgatgacaaaccagaacaaatgcaacgattggactttgtgctactagatgtcgagggacatgcaatcgaagctcaagtaccccagcaacacatcagtcgtttcttatcacgtcttaaagaaggaactgtgtactttgttgaattcttccaggtcgttccatgtaggaccaattaccgagcagtcagccatacatacatgattaaattcacatgccatactagagtaactgaattcaatgctgcgcctccaacattacccaaatatgcatatactctagcatcatttgatactctgaggaccagaatcgactatacagctgacatgtcagacacaataggtcgaattgtctctgttgaacctgctacaactgcttatgtaaaaggtctgaagaaagcaatacgtcacctttacatatccgatggccgcgaatccattgaagtggtcctttggagccgtcaagcaactgaattcccagctgaaaaaatcattgaactgagtaaagaaaaacctataattttactactccttggtatcattgccaaatcacgtgaaggtcagctaaaaatacaaggaagcatgtcatgccaataccatatcaatcctgcaatcccagaagcagcagctctcataaacaaatttacaggttttcctcatcaagtaacatggactggtgcagccacttcttcttcttcagatattatgactacatcagtgacagaattagcaaaattgaccaatccacatgaactctatggtaacatatatcaagttaacgtcgtactcagaacaatatcacccaatcaaccatggtggtacttaggctgcatattatgcagaaaaagagtattcccagaaggtgaaacgtacagatgtcccaaatgctctggaaataaagctgaacctatgtaccgaattgttttcattgcagctgatccagacaacttcttggaagataatgcacctaccattgaaataacattctttggaaacatgggtcaagaacttacaggcatcccggtgctccaattagcagcaatatctgaaggaaataatgtttctatccccccagaaataacacgtctctatagtcacaaatacacccttgcaatcagtgttccattctcatcaatgcaaagagaaaatgtatcatatcaggtaaaaaatatcatcactacagcaggccctgttatcactaccaaaactatatatcctgctacttcaggaacaggacaacaacaaactaaacctacccaggacaccacaagacacttaccagttgctgaaaccaccaaactagacagtaacaaggaagaaggcaaggtagcaacccccctgccttcacctcaacgattacaaatggaaacatcgtctccaacaatgaaacagacaacttcttcagaggatgaccttgcattttctacagaagctggcacatccggtaaaaaacaaaacgaaatgtgagaagaaaacttggagactgaacctcaatccaacttcagcggacttcacctactatcaatctactgcctcttttgctctcagcaatcagttgccactagctaccctaaacgtttgtattatgtaacaattatgtttgcgacttagacttcatatctatcagccatgtacaaaacaacttgaacggcgcagcgtagcgcgcctacctttctagtaggaattgaattctaattattct

SEQ ID NO: 25542 - protein, 583 aa, Panicum virgatum
  misc_feature: Ceres CLONE 1864087
  misc_feature (351)..(487): Pfam Name: Rep_fac-A_C Pfam Description: Replication factor-A C terminal domain
MASAGGVSDGDGLLSGFGGTGKTFLWNCILSKLRSQVSRVTSQEGLKILIENEDGTSGTATKNIVYRMTCIPLKDINQGSYKTKICARLTRLSEFILDDKPEQMQRLDFVLLDVEGHAIEAQVPQQHISRFLSRLKEGTVYFVEFFQVVPCRTNYRAVSHTYMIKFTCHTRVTEFNAAPPTLPKYAYTLASFDTLRTRIDYTADMSDTIGRIVSVEPATTAYVKGLKKAIRHLYISDGRESIEVVLWSRQATEFPAEKIIELSKEKPIILLLLGIIAKSREGQLKIQGSMSCQYHINPAIPEAAALINKFTGFPHQVTWTGAATSSSSDIMTTSVTELAKLTNPHELYGNIYQVNVVLRTISPNQPWWYLGCILCRKRVFPEGETYRCPKCSGNKAEPMYRIVFIAADPDNFLEDNAPTIEITFFGNMGQELTGIPVLQLAAISEGNNVSIPPEITRLYSHKYTLAISVPFSSMQRENVSYQVKNIITTAGPVITTKTIYPATSGTGQQQTKPTQDTTRHLPVAETTKLDSNKEEGKVATPLPSPQRLQMETSSPTMKQTTSSEDDLAFSTEAGTSGKKQNEM

SEQ ID NO: 25543 - DNA, 746 bp, Panicum virgatum
  misc_feature: Ceres CLONE 1864096
  misc_feature: Encodes the peptide sequence at SEQ ID NO. 25544
aagccctcctcccctcttcctaccattagcagaagagaagaagagcagagacaggcaggctgcaaagcagcagcagcgaagcgcgatcgagagagagacacgatgagcggcggcggccaggacctgcatctgccgccggggttccggttccacccgacggacgaggagctggtgatgcactacctctgccgccgctgcgccgggctgcccatcgccgtccccatcgtcgccgagatcgacctctacaagttcgacccatggcagctccccagaatggcgctgtacggcgagaaggagtggtacttcttctccccgcgggaccgcaagtacccgaacgggtcgcggccgaaccgcgccgccgggtccgggtactggaaggccaccggcgccgacaagcccgtgggcacgcccaagcccctcgccatcaagaaggcgctagtcttctacgccggcaaggcgcccaagggcgagaagaccaactggatcatgcacgagtaccgcctcgccgacgtcgaccgcaccgcccgcaagaagaacagcctcaggctggatgactgggtcctgtgccgcatctacaacaagaagggcgggctggagaagccgccagtggccgccggcgaccgcaagccggcgctcgccgcggcggcgggctccccgccggagcagaagccgttcgtggcggcgccgggcgggctccccccccgcgtcgcggacctggcggcgtactacgaccggccgtcggactc

SEQ ID NO: 25544 - protein, 214 aa, Panicum virgatum
  misc_feature: Ceres CLONE 1864096
  misc_feature (10)..(135): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: Useful for making plants with altered terpenoid content
  misc_feature: Useful for making plants with modulated water use efficiency
  misc_feature: Useful for making plants with modulated oxidative stress sensitivity
  misc_feature: Useful for making plants with modulated light quality response
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for making plants with modulated light quality sensitivity
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 476 in the 10/666,642 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 612 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated nitrogen use efficiency
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 344 in the 10/666,642 US patent application
MSGGGQDLHLPPGFRFHPTDEELVMHYLCRRCAGLPIAVPIVAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRTARKKNSLRLDDWVLCRIYNKKGGLEKPPVAAGDRKPALAAAAGSPPEQKPFVAAPGGLPPRVADLAAYYDRPSD

SEQ ID NO: 25545 - DNA, 1384 bp, Panicum virgatum
  misc_feature: Ceres CLONE 1864118
  misc_feature: Encodes the peptide sequence at SEQ ID NO. 25546
aaaacccgagcaggaaaatctttttccattggccgagaaaaactcagccgccggccgcgaccttcgcttccgtctccggtctccgcctcccccattcccccggcccccatcctgtgggagctcccgattcgggggaggaggcaggcacccgcaccccgccgcccgccccccgcctgcggatcagcgccgtcgccgatcggaggcccctcgccttcccccggtgggcggcgcgcggtgggaggatggacggcggcgcgggggcggccgggcacggcggccccggccggaggagcatctcctccgccgccgcctccaggaggaggctcccgcccgccgagaacggccacggccacggccacgacggcgccgcctccaggaggtcctccgcctccatctcccgggccaactccccgtcactgactggcgagagaactgtgaaaaggctgagattgtccaaggcgttgacgataccggatcacacaaccgtgcatgaggcttgtcggaggatggcctcacgcagggtcgatgccgtgttgctgactgactccaatgctttgctctgcgggatcctcactgacaaggacataaccacaagggtcattgctcgtggattgaagatggaagacacaccagtctccaaggtcatgaccagaaaccctgtatttgtgcttgcagacactcttgcagttgaggcattgcagaagatggtacaaggtaagttcagacatctgcctgttgtggagaatggtgaagtcattgcactgctggacattgccaagtgcctatatgatgctattgcacggatggaaagggcagcagagaaaggaaaagcaattgctgctgctgttgagggcgtagaaaagcattggggaacagctgcatctggtcctaaaaattttattgaaactcttcgagagaagatgtttaggccatcgctgtctaccattatctctgagaattcaaagtaggtaatatcctttccttttcaaattaagtgccttcttgagcattcatataatataagtgccagtccagaacaacttatttcctgatcttgattgcttagagtggtcactgttgcaccaacagacacggtgttgacagcatcaaagaagatgctggaattaaaagtgagttcagccgttgtagcaattgaaaacaaacctgggggaattttgacctctagagatatattgatgcgtgttatcgcccaaaatcttcctcccgagtccaccacagttgagaaggtcatgacccagagtcctgaatgtgccacaattgacaccccaatccttgatgcccttcacacaatgcatgatgggaaattcttacatttgcctgttctagacagggatggcaatgttgtgactgttgttgatgttct

SEQ ID NO: 25546 - protein, 241 aa, Panicum virgatum
  misc_feature: Ceres CLONE 1864118
  misc_feature (67)..(185): Pfam Name: CBS Pfam Description: CBS domain pair
  misc_feature: SWISSPROT Homolog: EC 1.1.1.205 IMP dehydrogenase
MDGGAGAAGHGGPGRRSISSAAASRRRLPPAENGHGHGHDGAASRRSSASISRANSPSLTGERTVKRLRLSKALTIPDHTTVHEACRRMASRRVDAVLLTDSNALLCGILTDKDITTRVIARGLKMEDTPVSKVMTRNPVFVLADTLAVEALQKMVQGKFRHLPVVENGEVIALLDIAKCLYDAIARMERAAEKGKAIAAAVEGVEKHWGTAASGPKNFIETLREKMFRPSLSTIISENSK

SEQ ID NO: 25547 - DNA, 667 bp, Panicum virgatum
  misc_feature: Ceres CLONE 1864118-R
  misc_feature: Encodes the peptide sequence at SEQ ID NO. 25548
cgggttcaagattcaggacaagccaggcaggatgcacagatttaactgcgaaacgagcagcttgacagacctgataaccagcattcttcagagggtcggcgatgacattgatagaaaaaaccttcctcaaattttgtatgaagatgaggatcatgataaggtcatactttcatcagacagtgaccttatagctgctgttgatcatgcaagacagattggttggaagagtttgcggttgcacttggattatgttggcgttggccgccggaagagaggaggcggttcttcagattttgagtacgctggaaaggatgcatgggcctccgcgtacagtgctgtcgccgccggggcggctctagttgccggccttggggtaatggcttacctgaaacgagcgggttaagctttgaggcaagcacaacagggagcacattactgcattggaatgaccagaatggctgtgtaattaattcttgtgaggaaaaagaaagaaaaaaactgtaataatacttcacggcagtggatgaccgccttcatactacacggtgttggtcaaagttttggtggttggaagtctccatgattactatggctgtcagtgtcgcgcttgtatttgtatcataaatcacatgatcagtatacaaccgagaagcatgattatgccttc

SEQ ID NO: 25548 - protein, 133 aa, Panicum virgatum
  misc_feature: Ceres CLONE 1864118-R
  misc_feature (2)..(84): Pfam Name: PB1 Pfam Description: PB1 domain
GFKIQDKPGRMHRFNCETSSLTDLITSILQRVGDDIDRKNLPQILYEDEDHDKVILSSDSDLIAAVDHARQIGWKSLRLHLDYVGVGRRKRGGGSSDFEYAGKDAWASAYSAVAAGAALVAGLGVMAYLKRAG

SEQ ID NO: 25549 - DNA, 241 bp, Panicum virgatum
  misc_feature: Ceres CLONE 1864154
  misc_feature: Encodes the peptide sequence at SEQ ID NO. 25550
aaggcacactcctctcctctcctctcctgctgcagtcccactagccatggatccaaccaagttccggccgtcgagcgcgcacgacggcggcgtgacgacgacgaacgccggcgcgccagtgtggaacgaacacgagggcctgagaggtggccccgcaggtggagcctcggggaggagagaaccacaagggaaaggaagggtggcccactccgcccccgagcacatcccggagggcgtgggc

SEQ ID NO: 25550 - protein, 64 aa, Panicum virgatum
  misc_feature: Ceres CLONE 1864154
  misc_feature: SWISSPROT Homolog: EC 1.11.1.6 Catalase
MDPTKFRPSSAHDGGVTTTNAGAPVWNEHEGLRGGPAGGASGRREPQGKGRVAHSAPEHIPEGV

SEQ ID NO: 25551 - DNA, 319 bp, Panicum virgatum
  misc_feature: Ceres CLONE 1864158
  misc_feature: Encodes the peptide sequence at SEQ ID NO. 25552
acatttcggtagctagctactagcaaagctcgggggcgacctggtgagcaaagtctacagggtatacaataccagcacatcgcagcgcagcgcttcgattaggaggatctcggaaggaggcagacggacccgatgacaatcgcagcggcggtgaccgcgcccacgaccgcgccagtgcacgccgcgccgcgccacgccgcgcccgcggtccagccgcgcgcgccgccgcgccgggacccgtcgccgctgaacccgaacacgccggcgcacgggcttcggtcggtggaggtccccgcccccttcctccctctgcggcgga

SEQ ID NO: 25552 - protein, 62 aa, Panicum virgatum
  misc_feature: Ceres CLONE 1864158
  misc_feature: Useful for making plants with altered carbohydrate content
MTIAAAVTAPTTAPVHAAPRHAAPAVQPRAPPRRDPSPLNPNTPAHGLRSVEVPAPFLPLRR

SEQ ID NO: 25553 - DNA, 1452 bp, Panicum virgatum
  misc_feature: Ceres CLONE 1864160
  misc_feature: Encodes the peptide sequence at SEQ ID NO. 25554
actcatcagtgctcactctccagctctcagcaaacactgcaagcgagagctagctaccaaagacaaggacacaatgccacccttacccaagagacccgggcctctccttgtcctcctcgttgtcgcattcgcggccgccgccgccgcctccgacgccaccgacgcgaccgtccccttctacccctccgcggaggccgccgcggccgcgcactgcgacggcacgctctaccctgacgtctgcctgtccacgctggccgacatcccggacctgcacaagaagcccctcccggacgtcatctgcgccgccgtgaaccgcaccgaggacgtcgtggcggccaccgcctccaactgctcctcctacctccgggagaggtccctgaccgcgcgcgaccgcctcgccctcagcgactgcctggagctcctgtccaccagcatggacgagctccaggccacggtcgcggacctggagtcccccgccgccaccggcggcggtggctcggcgtcgtcgtcgtccgcggtgggcgccaggcgcgtgacgatggaccacgtgatgacggtgctctcggcggccatcacgaaccagtacacctgcctgggcgggttcgcgtaccagaacggcgggcgcgtgcggcgctacatcgagccgacgctccaccacgtctcccgcatggtgagcaactcgctcgccatggcgaagaagctgcccggcgcgacgccgtcgccgccatcgccggcggcggcgcggcatccgttcatggggtacgggcagatggtgaaggggttcccgcggtgggtgcggcccggggaccggcggctgctgcaggcgccggcgtcgggcatcgcggcggacgcggtggtggcccaggacgggagcgggaactacacgacggtgtcggcggccgtggcggcggcgccgaccaactcgaagcggcggtacgtgatctacatcaaggccggggcgtacatggagaacgtggaggtcgggaagaagcacgtcaacctgatgttcgtcggcgacggcatcgggaagacggtcatcaaggccagccgcaacgtcgtcgacggctccaccaccttccgctccgccacagtcgctgttgtgggcaacaacttcctgggccgcgacctgacgatcgagaactcggctggcccgtccaagcaccaggcggtggcgctccgcgtgggcgccgacctctccgccttctaccgctgcagcttcgtggggtaccaggacaccctgtacgtgcactccctccgccagttcttccgcgactgcgacgtctacggcaccatcgacttcgtcttcggcaacgccgccgtcgtgctccaggcctgcaacctctacgcccgccgcccgctgcccaaccagagcaacatcttcacggcgcagggccgcgaggaccccaaccagaacacgggcatctccgtccaccgctgcaaggtggcggccgc

SEQ ID NO: 25554 - protein, 459 aa, Panicum virgatum
  misc_feature: Ceres CLONE 1864160
  misc_feature (259)..(459): Pfam Name: Pectinesterase Pfam Description: Pectinesterase
  misc_feature (37)..(206): Pfam Name: PMEI Pfam Description: Plant invertase/pectin methylesterase inhibitor
  misc_feature: SWISSPROT Homolog: EC 3.1.1.11 Pectinesterase
  misc_feature: Useful for making plants with altered carbohydrate content
  misc_feature: Useful for making plants with altered cell wall content and/or composition
MPPLPKRPGPLLVLLVVAFAAAAAASDATDATVPFYPSAEAAAAAHCDGTLYPDVCLSTLADIPDLHKKPLPDVICAAVNRTEDVVAATASNCSSYLRERSLTARDRLALSDCLELLSTSMDELQATVADLESPAATGGGGSASSSSAVGARRVTMDHVMTVLSAAITNQYTCLGGFAYQNGGRVRRYIEPTLHHVSRMVSNSLAMAKKLPGATPSPPSPAAARHPFMGYGQMVKGFPRWVRPGDRRLLQAPASGIAADAVVAQDGSGNYTTVSAAVAAAPTNSKRRYVIYIKAGAYMENVEVGKKHVNLMFVGDGIGKTVIKASRNVVDGSTTFRSATVAVVGNNFLGRDLTIENSAGPSKHQAVALRVGADLSAFYRCSFVGYQDTLYVHSLRQFFRDCDVYGTIDFVFGNAAVVLQACNLYARRPLPNQSNIFTAQGREDPNQNTGISVHRCKVAA

SEQ ID NO: 25555 - DNA, 665 bp, Panicum virgatum
  misc_feature: Ceres CLONE 1864160-R
  misc_feature: Encodes the peptide sequence at SEQ ID NO. 25556
cccgccgacctcgccggccgggaggcctccacgcggacgtacctgggccggccctggaagcagtactcccgcacggtgttcatgcagtcggagctggactcgctcatcgacccggccgggtggctcgagtggagcggcgacttcgcgctcgacacgctctactacggcgagtacatgaacacgggcgccggcgccggcacgtccgggagggtcaagtggaaggggtaccgggtgatcaccagcgcggcggaggccagcgccttcaccgtcgggtcattcatcgacggcgacgtctggctcgccggcacgtccatccccttcaccaccggcttgtgagcgctggccggccggcgattattcatcatcaatcatcagttgatcgatgcacgctgctgatgattcacatacagtgggctctggggaagatgtgtgtgtgtgtggcaaacaataaatgggtacggtggtggcgtgatttattgcggcattgagaggtacggtgtggaaaggcacccatagatgcatggttcggtcggtcgtgttgcgttgttgctgccgtcgttgattctttctgtactagtgcatagcgcgcgcctgtaaactttgcatcattccttgtaagacaatttgtatttaattttaaactattatatcaaatgcatcacgtt

SEQ ID NO: 25556 - protein, 111 aa, Panicum virgatum
  misc_feature: Ceres CLONE 1864160-R
  misc_feature (1)..(97): Pfam Name: Pectinesterase Pfam Description: Pectinesterase
  misc_feature: SWISSPROT Homolog: EC 3.1.1.11 Pectinesterase
  misc_feature: Useful for making plants with altered carbohydrate content
  misc_feature: Useful for making plants with altered cell wall content and/or composition
  misc_feature: Useful for making plants with modulated time to senescence
PADLAGREASTRTYLGRPWKQYSRTVFMQSELDSLIDPAGWLEWSGDFALDTLYYGEYMNTGAGAGTSGRVKWKGYRVITSAAEASAFTVGSFIDGDVWLAGTSIPFTTGL

SEQ ID NO: 25557 - DNA, 662 bp, Panicum virgatum
  misc_feature: Ceres CLONE 1864161
  misc_feature: Encodes the peptide sequence at SEQ ID NO. 25558
acccttcgcccccgaaggcccggcctcgccgcacccctcctcccgcccgcccccgccgatccatccaccctatacacgcgcctgtacagatccaaccctcatgatccggatcgccccgccccgcgccgatccgcgcgatttcctccgattttccctccgttttttggcccgaatttttttgcggcttttctctcttcttccatctgagcgctatggcctgggcgcgcgaggggcggcgccttccatggccatccccgccgggggctagggtgatttctcagcggggggaggggaccggacccaaccgatggagaagaagaacgtggcgatcccgctcgtgtgccacggccactcgcggcccgtggtggacctcttctacagccccgtcacgcccgacggctacttcctcatcagcgccagcaaggatacaaatccaatgcttcgtaatggtgagactggtgactggattgggacatttcaaggtcataaaggagctgtttggagctgttgtcttgacagaaatgctctgcgtgctgcatctgcatctgctgacttctcagctaaagtatgggatgcactgactggtgatgagctacattcatttgaacacaagcatatagtacgggcctgtgccttttctgaggatccccacctgttactca

SEQ ID NO: 25558 - protein, 118 aa, Panicum virgatum
  misc_feature: Ceres CLONE 1864161
  misc_feature (51)..(89): Pfam Name: WD40 Pfam Description: WD domain, G-beta repeat
  misc_feature: SWISSPROT Homolog: EC 2.7.11.7 [Myosin heavy-chain] kinase
MEKKNVAIPLVCHGHSRPVVDLFYSPVTPDGYFLISASKDTNPMLRNGETGDWIGTFQGHKGAVWSCCLDRNALRAASASADFSAKVWDALTGDELHSFEHKHIVRACAFSEDPHLLL

SEQ ID NO: 25559 - DNA, 719 bp, Panicum virgatum
  misc_feature: Ceres CLONE 1864162
  misc_feature: Encodes the peptide sequence at SEQ ID NO. 25560
caccccaacagcatagcatcctcctcctccgccttccttcacccgttgcagacttgcagcctctccttcctcctcctccgccctttcctagctcgctccctccaccgcggctgtagctagcggagcaggagcgaaagcaaaaggccatgggcgccctcctgctcttcgtctgcctcctggcgccgttcgtgctcgcctgcgccgcccgtggcaggaggcggcgggccgccgcgccggcgtgcggcaaggcgctgccgctgccgccggggtccatggggtggccgtacgtgggcgagacgttccagctctactcctccaagaaccccaacgtgttcttcgcccggaagcagaaccggtacgggcccatcttcaagacgcacatcctggggtgcccctgcgtgatggtgtccagcccggaggcggcgcgcttcgtgctcgtcacgcaggcgcacctcttcaagcccaccttcccggccagcaaggagcgcatgctgggcccgcaggccatcttcttccagcagggcgactaccacgcccacctccgccgcctcgtctcccgggccttctccccggaggccatccgcgcctccgtgccggccatcgaggccatcgcgctgcgctcgctccgctcctgggacggccagctcgtcaacaccttccaggagatgaagctgtacgcgctgaatgtggcattgctgtccatcttcggcgaggaggag

SEQ ID NO: 25560 - protein, 190 aa, Panicum virgatum
  misc_feature: Ceres CLONE 1864162
  misc_feature: SWISSPROT Homolog: EC 1.14.13.93 (+)-abscisic acid 8'-hydroxylase
MGALLLFVCLLAPFVLACAARGRRRRAAAPACGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHAHLRRLVSRAFSPEAIRASVPAIEAIALRSLRSWDGQLVNTFQEMKLYALNVALLSIFGEE

SEQ ID NO: 25561 - DNA, 1963 bp, Panicum virgatum
  misc_feature: Ceres CLONE 1864165
  misc_feature: Encodes the peptide sequence at SEQ ID NO. 25562
atcccgttcccgtggcgtgccttctagggtttccttcctccccccgcctccccgcgccgctccctcccgcccgccagatttggatctgcgctccagccccaggtgagcatgcgtcttcctcctccctctctgcacccacgaactcagccttctcctgctctagcacgagtagatccccattccgtttcgcgtctgatcctgtccctacggttcgcacgtatctccgcctccatcgatgatttggcgattgttacttcgcctgcgcccgccgttgcttgcgtttcacttagaaacgcatatcctccttttgctgttgttgttgttgttgttgttgttctttgatgcctcttgagttggccgtgcgctgggacagattctcgccccaaattcgcgcgtctcattctcccctctcgattccgtcatgggccgaattgccggtgaatttggaggggtgtggaaattttgacccccgactcatacgaggttgtccttgcatcgaggggaaaaaatatactacctgcagaactcattcagatcgcgtgtgcgtcattgcatactaaggagtaggacgtacttactacttagtactctccctgtccgaactccaagtcaacaatatactgcgtctgcaattcaaatcctattaatagccgccaccgatttttctctgtacatagacgatgacgtattgccttgctttggtgccacaatgtccacaccacacggagcaaactccgtatattagtagtatacacaagactctggcgcatatgtggaatcacgtactatcctgctggttttagggtgcctgcaactgccaggttgtttcttatatacaattatcacggcatgcacggctcctctagctatccgtcaccaatccggaaatcttgtccactcaccatttccttacctgcatgtatagattcacactacagctgcctgtgcaattccgggtgcaattgtgctagttcgcaagccaaattccaaaatagcaaatcatgaatagtgctttagttgcattccctgtatcacacctattgcaggttctctagtacttggctgtgctttatgccgtgcttttcgatttgttagcagttggtttgctcatttcatttgtgatgacatgaagtctgcatggattcaagcatgtagttatgtgcccaaagcgcttcagattcactcatggtatcatgtgcattgctttttcaccatcacacaaaatagtgtaattgtggaaacatgacgggtggtctgtttatatcttttaacctaattagaccagacagcatagttggtgacatccatctgcttctttcctcaaaaagatatctttgctgcatttaattttgtcgcccgtaacttcttcctattagcatttttaggaggcttgatgctgtttttggttgagatgtttctgataatgaaacagtgaaacatgcaaacgtggacaatgcttcctattttagtcactgttggacagtaacttcagtgtgtaccatgttacctagtgcagtcgatgttgggctatttcttcagcgtacattgttgcttacctaggaagaccaaatcaaatcagtttacctggtaaccttttattcttgccaggttgttccgatggctcctgctgtagaagctgtgaacgaggcaggctcattccaaaaggttcctgctctgaatgaaagaatactgtcatccatgtccaggagatctgttgctgcgcatccttggcatgatctggagattggtattctactcatctgacaaactgtcaatcttctcttgattgctatgagatacttatgtttcttgcttcatgcaggacctggtgcaccaaccatattcaactgtgtaaggacatcatgtgatacttcactgatcaattgatcttttgttacttaacattgatggatacttttgcaacatgttaatttcaatatcacaatattttgtcttttcttgg

SEQ ID NO: 25562 - protein, 48 aa, Panicum virgatum
  misc_feature: Ceres CLONE 1864165
  misc_feature: SWISSPROT Homolog: EC 3.6.1.1 Inorganic diphosphatase
  misc_feature: Useful for making plants with modulated nitrogen use efficiency
MAPAVEAVNEAGSFQKVPALNERILSSMSRRSVAAHPWHDLEIGILLI

SEQ ID NO: 25563 - DNA, 745 bp, Panicum virgatum
  misc_feature: Ceres CLONE 1864174
  misc_feature: Encodes the peptide sequence at SEQ ID NO. 25564
atttcgctctctctctctctctctctctctctctctcgcaactcgcgatttcttttactgtgctcgttccggcgtgcggcggcggagctccctacgacgactgagccatgtgcggcggtgcgatcctcgccaacctcaccaagcagccgggcccgcgccggctcacggagcgggacctctggcaggagaagaagaagcccaagaggagcgccggcgggggtaggcgctggttcctggctgaggaggatgaggacttcgaggccgacttcgaggacttccagggcgactccgacgagtcagatttggagttcggggagggggaggacgacgacgtcgtcgagatcaagcccttcgccgccaagaggacttcctccaaagatggcttaagcaccatgattactgctggttatgatggccctgcagcaaggtcagccaaaaggaagagaaagaatcaatacaggggcatccgccagcgcccttggggtaagtgggctgctgagatcagagatcctcagaagggtgttcgtgtctggcttggtactttcaacagtcctgaggaagctgcaagagcttatgatgctgaagcacgcaggatccgtggtaagaaggccaaggttaacttccctgatgcaccaacagtttctcagaagcgtcgtagtggcccagctgccgctaaagcacccaagttaagtgtggaacagaagcctactgtcaaaaccgcagtgaacaaccttgcccacgcaat

SEQ ID NO: 25564 - protein, 212 aa, Panicum virgatum
  misc_feature: Ceres CLONE 1864174
  misc_feature (115)..(166): Pfam Name: AP2 Pfam Description: AP2 domain
  misc_feature: Useful for making plants with altered alkaloid content
MCGGAILANLTKQPGPRRLTERDLWQEKKKPKRSAGGGRRWFLAEEDEDFEADFEDFQGDSDESDLEFGEGEDDDVVEIKPFAAKRTSSKDGLSTMITAGYDGPAARSAKRKRKNQYRGIRQRPWGKWAAEIRDPQKGVRVWLGTFNSPEEAARAYDAEARRIRGKKAKVNFPDAPTVSQKRRSGPAAAKAPKLSVEQKPTVKTAVNNLAHA

SEQ ID NO: 25565 - DNA, 1508 bp, Panicum virgatum
  misc_feature: Ceres CLONE 1864175
  misc_feature: Encodes the peptide sequence at SEQ ID NO. 25566
atcaaacgctagttcgtcctcctcctcgattgcccccgatccccaccgggcgaccgccggaaccctagctagccgtagatccaccgcgcggccgccgccatggggaccctcaaggatctcctcccggcgcccaagacgtcggcgtccaccttctacgaccacagcagcgacccctggttcaaggagcggtacggcggggagtcggcgcaggcgtcggccgcggcgaggcccgcgggcgccgccagggccatcccttcgtacgggaagcggacggggttcgtgccgcgccggccggaggactttggggatggcggcgccttcccggagatccatgtcgcgcagtatccgctcggcatgggccgccgcgacgacaagggcgggtccaagatcctcgcgctcaccgtcgacgcgcacgggagcgtcgccttcgacgccgtcgtcaagcagggcgagaacgccggcaagatcgtctactccaagcacagcgacctcgtgccgaagatcgccacgtccgattcgcaggcgccggacgatgacgacgaggagcagaagcagatcgaggagaccacagagcggacgaaggctgccctggagaaggttgtcaacgtccgcctttcagctgctcagcccaagaatgtgccgacacatgattctgagtccaagtttatcaagtataagccgtcacagcaatcagcggccttcaattcaggtgccaaggagaggatcattcggatgtcggagatggcagtggatcctcttgagccaccaaagttcaagcacaagcgtgtgccccgggcgtctgggtcaccacctgtgccggtgatgcactcgccaccgcggccagttacagtgaaggatcagcaggattggaagatcccaccatgcatttctaactggaaaaatcctaagggttacacgattccacttgataagaggctggcggctgatggaagagggctacaggaggtgcaaattaatgacaactttgcaaagctttctgaagcattgtatgtggcagaacagaaggcgagggaggcagtacagatgcgctccaaggtgcagagggaactgatgctgaaggagaaggagagaaaggagcaagaactgagggctcttgcacagaaggctcgcatggagaggactggtggccctcccgcaccatcagctgtgcctgctggtggtgtcaggggaacaattgatgctatcgatgaagatatggatatggagcaaccgcgtgagccgcgcagggagagtagagaagagagggaagcgaggattgaacgtgatagaatccgtgaggagcgcagacgtgagcggaagaaggaagagaaggtggaggagaaggaagaaagcgatgatgtaagatcactcctcttgccattgtttcccagttgtttttgtagcattttctgcaaagatcctgtggaactctgtttttgaaaaatagctagttaccattttcaatgatcatatgccatatcacttgaatgtcatgttgctattccatc

SEQ ID NO: 25566 - protein, 446 aa, Panicum virgatum
  misc_feature: Ceres CLONE 1864175
  misc_feature (187)..(353): Pfam Name: SKIP_SNW Pfam Description: SKIP/SNW domain
  misc_feature: Useful for making plants with modulated biomass
  misc_feature: Useful for making plants with modulated flowering time
MGTLKDLLPAPKTSASTFYDHSSDPWFKERYGGESAQASAAARPAGAARAIPSYGKRTGFVPRRPEDFGDGGAFPEIHVAQYPLGMGRRDDKGGSKILALTVDAHGSVAFDAVVKQGENAGKIVYSKHSDLVPKIATSDSQAPDDDDEEQKQIEETTERTKAALEKVVNVRLSAAQPKNVPTHDSESKFIKYKPSQQSAAFNSGAKERIIRMSEMAVDPLEPPKFKHKRVPRASGSPPVPVMHSPPRPVTVKDQQDWKIPPCISNWKNPKGYTIPLDKRLAADGRGLQEVQINDNFAKLSEALYVAEQKAREAVQMRSKVQRELMLKEKERKEQELRALAQKARMERTGGPPAPSAVPAGGVRGTIDAIDEDMDMEQPREPRRESREEREARIERDRIREERRRERKKEEKVEEKEESDDVRSLLLPLFPSCFCSIFCKDPVELCF

SEQ ID NO: 25567 - DNA, 552 bp, Panicum virgatum
  misc_feature: Ceres CLONE 1864177
  misc_feature: Encodes the peptide sequence at SEQ ID NO. 25568
gccgccggaagtgcatagctccaccaaaaccatcgctccaaaagatcctcaaccaccgatgggactgtctccgcctctccgggactccaggaatcgcggcagctccggccggcctaagaagctgccgggataccatggtgaacggctgcagcggcgccgcggagctcgcgccctccgctggtacgcccggcgcccacttcactcgccggccgtctcgtcctccgcgccgctcgccggttgcccaactcccgtcaccgctcgccgccgccgccgcccgaaacccccgcgtcgacgcccgcagcctgctcgacggaatgcctcgtgccgagagcaagagagcggcttgctgcgacggcattgatgtcctcccggacgaagttctgcagcacatcctcggcttcctggaggcgcaggagtccgtgcggacctgcgtgcttgcccgccgctggcgccacctctggaagtcggccacgggcctgcgcattgccgcggacgaggacgagttcttggggtccgtggaaaagctctgcgattttgtggacagtctactgc

SEQ ID NO: 25568 - protein, 79 aa, Panicum virgatum
  misc_feature: Ceres CLONE 1864177
  misc_feature (13)..(60): Pfam Name: F-box Pfam Description: F-box domain
MPRAESKRAACCDGIDVLPDEVLQHILGFLEAQESVRTCVLARRWRHLWKSATGLRIAADEDEFLGSVEKLCDFVDSLL

SEQ ID NO: 25569 - DNA, 2135 bp, Panicum virgatum
  misc_feature: Ceres CLONE 1864189
  misc_feature: Encodes the peptide sequence at SEQ ID NO. 25570
cgatctcctctcccctccctccctctccgtgcgctcgagcgcattcccgttctccgcggtagaggaaccctaacgctccccggatcccgcggcggggtgcaatagccgcgccggcgttcctgcccgagctggccacgcaggtggtggtgcccgtcgcggccgtggtgggcatcgccttcgcggtgctgcagtgggtgttggtctccaaggtgaagctctcccccgacccgcggcgcggggacgggtcctccccgaagagcggcaccggccccagcgagtacctcatcgaggaggaggaggggctcaacgagcacaacgtcgttgtcaagtgcgccgagatccagaacgccatctccgaaggagcaacttctttccttttcactgaatataagtatgttggactattcatgggtatttttgctgtcctgatcttcctcttccttggctctgttgaggggttcagtaccaagagtcagccttgccactacagcaagggcaagacgtgcaagcctgcccttgccaatgctcttttcagcaccattgcctttgttcttggtgcagtcacctcacttgtttctgggtttcttggaatgaagattgcgacatatgcaaatgccaggacgactcttgaggcaaggaagggtgtcggaaaggcattcattactgctttccgctctggtgctgtgatgggcttcctgcttgctgccagtggcctttttgttctttatattgcaatcaacttgttcggaatttattatggtgatgactgggagggcctttatgaggctatcactggttatggtcttggtggttcttctatggctctttttggccgtgttggtggtggaatatacaccaaagctgctgatgttggtgctgatcttgttgggaaagtcgaaaggaatatccctgaagatgatccaagaaacccagctgttattgcggataatgttggtgataatgttggagatattgctggaatggggtcagatctctttggctcctatgctgagtcttcatgtgctgctctagtcgttgcctcaatctcttcttttgggatcaatcatgaattcactcctatgttgtacccacttcttgttagctctgtgggtatcatagcttgcttgataaccactctttttgcaaccgatttcttcgagatcaaggctgtcgacgaaattgagccggctctcaagaagcaacttataatttccactgctgtgatgactgttggcattgcacttgtcagttggttagggctcccatatacattcacaatcttcaattttggtgcacagaagacggtgtataactggcaattattcctctgcgtcgctgttggtctgtgggctggactagttattggatttgttacagagtattacacaagcaatgcgtacagccctgtgcaggatgttgctgactcctgcagaactggagctgctacaaatgtcatctttggccttgctctgggatacaaatcagtcattatccctatttttgctattgctttcagtattttcctcagcttcagccttgctgcaatgtacggtgttgctgtgactgctcttggaatgctcagcacaattgctactggccttgccattgatgcatatggtcctattagtgataatgctggaggaattgctgaaatggctggcatgagccacagaatccgtgagagaacagatgctctcgatgctgctggaaacactactgctgccattgggaagggttttgccattggttcagcagccttggtatctcttgccctctttggtgcttttgtgagccgtgctgagatctcaactgttgatgttttgacacctaaagttttcattggactgattgttggtgctatgcttccatactggttctcagcaatgaccatgaagagtgttggcagtgcagcactcaagatggttgaggaagtccgcaggcagttcaacaccatccctgggctcatggagggcaccaccaagcctgactatgcaacgtgtgtcaagatctccactgatgcatccatcaaggagatgatccccccaggtgcacttgtcatgctcacccctcttattgttgggatcttgtttggtgttgagaccctctctggagttcttgctggtgctcttgtttct

SEQ ID NO: 25570 - protein, 575 aa, Panicum virgatum
  misc_feature: Ceres CLONE 1864189
  misc_feature (1)..(575): Pfam Name: H_PPase Pfam Description: Inorganic H+ pyrophosphatase
  misc_feature: SWISSPROT Homolog: EC 3.6.1.1 Inorganic diphosphatase
  misc_feature: Useful for making plants with modulated water use efficiency
MGIFAVLIFLFLGSVEGFSTKSQPCHYSKGKTCKPALANALFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLVSSVGIIACLITTLFATDFFEIKAVDEIEPALKKQLIISTAVMTVGIALVSWLGLPYTFTIFNFGAQKTVYNWQLFLCVAVGLWAGLVIGFVTEYYTSNAYSPVQDVADSCRTGAATNVIFGLALGYKSVIIPIFAIAFSIFLSFSLAAMYGVAVTALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALV

SEQ ID NO: 25571 - DNA, 769 bp, Panicum virgatum
  misc_feature: Ceres CLONE 1864189-R
ttttggaattacgataatttctcagtttaaaatttggatactatgatgatcaacatgcagtggtagaaggttccgagcatatttgggggattcaagcgacgtgggggaattttatggttacaacatacttacactcatttctaagctttgctctgtttcatcatgttatgctttgaacatagctttaatccggtgttgcttctctatgttcgcagatcatttagcccaactagttgctagttcatccatctgatttggtcataaaatgttcggtttgggatttctctctggtttgatttgctctatctatatttttgtgcgtgcttcttcatgtggtggctgcaggattagtttggcattgggaacttcctgcatctaagaactggcacttgaaattgggggcaggtcagagtctagtgcacgattttggttagtattggttccattacttgtattcagtcttttcagatctgaatggttggatgatattttgcctctccaatgggatgatgacgaggtttgagactctgaatttattcagtattgtataagctgatctttgttctggtgtgttttgtgtcattcagagatgcaggtggggcattggttgtggaggttggttgatgtagaaggtttggttatggttgacagtagttttgctatttctgtgtcattatgatgatattagacattacatctttaatgccagcgcttcaattgtgatcgatgttcaaatctatagaatgcttggaagcaacactttgactgg

SEQ ID NO: 25572 - DNA, 741 bp, Panicum virgatum
  misc_feature: Ceres CLONE 1864193
  misc_feature: Encodes the peptide sequence at SEQ ID NO. 25573
acagtagtccactgcctccaaaccctctgctccatctccaaactgccaactccgacgcccgccgccgccgccgccgcgacgcaacgcgtagatccaaacccccagcccacgccacctccgccgccgctgaaccgcgtccacgcggccgccccaggccccggcgttgctcaagcagaaccgaagatggcgcgccgagggttgatggagcaggatctgagcacgctcgacgttttcaagctgagccctctgtcgccggaggtgatttcgcgccaggcgacgatcaacatcggtaccattgggcacgtggcccatgggaagtctacggttgtcaaagcaatctcaggtgtacagacagttcgtttcaagaatgaactggagcgcaatatcactataaagcttggttatgctaatgcaaaaatctataaatgtgaagatgatagatgcccacggccaatgtgctacaaggcttatggcagtggcaaagaagatagtcctctctgtgacgttccagggtttgaaaactgcaggatgaagctcttgagacatgtttcatttgttgattgcccggggcatgacattctcatggctacaatgcttaatggagcagctatcatggacggtgcactacttctgattgcagcaaacgagagctgtccccaaccccagacatctgaacaccttgcagctgttgaaattatgcgccttcaacatattatcattctgcagaacaaaattgatctt

SEQ ID NO: 25573 - protein, 185 aa, Panicum virgatum
  misc_feature: Ceres CLONE 1864193
  misc_feature (30)..(185): Pfam Name: GTP_EFTU Pfam Description: Elongation factor Tu GTP binding domain
  misc_feature: SWISSPROT Homolog: EC 2.1.1.43 Histone-lysine N-methyltransferase
MARRGLMEQDLSTLDVFKLSPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKID

SEQ ID NO: 25574 - DNA, 1474 bp, Panicum virgatum
  misc_feature: Ceres CLONE 1864213
  misc_feature: Encodes the peptide sequence at SEQ ID NO. 25575
attggtggcaggagtatattattgctcaaggtaggagtgagaggttagaacagctcaagtctagagagggaaccaaaagggaaaaataacaaaaagaatagacacagctctcttcttcttattccaatcttctttcatctgctgattccttcttagaatcatttggatcagccctgtccccttgctgggtggtttcttttatagtcaagaactcttgcttgcttggtctcaagttcagtttcttgaagaggcactttgaaagccttgggaactgtgttcggaagtgcattaatctgaagttcatcgtcccagatcctgtttttgcagctttcataataccagtctgatgataagatcaatcactacctctcgtcaccactctgatgatccatcagctggcctcatcttctgcttctgaagaggatggccacattcttctccgcttctaccgatcagagggacctcgccgccgccggcgacatgtcgttccaccactacaccacgtccaatccgtactcggatacaccaaccggtggtctgatacctttccccgccaccatcatgtctgaaggccacgtcgcgcatggcggcgacggcagggacgagccgacctcgttcttgaacgcgcgggacgggccatcgtgcggcgccgagatgggcctgcagacgcagctgctgatggcgaacgcgtcggcggcgcagcaccagggtctatcgcttagcctcgggactcaaggcgtgccggtggcgtctctttaccagtaccgccaggcaggcatggccgccgcctccttgcttagcccgggccagacgacgacggcgagcaggaacgcacagagcatctacatccagaactcaaagtacctgaaggccgcgagggagctgctggacgaggtggtcaatgtccgggacgcgatcaagcgcaagggagacaagaaccaccagagcaaggattccggcgagggcaaggatgccgagaagagcgaggagaaggccgacgagcacgagggcaactcctccgccgagctgacgccgtcagagaggcaagaccttcagaacaaagtgtcggcgctgatggccctgctggatcaggtggaccggaagtacaggcactaccgcaaccagatgcagatggtcatgtcgtccttcgacgaggtggccggcgccggcgcggcgaggccgtacacggcgctggcactgcagacgatctcccgccacttccggtcgctgcgtgacgccatcggcgcgcaggtgcagtccctgcggcggagcctcggcgagaaggacagctccgcgcagggcggcaggctgtcccggctgcgttacatcgaccagcagctccggcagcagcgcgccatgcagcagttcggcatgatgcagcagccgcagcacgcctggcgcccgcagcgcggcctcccggagtccgccgtctccgtgctccgcgcctggctcttcgagcatttcctccacccgt

SEQ ID NO: 25575 - protein, 350 aa, Panicum virgatum
  misc_feature: Ceres CLONE 1864213
  misc_feature (140)..(275): Pfam Name: POX Pfam Description: Associated with HOX
MATFFSASTDQRDLAAAGDMSFHHYTTSNPYSDTPTGGLIPFPATIMSEGHVAHGGDGRDEPTSFLNARDGPSCGAEMGLQTQLLMANASAAQHQGLSLSLGTQGVPVASLYQYRQAGMAAASLLSPGQTTTASRNAQSIYIQNSKYLKAARELLDEVVNVRDAIKRKGDKNHQSKDSGEGKDAEKSEEKADEHEGNSSAELTPSERQDLQNKVSALMALLDQVDRKYRHYRNQMQMVMSSFDEVAGAGAARPYTALALQTISRHFRSLRDAIGAQVQSLRRSLGEKDSSAQGGRLSRLRYIDQQLRQQRAMQQFGMMQQPQHAWRPQRGLPESAVSVLRAWLFEHFLHP

SEQ ID NO: 25576 - DNA, 646 bp, Panicum virgatum
  misc_feature: Ceres CLONE 1864213-R
acgcgaccagcctcaacctcggcgccgtcggcaacggcagcagcagcctcctgcaggacgcgctcgcgcaccaccacggcgacgcgaggttcgtggcgtacggcgacatgggcggcctcggcggcggcggctacgacggcggcagcgtgtcgttgacgctgggcctgcagcactgcaacgacgccgggaccgtgccggccgaacagcagggcctcctgtacggcaacgccggcgacttcgagttcatgaacggctccgaggacaggcagcggttcggctcgtcgcagctgctgcacgattttgtcgcgtgagcgcgcgcggctggggtgctcgttgggaataacgcggacggcgtcagaagcctgggatggccggccggcgccgccgcgggtatatatacataccgggatcacagttcagttcatcatggtacacggtttcatcaaacaagtaagtatacgcatgtactggtgtggtaagtgaggtagtagtgggaaatggggggtatacaaaactgtatatgaggtgtggtaagttgtagggtgctgtaaaaggatatttagattggtatttttggtagcttgaagattcgtgtactgatgattcaagtcccatatatgatgtgttgttggtccaattggacctc

SEQ ID NO: 25577 - DNA, 739 bp, Panicum virgatum
  misc_feature: Ceres CLONE 1864219
  misc_feature: Encodes the peptide sequence at SEQ ID NO. 25578
acaagcccacaacacacgcaaccaaagcacggttgctacccacctcgccccgagacaacagcagtgctcaccgccgggcatggactcgccgctgggccggcctgcgctgctcgcgctatccgtgctcctcctcgtcgcgctctacctcgcgcgccggcgccgcgcccgcggcaagaaccggaagtacccgccggtggccggcaccgtgctgcaccagctgctcaacttcgaccgcctggtggagtaccaaaccgagctcgcccgcaggtacggcaccttccgcatgctcaccccgacctgcaactacgtctacaccgtcgagcccgccaacgtggagtacatcctcaagaccaacttcgccaactacggcaagggggtgatgacgcacgacgtgctggaggacctcctcggcgacggcatcttcaacgtggacggcgccaagtggcggcaccagcggaaggtggccagccacgagttctccacgcgggtgctgcgcgactacagcagcgccgtgttccgcgacacggccgcggagctcgcgggcatcgtggccgccgcggcgcggggcgacggggagagggtggatatcgccgacctgctgatgcgctcgacgctggactccatcttcaagatcgggttcggggtctaccttggctccctgtccggttgcagcaaggagggcgcggcgttcgccagggcgttcgacgacgccagcgagcaggtgctgtaccggttcttc

SEQ ID NO: 25578 - protein, 219 aa, Panicum virgatum
  misc_feature: Ceres CLONE 1864219
  misc_feature: SWISSPROT Homolog: EC 1.14.14.1 Unspecific monooxygenase
MDSPLGRPALLALSVLLLVALYLARRRRARGKNRKYPPVAGTVLHQLLNFDRLVEYQTELARRYGTFRMLTPTCNYVYTVEPANVEYILKTNFANYGKGVMTHDVLEDLLGDGIFNVDGAKWRHQRKVASHEFSTRVLRDYSSAVFRDTAAELAGIVAAAARGDGERVDIADLLMRSTLDSIFKIGFGVYLGSLSGCSKEGAAFARAFDDASEQVLYRF

SEQ ID NO: 25579 - DNA, 1759 bp, Panicum virgatum
  misc_feature: Ceres CLONE 1864230
  misc_feature: Encodes the peptide sequence at SEQ ID NO. 25580
gtccgaaacaagccgacgaacgcgacctaggaagcggaagcgggagggagggaaaagggcgaaatcaccgccgccgtcagcaccgattgatcggtgaggccgatgcgccgccccccgctcggccggcaccgtatcccgccgcgttaatgtccgccgccctcgccgaggccccgagtcggggaccgccgcttcggtttggccgcggccggtaggttggttggctctcatctcctcttttcttttgttttcaaggactggacaccgagtcgccttcacctaccatgtgctgctggtgagttcgttgggggtccgtgcggagggagccgctcctcatttcgctggtcctggcaggctccgtgggggattccggacgcggggggagggggagtccttgtctccttgaggccgcattgcagcacggacttgcatctaacgccgcggtttcggcggttcgattcgtctgatcccccgttttgttgtgctcaaagcctgaaactgtgcggctgtatgatagggagcgttggcgctagctcgattggccggggaattcagggggcttgtctcagcctagcctggaattgatggagcagaagagagcaagggcagcggaggagcctgcccggttgatgtgtgatgatgcgctaacagaggtcttccgcaggctgcctgcccgtgcgctcgccgcttgcaggctggtgtgcaagtcctggataacggtgctcacggatccacacttcatccacgagcaccttagccgcggccggcagaagctgctgctctttgcgagcgaccgggtgagcgataggtcgctcgccatggtgcttgcggatgacaacaagtccatgtaccagttgtcgaggcctgctgcgtctcggagcgtgtttgtccacaattcatgcaatgggctgctgtgcctgggtgacagtacaggagccgtggaggtgctgaacccgacaaccggtgaatctctaatgttgccaactccgacgtacacagcagggagcagccagttctcatcctgtaattggcactgcttggggttttgtccaaagacgagggagcacaaggttgtgcatttctatcctggaacacatattgattcgttcaaggtgcgctgtgagatatacacacttggagctggtgtctggagacaagttgggagcttccgtggtgctccgatagatagaggggtgcatgtgaatggagcagtgtactatctgacaaagtttcgctacattgcttcatctcgtatcaattgcttgaatcttgagagcgaaaaaattgatgcgatgatgcttcctccacgcaagtcttatggagggcattgctctttgacggagcttgaaggaagggtatgcttgttagttgtggatggtgtgcttgaaggtccgcctcgtacgatggacatattgatgctcaatagtgatgagcagagctggactcccagataccacttctctttgccttggttgatgccttcctgttattttactccgaagcacacactcttccacgacgggaaaatttgggtgcaattgttggctaggaatctctactgttttgatccaacatcaaattctgaagaattgacaatagcgtggccagagcttgactttccgtttagcacacatactttcattgagagcatagttcctttgcggaaagactacttcatcaagcacatacagtgacagtggtgttctgccccttgttttccaaggtggttttcagtttacagcattacagtgtcttagttgtt

SEQ ID NO: 25580 - protein, 369 aa, Panicum virgatum
  misc_feature: Ceres CLONE 1864230
  misc_feature (11)..(58): Pfam Name: F-box Pfam Description: F-box domain
MEQKRARAAEEPARLMCDDALTEVFRRLPARALAACRLVCKSWITVLTDPHFIHEHLSRGRQKLLLFASDRVSDRSLAMVLADDNKSMYQLSRPAASRSVFVHNSCNGLLCLGDSTGAVEVLNPTTGESLMLPTPTYTAGSSQFSSCNWHCLGFCPKTREHKVVHFYPGTHIDSFKVRCEIYTLGAGVWRQVGSFRGAPIDRGVHVNGAVYYLTKFRYIASSRINCLNLESEKIDAMMLPPRKSYGGHCSLTELEGRVCLLVVDGVLEGPPRTMDILMLNSDEQSWTPRYHFSLPWLMPSCYFTPKHTLFHDGKIWVQLLARNLYCFDPTSNSEELTIAWPELDFPFSTHTFIESIVPLRKDYFIKHIQ

SEQ ID NO: 25581 - DNA, 713 bp, Panicum virgatum
  misc_feature: Ceres CLONE 1864233
  misc_feature: Encodes the peptide sequence at SEQ ID NO. 25582
ctggctgctgctggtttgggtttggtgtcgctgccggtggctgttggaacgagagcgtcagctgccagtcgcgccaatcaatggcggggccggggaggtgaaggtgctttccccccctctcttcgccgtcgcttcggcttcgagaaggcgccggccccaaccccaacgaagaacaaggtgggctgccgtcgatccttctccttcctccggcgatcgtaggtcgaggaattggggatttttttttgcccccagcaagcagcagcgacgagcctcgctgccgaagcagcaggcggagcatgcgccgcgtccgggtgtcctcggaccaggcccccgtccgcaagctcggcgacgcgcagatggcgctcacgcccaagttccgcctcgccaccgccgccgtccccgcgcccccggagggcccccagcagcagcagctgccggcctgggagacgccgctcatcccggggctccccgacgacgccgcgctcggctgcctcctccgcctccccgtcgaggcgcacgcggcctgccgcctcgtgtgccgccgctggcgccacctcctcgccgacaaggcgcgcttcttcgcgcagcggcgggcgctgggcctccgcgccccctggctcttcaccctcgccttccaccgctgcacggggaagatccagtggaaggtgctcgacctcggccacctcacctggcacgccatccccgccatgccc

SEQ ID NO: 25582 - protein, 138 aa, Panicum virgatum
  misc_feature: Ceres CLONE 1864233
  misc_feature (52)..(99): Pfam Name: F-box Pfam Description: F-box domain
MRRVRVSSDQAPVRKLGDAQMALTPKFRLATAAVPAPPEGPQQQQLPAWETPLIPGLPDDAALGCLLRLPVEAHAACRLVCRRWRHLLADKARFFAQRRALGLRAPWLFTLAFHRCTGKIQWKVLDLGHLTWHAIPAM

SEQ ID NO: 25583 - DNA, 1801 bp, Panicum virgatum
  misc_feature: Ceres CLONE 1864235
  misc_feature: Encodes the peptide sequence at SEQ ID NO. 25584
caagcattgcattggatggctattgcacatgcagaagcctatgattacatacatttgaaaagcaaaaatggaaggaagccaatcgttggtgtcgctcatcatgtatcatttacacggccgtatggactattcgatgttgcggctgtcactgtagctaatacattgacccttttcccttacattgatagcatctgtgataaactggactttattggaatcaactactatgggcaggatgttatatcaggtcctggtctaaagcttgtggacaatgatgagtacagtgaatctggtcgtggcgtttatcctgatgggctattccgtatcctgattcagtttaatgaacgatacaagagcttaaatattccttttctgatcactgaaaatggagtttctgacgagactgatctgattcgtgaaccatacattctggagcacctgttagccatctatgctgcaatcattatgggtgtgcttgtacttggttatctattctggacaacatcagataattgggaatgggcagatggctatggtcccaagtttgggcttgttgctgttgatcgtgctaacaacctagcacgggaacctcggccttcatactatttattctccaaggttgttacaactgggaaaataacaagacaggacagattgtgtgcttggagggaactgcaacaagctgcatttcaaaagaaaacacgcccgttttttagagcagtagacaaacatggtcggatgtatgcagggggtctagatcggcctattcagagacctttcatattaagggattggagatttggtcattatgaaatggaaggcttgcaagatccttttagtcgctttataagatctattatttcaccaatttcacaaaaaaagaagattcattacattgaggatgatgatgtttcttattctatttcctgatgatgcctgttactctagttggttagtaagataacttgtcctctagatgaagtgaagtaaataaaaaggtcttggcatcagaagtttctctttttggaggaaccaccaagtgtactctttatcatggcattttgttgcaggacccatggatctcagagcagccaaggactgggcaccagaatactgtgggtttgtccgtggttcataatcatatttgttcattcatcctgtcaaaatcacatacctgatcatttccgagcctgcgaatcttgagaaaaccacacttcttccaacaaagcaacatcatacgacttcggcactgggcacatctgaagccggtgataggtaccatgatactgctgggcggcacagcgatcctattaattccttgcttggattacagctatctatggcgacgcaagattattgttagcttggcatatatgattaatgcaagcaatcggatatcaggcaggcaggcagcatgggaagatcagaacgcatcatcagccttgagccccatgatggatgcttatcgtggcatgtttgcagttcttgacccaagcagatgtgaccattctcaatggctatccatggatatcatccccttgtgttgtgtgggataggacgaaggcatggacttggatggagatggagttagtgcagctgcaagcttaactgaaaccatctcctaagttggtgccatgtcttttccatagtatgggcatagaaaaactgcattgtgtgtcgccgcctcatgtagtcatgtattgcgaggaaaaagacatgatgatcctgtatttgtgagcgtaatacagtgtgtgccctatatgttgtcagtagaataatagaactgacagagtgacagtgc

SEQ ID NO: 25584 - protein, 309 aa, Panicum virgatum
  misc_feature: Ceres CLONE 1864235
  misc_feature (1)..(213): Pfam Name: Glyco_hydro_1 Pfam Description: Glycosyl hydrolase family 1
  misc_feature: SWISSPROT Homolog: EC 3.2.1.23 Beta-galactosidase
  misc_feature: Useful for making plants with altered cell wall content and/or composition
QALHWMAIAHAEAYDYIHLKSKNGRKPIVGVAHHVSFTRPYGLFDVAAVTVANTLTLFPYIDSICDKLDFIGINYYGQDVISGPGLKLVDNDEYSESGRGVYPDGLFRILIQFNERYKSLNIPFLITENGVSDETDLIREPYILEHLLAIYAAIIMGVLVLGYLFWTTSDNWEWADGYGPKFGLVAVDRANNLAREPRPSYYLFSKVVTTGKITRQDRLCAWRELQQAAFQKKTRPFFRAVDKHGRMYAGGLDRPIQRPFILRDWRFGHYEMEGLQDPFSRFIRSIISPISQKKKIHYIEDDDVSYSIS

SEQ ID NO: 25585 - DNA, 2237 bp, Panicum virgatum
  misc_feature: Ceres CLONE 1864246
  misc_feature: Encodes the peptide sequence at SEQ ID NO. 25586
aggcaaacgagtgaactcaaactgcgaccaccctgatccgtctccctctcgtcttcctctgcccgctcgcaccccggagcccccgagcgagaacggagcgcgagctgccgccgccagcagccgcggcgggcaccatggtgagtcacctggcggggccaattcctgggcatttccttagctcgatcttccttgttgctgatctctggtggccgcgcgcggtcgtggcgcgcaggaggacggcggcaacgcacggcgcgcggagcggtgggaggggtacgtgaactggcggaaccggccggcgaccaggggccggcacggcggcatgctcgcggcgtccttcgtgctcgtggtggaggtgctggagaacctagcgttcctggcgaacgcgagcaacctggtgaggtacctgatggggttcatgcactactcgccgtcgcagtcggcgacgacggtgaccaacttcatgggcacggcgttcctgctcgcgctcctcggcggcttcctctccgacgccttcttcaccacctacaccatctacatcgtcagcgccttcatcgagttcatggggctggtgatcctgacggtccaggcgcggacgccgcacctgatgccgccgccgtgcgccaccaccgccacgggggctccggcgccgtgcgcgcccgtgtctgggccccggaaggcgatgctcttcgcggggctgtacctcacggcgctgggcgtgggcgggatcaagggctccctgccctcccacggcgccgagcagttcgacgagcacgcgccgcggggccgcaaggcccgctccaccttcttcaactacttcgtcttctgcctctcctgcggcgcgctcgtcgccgtcaccttcgccgtctgggtcgaggacaacaggggctggcagtggggcttcggcatcgccaccatcgccatcctgctctccgtcccggtcttcgccgcgggctccggcctctaccggaacaaggtgcccacggggagcccgctcaccaccatcgccagggtcctcgccgccgccgccctcgcgcgccgcgccggcgcgcagagcgccagcaacggcgctgtcatcgaccgcgcgcccagccccacggggagcaccgacatgaaggactactgcaagcccggcgacatggtggccaacatcgccgccggcgccgggccggccgagccgtcgcgggagctcgcgttcctcaaccgcgccgtgcggtgccaggaggagcagccggggcaacagaacgggcgcctcgcgtgcacggtgcaggaggtggaggacgtcaagatcgtgctcatggtgctgcccattttcttctccactatcatgctcaactgctgcctggcgcagctgtccaccttctccgtcgagcaggcggccaccatggacacgcgcgtcggcaggctcaccgtgccgcccgcctcgctccccgtgttcccggtcatgttcatcatcctcctcgcgcccgtctacgaccacgtgatcatcccgttcgcgcgccgcctcacgggcaccgagatgggcatcagccacctccagcgcatcgggaccgggctcatcctctccatcgtcgccatggcggtggccgccgtcgtcgaggtgaagcgcaagaacgtggccgccgacagcggcatgctggactcgccgaagccgctgcccatcagcttcttctggatcgcgttccagtacctgttcctggggtcggcggacctgttcacgctggcggggctcctcgagttcttcttcagcgaggcgccgtcgcggatgcgctcgctggcgacgtcgctgtcgtgggcgtcgctggcgctgggctactacctcagctccgtgctcgtgtccatcgtgaacagcgcgacggggcgcggcggccaccggccgtggctgcggggtgccagcctgaaccactaccatctcgaaaggttctactgggtcatgtgcgtgctcagcactctcaactacctcttcttcctgttctgggcgatcaggtacaaatacagaaacgcaggggtcatcaaagggtaatgccatagccaatcggcattgccgttgatcgccacggtagcgagaactgctgggtgttactgtttatattggtggcaagcagagagtaaaaaaaaaggtactaggttaacttctgcaggatgtggggattatattggtggtggtggtttatcaggttgtcatgaatttggttgattggttcaacaagtgaatcaagaggtggctcagttaatcc

SEQ ID NO: 25586 - protein, 566 aa, Panicum virgatum
  misc_feature: Ceres CLONE 1864246
  misc_feature (69)..(494): Pfam Name: PTR2 Pfam Description: POT family
MLAASFVLVVEVLENLAFLANASNLVRYLMGFMHYSPSQSATTVTNFMGTAFLLALLGGFLSDAFFTTYTIYIVSAFIEFMGLVILTVQARTPHLMPPPCATTATGAPAPCAPVSGPRKAMLFAGLYLTALGVGGIKGSLPSHGAEQFDEHAPRGRKARSTFFNYFVFCLSCGALVAVTFAVWVEDNRGWQWGFGIATIAILLSVPVFAAGSGLYRNKVPTGSPLTTIARVLAAAALARRAGAQSASNGAVIDRAPSPTGSTDMKDYCKPGDMVANIAAGAGPAEPSRELAFLNRAVRCQEEQPGQQNGRLACTVQEVEDVKIVLMVLPIFFSTIMLNCCLAQLSTFSVEQAATMDTRVGRLTVPPASLPVFPVMFIILLAPVYDHVIIPFARRLTGTEMGISHLQRIGTGLILSIVAMAVAAVVEVKRKNVAADSGMLDSPKPLPISFFWIAFQYLFLGSADLFTLAGLLEFFFSEAPSRMRSLATSLSWASLALGYYLSSVLVSIVNSATGRGGHRPWLRGASLNHYHLERFYWVMCVLSTLNYLFFLFWAIRYKYRNAGVIKG

SEQ ID NO: 25587 - DNA, 1732 bp, Panicum virgatum
  misc_feature: Ceres CLONE 1864248
  misc_feature: Encodes the peptide sequence at SEQ ID NO. 25588
gatagattaacagcaaatcccgaaatcgcagcgcgaaattaaacaaaaccggaacggcggatacaataagcagctgctgccgccggcagcagcaccaccgcaagcagccgccaccgacacgccaccgcgccgagagggaaaagccaagcggggggcggtggcaggctaggaggggacggacgaaagggggaaatcgcctgcctgcctgccgcggtgggttggtggctgccgcctccgcatcctctgctcagtcccccagcccacccccattcacctcgcctgaccttgcatggattcccgctcgcttcccctccactccacgcgccgatccgccgccacctgccaggagagcgcgacgcgatccaattgaggtgcaggaggcgggggcgccctgcctgctgcctgctgcctgcgtgcttcccctccagtatccgcccgggcctggccgcgctgccgctggacgccatcgcgcgcctgcagggcgtcttggggcggtcggagcagccgccgccacgcgggcgacccggcgcgaggaagcggtggccgagccgggggagcgcgatgctgtgggtgacgcgcctgtccggcttcttctccgccgccatggtgatggtggtgctgtcgccgtcgctccagtccttcccgcccgccgaggctatccggtcctcgcagttcgacggcagcgtccgcttcccgggccagatcgcgggcggcgcccgggggatcgccttccgccgcgccccgtcgttccgcaatgccgccgattgcggcggcggcggcgcgggcaacggcaccgcggccaatgtctgcgacccctcgctcgtccacatcgcgattacgctcgatgaggagtacctcaggggatccgtcgcggcggtccactcggtggttcagcacgccaggtgccccgagagcgtcttcttccacttcctcgtctccgacccgggcctcggggacctcgtccgcgccgtgttcccgcagctccgcttcaaggtctactacttcgaccccgaccgcgtccgggggctcatctccacgtcggtgcggcaggcgctggagcagccgctcaactatgcgcgcaactacctcgccgacctcctcgagccctgcgtgcgccgcgtcatctacctcgactccgacctcgtcctcgtcgacgacgtcgccaagctctggcgcaccgacctcggcggccgcaccgtcggcgcgcccgagtactgccacgccaactttaccaagtacttcacaggccggttctggtcagaccagcggttcgccgggacgttcgcggggcggcggccgtgctacttcaacacaggggtcatggtgctcgatctcgagcggtggcggcaagcgagctacacgcagcgcatcgagcggtggatggagatacaaaagtcgccgccagggcgcatctacgagctggggtcgctgccgcccttcctgctggtgttcgcagggcacgtggcgccgatcgaacaccggtggaaccagcacggcctcggcggcgacaatgtcctgggcagctgccgcgacctccacccgggtccggtgagcctactgcattggtccgggtccggcaagccgtgggcgcggctcggcgccgggcggccgtgcccgctcgatgcgctctgggcgcccttcgacctgtacggccccgccggcgccggcgccggcgccgaggagtcccggtaaccgctacactcgaaaaaataaagaaagattcttttccttc

SEQ ID NO: 25588 - protein, 376 aa, Panicum virgatum
  misc_feature: Ceres CLONE 1864248
  misc_feature (89)..(346): Pfam Name: Glyco_transf_8 Pfam Description: Glycosyl transferase family 8
  misc_feature: Useful for making plants with altered carbohydrate content
  misc_feature: Useful for making plants with altered cell wall content and/or composition
MLWVTRLSGFFSAAMVMVVLSPSLQSFPPAEAIRSSQFDGSVRFPGQIAGGARGIAFRRAPSFRNAADCGGGGAGNGTAANVCDPSLVHIAITLDEEYLRGSVAAVHSVVQHARCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRRPCYFNTGVMVLDLERWRQASYTQRIERWMEIQKSPPGRIYELGSLPPFLLVFAGHVAPIEHRWNQHGLGGDNVLGSCRDLHPGPVSLLHWSGSGKPWARLGAGRPCPLDALWAPFDLYGPAGAGAGAEESR

SEQ ID NO: 25589 - DNA, 548 bp, Panicum virgatum
  misc_feature: Ceres CLONE 1864249
  misc_feature: Encodes the peptide sequence at SEQ ID NO. 25590
cgtctcttgccgggggccttggcgtccatcgccgccgcgccggtgctccgccactacctcccgctgctccccccggagggcgctccccaacggcaccttccgctggcccttcatcagcgagaccatcggcttcctccccccccacccgtccaacaccgccggcggcttcctgcaggagcacgtcgccaagtacgggacggtgttcaagtcgcacctgttcggctcgccggcgatcgtgtcgtgcgacgaggagctcaaccacttcgtgctgcacaacgaggagcgcctgttcgagtgcagctaccccggcgcgatccgcaccatcctcggcgagtcctccgccctggtggtcaccggcgagcggcaccgccagatccggagcatgttcctcgccctcctcgcctccaccgggctcaaggcctcctacgtcgccagcgtcgacaaatccccgcgctcgctcatcgcgtcctggagcggcctcaagaccatcagcttctgcgaggaggcgaggaagttccccttcaaggtgatcatgggacatgtgctgg

SEQ ID NO: 25590 - protein, 182 aa, Panicum virgatum
  misc_feature: Ceres CLONE 1864249
  misc_feature: SWISSPROT Homolog: EC 1.14.13.93 (+)-abscisic acid 8'-hydroxylase
  misc_feature: Useful for making plants with modulated oxidative stress sensitivity
VSCRGPWRPSPPRRCSATTSRCSPRRALPNGTFRWPFISETIGFLPPHPSNTAGGFLQEHVAKYGTVFKSHLFGSPAIVSCDEELNHFVLHNEERLFECSYPGAIRTILGESSALVVTGERHRQIRSMFLALLASTGLKASYVASVDKSPRSLIASWSGLKTISFCEEARKFPFKVIMGHVL

SEQ ID NO: 25591 - DNA, 716 bp, Panicum virgatum
  misc_feature: Ceres CLONE 1864263
  misc_feature: Encodes the peptide sequence at SEQ ID NO. 25592
atccatatgcttagctcccagcccggcacccatgggcgcctgcttctcctccgcctccgctgcccccgccggcgccgccgagcgccgcccctccaaggaggacaagaaggggcgccgcggcggcgcgtctcccgaaggcgcggcaaaggcggcggcggcggcccccgtgcgggtagagttcggctacgagagggacttcgaggcgcgcttcgaggtcggccgcctgctcggccacggccagttcggctacaccttcgccgccaccgaccgccagtccggggaccgcgtcgccgtcaagcgcatcgacaaggccaaggctataatggctacaatcaagaagaataaggcaacagaggcacgggcaaggaagaaaaaggctgcagagaagaaagcaactcttgcacaagctaggaaggttgaggttgcacagaagagagcagcagttttggccgcaaaaaagattgcagctgaagagagaaaagcattaagtattgcaaaaaaaaaaaacccagaaaaagcagctgccaagaaagcaaagaaaacctaatatgtttgtctttctatttttttttcaaaataatattgttattcagaactgaactttgattgatgtaaaaatgctacatattgatgcttttagtcacattggagctctaattgctaagtagaggttaaacctgctaatttttattgccaagggatacagaggggagcga

SEQ ID NO: 25592 - protein, 171 aa, Panicum virgatum
  misc_feature: Ceres CLONE 1864263
  misc_feature: SWISSPROT Homolog: EC 2.7.11.1 Non-specific serine/threonine protein kinase
MGACFSSASAAPAGAAERRPSKEDKKGRRGGASPEGAAKAAAAAPVRVEFGYERDFEARFEVGRLLGHGQFGYTFAATDRQSGDRVAVKRIDKAKAIMATIKKNKATEARARKKKAAEKKATLAQARKVEVAQKRAAVLAAKKIAAEERKALSIAKKKNPEKAAAKKAKKT

SEQ ID NO: 25593 - DNA, 742 bp, Panicum virgatum
  misc_feature: Ceres CLONE 1864265
  misc_feature: Encodes the peptide sequence at SEQ ID NO. 25594
atcaagcaccattccaagaatctcgatcgctgatacgaactggcaagaaagagatttcttgtgcaattggtgtgaaggctccggttcgtcgtcggccattccaagaaggtctctgcttcgtgaaaagcagaggagatgatcacggtggcagcaccggaggcgcagccgcaagcatcggcggcggcggtgacggagatggtggcgctggaggagaccgtgttccggtcgaagctaccggacatcgagatccccagccacctgcccctgcacgagtactgcttcgcgcgggcggcggagctcccggacgcgccgtgcctcatcgcggcggccacgggaacgacctacacctacgccgagacgcgcctcctgtgccgcaaggccgccgcgtcgctgcacgggctcggcgtcggccagggcgaccgcgtcatgatcctgctccagaactccgtcgagttcgtgctcaccttcttcggcgcgtcgttcctgggcgcggtcaccaccgccgccaacccgttctgcacgccgcaggagatccacaagcagttcaaggcctccggcgcgaggctcgtcgtcacccagtccgcctacgtcgacaagctccgccacgaggccttcccgaggatcgacggcgcggcgaggagcggcgacgagggcaacgttctcaccgtcgtcaccgtcgacgacgcgaccagcaccccggacggctgcctggcgttctgggagctggtggcgtccgccgacg

SEQ ID NO: 25594 - protein, 202 aa, Panicum virgatum
  misc_feature: Ceres CLONE 1864265
  misc_feature: SWISSPROT Homolog: EC 6.2.1.12 4-coumarate--CoA ligase
  misc_feature: Useful for making plants with altered cell wall content and/or composition
  misc_feature: Useful for making plants with altered carbohydrate content
MITVAAPEAQPQASAAAVTEMVALEETVFRSKLPDIEIPSHLPLHEYCFARAAELPDAPCLIAAATGTTYTYAETRLLCRKAAASLHGLGVGQGDRVMILLQNSVEFVLTFFGASFLGAVTTAANPFCTPQEIHKQFKASGARLVVTQSAYVDKLRHEAFPRIDGAARSGDEGNVLTVVTVDDATSTPDGCLAFWELVASAD

SEQ ID NO: 25595 - DNA, 742 bp, Panicum virgatum
  misc_feature: Ceres CLONE 1864269
  misc_feature: Encodes the peptide sequence at SEQ ID NO. 25596
atcccacccctcccctccccgcccagcggaactcaggcagcagcaacatactcaatcaaagtcttgatttttgtcgcttcctcgaccccccctcttcctcttcgtggaatcgcaagataacaaaatccacaacaagtcaaaacatcagggaatgctgaaagatgtgctttcatagaagagatttctgctgcgacatcaaggagctcgctgctccacaaaggctgctagcctgctcaactcttaatgtgagcgaccatcttagctgcatcaactctacaccattcagactccgacacgaccaaggcataagagttctgttcaccatcatggaccatgacatgggggaggagggctaaatcattgcagtccatctgttcggcggtcaaaatatagccctgtgatttatacttttgaagacatggagggtagaggaaagatattgatggagcggtatgagttggggagattgctgggcaaaggtacatttggcagggtgcactatgcaagaaaccttgagtccaacaggagtgttgctattaagatgatggacaaggacaaagtgctcaaggtcgggctttcagagcagataaggcgtgagatcacaacaatgaggttggtggcacataagaacattgttgagctccatgaggtcatggcaacacgaaacaagatctactttgtcatggagtatgtgaaaggtggcgagctctttgacaagattgagaagagtggcaagctcacg

SEQ ID NO: 25596 - protein, 107 aa, Panicum virgatum
  misc_feature: Ceres CLONE 1864269
  misc_feature: SWISSPROT Homolog: EC 2.7.11.1 Non-specific serine/threonine protein kinase
  misc_feature: Useful for making plants with modulated biomass
  misc_feature: Useful for making plants with modulated salt sensitivity
MEGRGKILMERYELGRLLGKGTFGRVHYARNLESNRSVAIKMMDKDKVLKVGLSEQIRREITTMRLVAHKNIVELHEVMATRNKIYFVMEYVKGGELFDKIEKSGKL

SEQ ID NO: 25597 - DNA, 1289 bp, Panicum virgatum
  misc_feature: Ceres CLONE 1864273
  misc_feature: Encodes the peptide sequence at SEQ ID NO. 25598
aaatgatctaggtctcccgcgccgccgccccctctgctgccccgccactgccaccttccctttctgcgcggggcctccccacgggagaaggcccggcggcggccgcgcgcacgcaatcgggaggcggcccgaggcgacgcggcgcttctcgtcccccgctgcctccgcccttcactggctagcaaccctaccctaatctgctgagcagctatggcgaagccggaggagaagcttcgctgcacgaaggagcccttcatcgaggacgtcggcgcccacaagataaagagcatccggttcagtgtgctctcgggcagcgagattcgcaagtccgctgaggtgcaggtctggaacagccggatctatggtcatgacatgaagccagtccccaatggtttgctcgacacgcgaatgggactccctagcaaaccaaagaaggatcctagcaaacaagataaggatgctgtgtgcagcacctgccatggtccattttctgattgtcctggtcattttggttacctgaagcttgcccttccagtttttaatgtcggctttttcaactgcatgctggacgtgttgaagtgtatctgcaagggctgtagcagggttcttcttgtggagaaagaccgccgagagtttctgaagaagatgagaaatcccagagctgatgcgctacagaaaagtgctaccatgaaaaaagtgagggacaaatgcaaactaaccagctgcccccggtgtgaatacagaaatggtgtagttaaaaaaggcagagcaggcctgatagtgattcatgattgcagcaaaattttggatggacatgcagaagaactgaagaatgcattacaacacaagaaagaaaaagtctccaccagttcagttcgcatgttagaccctgcaactgttctctctcttttcagaagaatgactgacgaggattgtgaattgctaaaccttggtgataggccagaaaaacttattgtgacggagattgcagtgccacctgtacctatacggccttctactgttgttggtagtactagaacaagcaatgaagatagcattactgctatattgaagagcattgttaatacaaattccatacttaaggagacccttcaaactgggggtctgttcaccaagtgttttgattgctggcaacaacttcaacttcaagttgttgaatacgtaaatagcgatgccccctgtcttcctgagtcgcaacatcgtggtcttgttcaacgactcaaagggaagactggccgatttcgtggtaacttatccggaaaacgtac

SEQ ID NO: 25598 - protein, 359 aa, Panicum virgatum
  misc_feature: Ceres CLONE 1864273
  misc_feature (21)..(355): Pfam Name: RNA_pol_Rpb1_1 Pfam Description: RNA polymerase Rpb1, domain 1
  misc_feature: SWISSPROT Homolog: EC 2.7.7.6 DNA-directed RNA polymerase
MAKPEEKLRCTKEPFIEDVGAHKIKSIRFSVLSGSEIRKSAEVQVWNSRIYGHDMKPVPNGLLDTRMGLPSKPKKDPSKQDKDAVCSTCHGPFSDCPGHFGYLKLALPVFNVGFFNCMLDVLKCICKGCSRVLLVEKDRREFLKKMRNPRADALQKSATMKKVRDKCKLTSCPRCEYRNGVVKKGRAGLIVIHDCSKILDGHAEELKNALQHKKEKVSTSSVRMLDPATVLSLFRRMTDEDCELLNLGDRPEKLIVTEIAVPPVPIRPSTVVGSTRTSNEDSITAILKSIVNTNSILKETLQTGGLFTKCFDCWQQLQLQVVEYVNSDAPCLPESQHRGLVQRLKGKTGRFRGNLSGKR

SEQ ID NO: 25599 - DNA, 437 bp, Panicum virgatum
  misc_feature: Ceres CLONE 1864273-R
  misc_feature: Encodes the peptide sequence at SEQ ID NO. 25600
agggcaaggataatgccatggagaacactgagatttaatgagtctgtttgcaacccgtataatgctgattttgatggcgatgaaatgaatttgcatgtccctcagacagaggaagctcgcactgaagcacttacgctcatgggggttcagaataatttatgtactcctaagaatggggagatactggtcgcttccacacaagatttcttgacctcatcttttctgattacaagaaaagatactttctatgatagatcttcctttactcttttgtgctcatcccttggtgaggcaatggagaacattgatttgccaacaccagccttgattaaacctatcgaactttggactggtaaacagttattcagtgtgttagttcgacctaatgcacatacaaaggtgtttttgaatcttgctgttaaagaaaaaatttattc

SEQ ID NO: 25600 - protein, 145 aa, Panicum virgatum
  misc_feature: Ceres CLONE 1864273-R
  misc_feature (1)..(49): Pfam Name: RNA_pol_Rpb1_2 Pfam Description: RNA polymerase Rpb1, domain 2
  misc_feature (52)..(145): Pfam Name: RNA_pol_Rpb1_3 Pfam Description: RNA polymerase Rpb1, domain 3
  misc_feature: SWISSPROT Homolog: EC 2.7.7.6 DNA-directed RNA polymerase
RARIMPWRTLRFNESVCNPYNADFDGDEMNLHVPQTEEARTEALTLMGVQNNLCTPKNGEILVASTQDFLTSSFLITRKDTFYDRSSFTLLCSSLGEAMENIDLPTPALIKPIELWTGKQLFSVLVRPNAHTKVFLNLAVKEKIY

SEQ ID NO: 25601 - DNA, 2462 bp, Panicum virgatum
  misc_feature: Ceres CLONE 1864292
  misc_feature: Encodes the peptide sequence at SEQ ID NO. 25602
caggatgtgtcaaggtcagggaacaatgatggggtttatcaacatgtacgtgagtcttgtggtgtttcaggggacattaatgtgggctatcaacccttgaccagtgaagacgagtcccctgctttatcaggggacaatgatgtgggttatcaacccttgaccaatgcacataaagctcatgatataccagagaacaatgatgagggtcatcaacccttgaccaatgaagatgaatctagtgatgctccagtgcttgaaagagccaaggatctcccagctaacaaggatgaagtttgtgacctcaacaacgaagacactgatttggaggatactggtgctaacttggctaaaaatgacacttttcagagctgcttggatctaacatcacaagtagatgatggggattcaggaaatgaattattttctcctggatcccagagggactctgagcttagtttgggtaattcttctgttgctgggacatatctagaggaaggtgaaactaaaactgcttactctgatcaagatgctcaattacaggagggagtggttgtttcaatatttaccttaggagttgataggactcgaaacaaaaggagctcctctcattatggcaagggatctgacatgctctctgaaggaggttctcatgataaggaacttgcctctgaaactgaggctgctggatccgatgatttacaatcatccatagctaccagtgataaagacaaactggggagcattccagagcattcagaagaggaggaacagagtaaagaagaacattctcaatcacaaaatggcttgggggttgaaatttctctttgtgggaacatgttacgaccaggaatgggtcgagaatctgctgaggaggcctttcaacagcatcttatccgcgaggaggatttcaagtcatctggatcaacaattataaaaaatgcaaaccttatcgtcaaagttgacaataagtacttcccatggagtaaagtttctcatgtcattcttgggaaggctgtatttggttcaaacgtcaccatagaaccaagtgatgcaattcgggtggagcgtcaggaaacacccaattcaagagaagactctcttagaatgtctccctcaagccgtagatggaggctttggctcaaccccttccggataacaaggtcccttcagcgtagtaacagtgattcttctgaggacattttccttgactcagagactgttttgagtccagtggatgaacaagctctggagagcaacaaaagccagtcaccaagaaagcaattcgtccggacattgattcccactagtgaacaggtagcatctttaaatctgaaggagggccaaaacatggtgacctttagcttctgcaccagagttcttgggaagcagcaggtcgatgcacacatttacttgtggaagtggaatgctaaaattgtgatatctgatgtggatggcaccataacaaggtctgatgtgttgggtcaggtcatgcctttggttggaagagattggagtcactccggtgtcgcgcgacttttttctgcaataaaggaaaacggttatcaactgctattccttagtgccagagcaattgttcaggcatatctcacgaagaacttcctcttcaatctgaaacaggatgggaaagcgctgcccaatgggcctgttgtaatttcacctgatggtttatttccttcactgtaccgagaagttatacggagagccccacatgaattcaagattgcatgtctggaggacattaaggctctttttccttccgattacaatccattttatgctggctttggcaacagagacactgacgagctcagttacaagaagatgggaatacctaaaggcaagatttttatcatcaacccgaagggagaagtggctgtcaacagttctgttgatgtgaaatcttatacctccttacatacccttgttaatgacatgtttccaccaacaactctggttgaacaggaagactacaataactggaattactggaaggtgccactgccagatgttgacttgtagtgtagtttcgacagatacaggcgtagataccagtagatcctcaaaagcatagtagctgagctttgtgtacactaattctcagtcactacgaccagttagatccaatctgtaaagcctctcaagagacccagatgtgcggttttgatagccaatgcagatgttgccacttctttctttcgacggagcttttccacgatcatacatcttttaggtagtgatctgattgtcttcgtcgaacttgttgtgctcagaggtttgggtcctggtctctcaattaattagataactcccagagctggtcagttctccgagctattttgttctgataactggacatccttggatgacagaactcgctgtatattgtacatgagggcatggaaaataatcgacattgcatttctgcttcatcttcaaccttt

SEQ ID NO: 25602 - protein, 679 aa, Panicum virgatum
  misc_feature: Ceres CLONE 1864292
  misc_feature (478)..(634): Pfam Name: LNS2 Pfam Description: LNS2 (Lipin/Ned1/Smp2)
QDVSRSGNNDGVYQHVRESCGVSGDINVGYQPLTSEDESPALSGDNDVGYQPLTNAHKAHDIPENNDEGHQPLTNEDESSDAPVLERAKDLPANKDEVCDLNNEDTDLEDTGANLAKNDTFQSCLDLTSQVDDGDSGNELFSPGSQRDSELSLGNSSVAGTYLEEGETKTAYSDQDAQLQEGVVVSIFTLGVDRTRNKRSSSHYGKGSDMLSEGGSHDKELASETEAAGSDDLQSSIATSDKDKLGSIPEHSEEEEQSKEEHSQSQNGLGVEISLCGNMLRPGMGRESAEEAFQQHLIREEDFKSSGSTIIKNANLIVKVDNKYFPWSKVSHVILGKAVFGSNVTIEPSDAIRVERQETPNSREDSLRMSPSSRRWRLWLNPFRITRSLQRSNSDSSEDIFLDSETVLSPVDEQALESNKSQSPRKQFVRTLIPTSEQVASLNLKEGQNMVTFSFCTRVLGKQQVDAHIYLWKWNAKIVISDVDGTITRSDVLGQVMPLVGRDWSHSGVARLFSAIKENGYQLLFLSARAIVQAYLTKNFLFNLKQDGKALPNGPVVISPDGLFPSLYREVIRRAPHEFKIACLEDIKALFPSDYNPFYAGFGNRDTDELSYKKMGIPKGKIFIINPKGEVAVNSSVDVKSYTSLHTLVNDMFPPTTLVEQEDYNNWNYWKVPLPDVDL

SEQ ID NO: 25603 - DNA, 438 bp, Panicum virgatum
  misc_feature: Ceres CLONE 1864298
  misc_feature: Encodes the peptide sequence at SEQ ID NO. 25604
aactcgcagtctcgatctccttcctcccccaccccactcttcctctccggggcctgctgctggcgaggtcgagcgctagctagcaagatggtggcgtcccgcaggttcaagcccatcgaggagtgctgcttggaggggcggtcggagcagacggtggcggcggacctggacggcacgctgctcatctcccggagcgcgttcccttactacctcctcgtggcgctcgaggccggcagcgtcctccgcgccgtgctgctcctcctctccgtgcccttcgtctaccccacctacatcttcttctccgagtcgctggccatcaacacgcttgtttacatttccgtcggggggctcaagggggccacaacatagagatggggcccccccccttgctgcccacattctctacgccggcgaccccacccagagagctggagggtg

SEQ ID NO: 25604 - protein, 93 aa, Panicum virgatum
  misc_feature: Ceres CLONE 1864298
  misc_feature: SWISSPROT Homolog: EC 2.3.1.15 Glycerol-3-phosphate O-acyltransferase
MVASRRFKPIEECCLEGRSEQTVAADLDGTLLISRSAFPYYLLVALEAGSVLRAVLLLLSVPFVYPTYIFFSESLAINTLVYISVGGLKGATT

SEQ ID NO: 25605 - DNA, 1802 bp, Panicum virgatum
  misc_feature: Ceres CLONE 1864318
  misc_feature: Encodes the peptide sequence at SEQ ID NO. 25606
atccccacctcctccaacccttccccgtcatcgccgcctcctccttccatcattcgcttcgtccgtacacctccccctccctctccccctcgcccttccctcctctcctcccccaaagccatccccgacaaggcgacaaacaacctctccggcggccgaagccgatggaggcgaactccggcgagggcgctcccaagcgcaaccctctcccgtccgcgctcgtttccaacctccagtccgtgctcgccgcgcgccgcccgcccccggccgaggaggtcggaaccgccgccttatccggcaaggcggaggctcccgatgccccgctgaccgatggggcgccgtcgaggcccgtcgttctgctgacctgcgccggggggatccggtcggcgggtctcgcggcgctcatcgacgccctcgtcgccggcggccgctgcgacgtccacgtgtgcgcccccgaatcggacaagccagcctgcggccactcaattaccgtccgtgagaccgtcactgcgacatccgtggatttcaaaggggctaaagcttttgagatatccggcacaccggttgactgtgtctcattggcattatctgggaggctgtttccttggtctgcacctgctttggtgatcagtggtattaacgcgggaccaaattgtggatatgagatgttccactcttctgccattgctgctgcaagggaggccttagtgtatggggtgccttcaattgcagtttcattgaattggaagaaggatgaaagcaaagacagcgacttcaaggatgcagctcaggcctgtttgccatcgatacatgctgccttggctgacattgagaaaggaaatttcgtcaaaggttgcctactgaatattgggattccaagctcaccctctgcaaacaagggtttcaagttgaccaaacagagtggatacagtcctgctcaaagttggcaagctgtatcaacaaacaggccttcatctgctgcacactttatgggcatgcatcaaagcctcggtattcagttggcacagcttgggaaggatgcatctgcagcaggagctgcacggagagttagtgctcagcgaaagacagtcgaggttgagtctgttgcagctgctggtaaacaagaggcacgtgaagtagtgaagaagttattccgtgctgagtttgtcgagaagcaacatgaagatttagatgaagatatcgatttaagggctatggagaatggatttatatctgtcactcctctgaatatacatgggcaagtggaggctgacattggagccccagtttcagattgtctctcagcagttgtatctctaggcaaagaaaaggaagctgctccagctacagctgaccaacaaattgctgctgaggaaaaagaagacccgtcagcagcctaacaaacatgtacacactccataggtgtcttagttcttgcagtgatggtggtcttttatctcttctctttattgggtttgatttgtttagccttttgcgcttgatattgttcagtgcaatttcaattttttttgttcatctttctgccaattgccggcttccttggccgtgcaaaatgatttgatgcagatgcctctacattttggatgtaacagatgaatactgcccagcccccactattttttcagtgtggtttgttctaggaaggtgttttattcagcatgggatatgtggttgattttgtcttgttcccgtctgaacgatggctgccaaaattggccgcttgtaacttgaaatgctgttgcagccattcaatgtggtaatgtcatcctgacttttgtggt

SEQ ID NO: 25606 - protein, 411 aa, Panicum virgatum
  misc_feature: Ceres CLONE 1864318
  misc_feature (62)..(259): Pfam Name: SurE Pfam Description: Survival protein SurE
  misc_feature: SWISSPROT Homolog: EC 3.1.3.5 5'-nucleotidase
MEANSGEGAPKRNPLPSALVSNLQSVLAARRPPPAEEVGTAALSGKAEAPDAPLTDGAPSRPVVLLTCAGGIRSAGLAALIDALVAGGRCDVHVCAPESDKPACGHSITVRETVTATSVDFKGAKAFEISGTPVDCVSLALSGRLFPWSAPALVISGINAGPNCGYEMFHSSAIAAAREALVYGVPSIAVSLNWKKDESKDSDFKDAAQACLPSIHAALADIEKGNFVKGCLLNIGIPSSPSANKGFKLTKQSGYSPAQSWQAVSTNRPSSAAHFMGMHQSLGIQLAQLGKDASAAGAARRVSAQRKTVEVESVAAAGKQEAREVVKKLFRAEFVEKQHEDLDEDIDLRAMENGFISVTPLNIHGQVEADIGAPVSDCLSAVVSLGKEKEAAPATADQQIAAEEKEDPSAA

SEQ ID NO: 25607 - DNA, 1445 bp, Panicum virgatum
  misc_feature: Ceres CLONE 1864346
  misc_feature: Encodes the peptide sequence at SEQ ID NO. 25608
aatctcctgcagatgcagagacgcagatgccgacgccggggcggctttagccaccactactataagagaagaggacgacgcccagctctctgtgtccgccttcacctagcttagcagcttagcctggcatctatcctctcctccgacctcagtccttccttcctctctgccgccggcacaggtgagctagcagcagcagcaggcatatggattcgtcggcagcagcaacgacgacgatgccccggcctgtggtgcgacccaagaggaagaaggttctggtggactacctggtgacattccgatggatccccgccatcttcgtggcccttcccctctccgctctcatccacctctgcatctacatcggcggcgtgctggcctccatcaagtccgaggagcgccggcgcagggagcacgaggagaacgtcgccaaggtcgtgaggcgcctcaagcagagggatcccaagagggacggcctcgtctgcacggccaggaagccatgggtggtggtggggatgcgcaacgtcgactacaagcgcgcccgccgcttcgaggtcgacctctccgcgttccacaacatcctggagatcgacaccgagaggatggtcgccagggtggagcccctcgtcagcatgggccagctcaccaaggtcacctgccccatgaacctctccctcgccgtggcccccgagttcgacgacctcaccgtcggcggcctcatcaacagctacggcatctcggggagctcgcacatctacggcctcttctccgacacggtcgtggccatggaggtggtcctggcggatggccgggtcgtgagggccaccaaggacaacgagcactcggacctcttctacggcatgccatggtcgcagggcaccatcggcttcgtggtcgcggcggagatcaagctcattcgcatcaaggagtacatgaggctgacctacactccggtgagggggacgctcaaggagatagcgcaggcctacgcagactccttctccttctcgttcagcagcagcagcagagacgatgctggtggtgattccaaaaagcagcagcaggtccctgacttcgtggaaggcatggtgtactccccctccgaaggcgtgatgatgaccggcgtgtacgccacggcggaggaggccaagaagaagggcaaccggatcaaccgcgtgggctggtggttcaagccctggttctaccagtacgcccagacggctctgaagcggggcgagttcgtggagtacatccccacgagggagtactaccaccggcacaccaggtccctctactgggaggccaagctcatcatccctttcgccgaccagttctggttcaggttcctgctcggctggctcatgccgcccaagatcaccttgctcaagatcacccagggggaggccatcaggaactactaccatgacaaccatgtcatccaggac

SEQ ID NO: 25608 - protein, 402 aa, Panicum virgatum
  misc_feature: Ceres CLONE 1864346
  misc_feature (52)..(197): Pfam Name: FAD_binding_4 Pfam Description: FAD binding domain
MPRPVVRPKRKKVLVDYLVTFRWIPAIFVALPLSALIHLCIYIGGVLASIKSEERRRREHEENVAKVVRRLKQRDPKRDGLVCTARKPWVVVGMRNVDYKRARRFEVDLSAFHNILEIDTERMVARVEPLVSMGQLTKVTCPMNLSLAVAPEFDDLTVGGLINSYGISGSSHIYGLFSDTVVAMEVVLADGRVVRATKDNEHSDLFYGMPWSQGTIGFVVAAEIKLIRIKEYMRLTYTPVRGTLKEIAQAYADSFSFSFSSSSRDDAGGDSKKQQQVPDFVEGMVYSPSEGVMMTGVYATAEEAKKKGNRINRVGWWFKPWFYQYAQTALKRGEFVEYIPTREYYHRHTRSLYWEAKLIIPFADQFWFRFLLGWLMPPKITLLKITQGEAIRNYYHDNHVIQ

SEQ ID NO: 25609 - DNA, 694 bp, Panicum virgatum
  misc_feature: Ceres CLONE 1864346-R
ttgaggttgatagagcctcacctcctttgctactgtggtgtcccggcgcggaggctaatatccgggaccggttggaatccaggacgcaagttcttcatctgctaaaatgcagatcttggtcgagtcttttggcatttgttgatttgctttcttgtttccttcttcttagagatgcaaactttggatctggaagatgttctcatgcaatttgttggggatatggtggacttctgtgtctcgaacattgctaaggtggttttgccttctcttacactacaggaagaacatggtttgaactttgaacagagcagaggacgcaggacggaaatcacggcacctgccttccttgatgatttgatgttgttggttaattaagtcttttgattgttcttaaaatcattgtgtcgttacaaatttagtggtgtgcacccttgtgagcaagttgttgccggattgatcggagaagtgaaacaaagctttgaaggagattcattacctgaagaagttaagaagagcattagtgaagtaggctcttggccctagcttacaacctcgttgtagtccatttttgcagagtcagtgtactaaaatgtttgtaaactgatgcacatggttcgaacccgttcgtggatatagtaggaagtgctatgtggagccattataactctacttaatgaaatggatttcttgtatt

SEQ ID NO: 25610 - DNA, 1784 bp, Panicum virgatum
  misc_feature: Ceres CLONE 1864362
  misc_feature: Encodes the peptide sequence at SEQ ID NO. 25611
agccacgcccgcggcgcgcctcgccacacgaatcgcgatggacgccgcgcgagctagcctccgactccccgtgcggtgggcgcggcaggcggcgctggtcgtcgtcgtcgccgccctcctcgtcctggcggcggcgccgcccggggcgggcgccgccgcggcgccggaggcggagtgcggcggggggaaggcggcggaggtcagggaggaggacgcgcgcggggcgctgcggctcaagctcgtcgcggtggcgtccatcctggcggcgggcgcggcgggggcgctggtgcccgtgctgggccgctcggcgcccgcgctccggcccgacggcgacgtcttcttcgccgtcaaggcgttcgcggccggggtcatcctcgccaccggcatggtgcacatcctgcccgccgcgttcgacgcgctcgcgcccccctgcagcggcggcggcggcgcgcgcggcagcaagggcgccgcgttccccttcgccgggctcgtcgccatgtgctccgccatggccaccatgatggtcgactccgtcgcggccgggtactaccagcgctcccacttccgcaaggcgcgccccgttgacgacgccgccgacgggcaccaccagggcggccgcggcgccgctgccggggatgaggagggcggcgccgagcacgcgggccacctgcacgtgcacacgcacgccacgcacggccacgcgcacggccacgcgcacgaccacgcccacggccccggccacggcgggccggccgccgccggcgcctcgcctgacgatgcctcctccgttgccgtgtcgatcaggcacagggtcatctctcaggttctggagctggggatcctggtgcactcggtgatcatcggcgtgtctctgggggcatcgctgaggccgtcgacgatcaggcctcttgttggagctctcagcttccaccagttcttcgaaggcataggccttggcggctgcattgttcaggcaaagttcaaagtgagagcaaccgtgatcatggtggccttcttctccctcactgctcccatgggcattgcactggggatcgcgatcacatccagctacagcaagcacagcgctaccgccctcgttgtcgagggggtcttcaatgcagctgcagcagggattttgatatacatgtccctggtagatctcctagcagcagatttccacaacccgaggctgcagacaaacatgaagcttcagctggcaacttaccttgccttattcctcggtgcaggactcatgtccttgcttgccaaatgggcatagataggcagatacatcttcagagctgctgaggactgtagttctgcgcattgtcattcctaaagaccccgaacgcagtttatgatcggcggggttaattttgttgtagcattacagcattaatttcagtagaatcttcttcaaccagaatcggtgcacagtgaggtataaagaaggcctgaatgtgaccaagttctagagttgaagggcattgctagacaagtcaaaatgttcaggacaaaatatgaatcttgcacaatgatgtgcttccatgaggatggcaccaaaatagatgtgcatagaagaatgatgaagtggtggtggcgaatagttgttctcgaattatctttggggctaaagatttgtaaaatcgccgacttccttttggagtcaacggcaatgtacatagttgttagctagattcctcctttttgctgggttgaaactccatggattttgttaactgaaaaattgtatttaatcacaatcatcgtcttatttccctgac

SEQ ID NO: 25611 - protein, 413 aa, Panicum virgatum
  misc_feature: Ceres CLONE 1864362
  misc_feature (64)..(410): Pfam Name: Zip Pfam Description: ZIP Zinc transporter
MDAARASLRLPVRWARQAALVVVVAALLVLAAAPPGAGAAAAPEAECGGGKAAEVREEDARGALRLKLVAVASILAAGAAGALVPVLGRSAPALRPDGDVFFAVKAFAAGVILATGMVHILPAAFDALAPPCSGGGGARGSKGAAFPFAGLVAMCSAMATMMVDSVAAGYYQRSHFRKARPVDDAADGHHQGGRGAAAGDEEGGAEHAGHLHVHTHATHGHAHGHAHDHAHGPGHGGPAAAGASPDDASSVAVSIRHRVISQVLELGILVHSVIIGVSLGASLRPSTIRPLVGALSFHQFFEGIGLGGCIVQAKFKVRATVIMVAFFSLTAPMGIALGIAITSSYSKHSATALVVEGVFNAAAAGILIYMSLVDLLAADFHNPRLQTNMKLQLATYLALFLGAGLMSLLAKWA

SEQ ID NO: 25612 - DNA, 565 bp, Panicum virgatum
  misc_feature: Ceres CLONE 1864369
  misc_feature: Encodes the peptide sequence at SEQ ID NO. 25613
agctgagggtcatggctaccccggacgtgctggggccaataatgcagctcctgctgctcctcatccttgcccagatgagcctcaccggctccagccctccgccggatcccgtagcctgcgcccacggtacctccaactgcaccatcaacaacgcatatgcctccttcccggaccgcagaccctgccacgccgcccgggccgcctacccacgcagccagcatgacctcggcgcggccgtggcggccgcggcggctgccaagcggaaggagaaggtcgccaccaggtactcccacagcttcaccaagctggcctgccccggcggcagcgacggcgccatcatcagcacgcagcggctcaaccggaccgtgcgggtcaacgccaagaatcagctcatcacggtggagagcggcgtgatcctcagggagctcatccgtgccgccgcctcggcggggctctcgctgccatacccgccgtactggttccgcctcaccgtccgcggcctcctggcgaccggcgcgcacggcagctcgatgtggggcatggggcgcgccgtgcacgagtccgt

SEQ ID NO: 25613 - protein, 184 aa, Panicum virgatum
  misc_feature: Ceres CLONE 1864369
  misc_feature (60)..(184): Pfam Name: FAD_binding_4 Pfam Description: FAD binding domain
  misc_feature: SWISSPROT Homolog: EC 1.1.3.41 Xylitol oxidase
  misc_feature: Useful for making plants with modulated nitrogen use efficiency
MATPDVLGPIMQLLLLLILAQMSLTGSSPPPDPVACAHGTSNCTINNAYASFPDRRPCHAARAAYPRSQHDLGAAVAAAAAAKRKEKVATRYSHSFTKLACPGGSDGAIISTQRLNRTVRVNAKNQLITVESGVILRELIRAAASAGLSLPYPPYWFRLTVRGLLATGAHGSSMWGMGRAVHES

SEQ ID NO: 25614 - DNA, 1606 bp, Panicum virgatum
  misc_feature: Ceres CLONE 1864373
  misc_feature: Encodes the peptide sequence at SEQ ID NO. 25615
acacacacccccggtccgccctcagtcccagtttcttttccctggcccgggaggcggcggcggcggttcttgagggcgctacttcttcgtggaggttcctgcacccaaaagcccaagacatggatcagtccaaggaaaatgcagaattcccgagctgtgatgcctactttgaagctatccaatccaaaaagaagctgccactatctttgcaagaatcactgaccgctgcctttgctcagattccagtctcatccttccctgaggttcctactggccgagtaattgaaattcctggtgacacctctgttcttgaggctgtgaggattctctcggaacacaacataagggcagctcccgtgctgaacccggaaccctgggccctagctgattggcaagggcggtatcttggtgttattgattactcggcaatcatcctttgggtactagaaaatgctgagcttgcttctattgctctgtccgctggatcggcaactgctgcaggggttggaatgggtgctgttggtgcggtgggggtcgcagcattgggtgcaattggcccagcggcagtggctggcttgactgcagctgcagtaggggctgctgttgctggtggtttaactgctgaaaagggtgtggcaaaggatggtttacctgccgcaaatcacttaggagaaaatttctacaaaattttgcttgagcaaaaacctttcaaatcaacaacagttcattcaattgtggagtcataccgctggtctccttttgtccccattacattaaacagttccatgcttactgtactactattgctctccaagtacaaattgaaaaacgtcccagtgattgagcctgacaaacctgttatcaaaaactttattactcaaactggtgttgtcaaaggactgcaacagtgtaaaggaagggattggtttgactacatttctgcacttcctctttcaaacttgggacttccttttatgtcaattgatgaggttataactgtgaagagtgatgatctaatattagaagctttcaagtgcatgaaggataacaaaattggtggtgtaccagtagtggaagggccccaaaggaaacttgttggcagtgtgagcataagggacattcgctttctgttgcttagacctgacttattttcgaatttcaggcaacttactgtcattgaattcatgaagactctaggctccactcttcctgactcagggaacgactgcctggtgaagccgccacccacctgcgcccctgacacttcccttggtagcgttatcgacagcattgcatcaagaataacccaccgtatatatgtagtggatggtgaccttgaggttgtcggtgttgtgaccctgcgcgatgtgatctcgtgcttcatccacgagccacccggttactgcgacatctatttggcttcagcaaatattggagaagctggagggaggagccagatcagtggagaaagttgagctttatgtaacgtggacgtgggaataacaggctgagttgatgtgatctctttagttggaataatgctttcagattgtgttaatcttgtaaattctgcttagattaaaaagcaaggcttatgtgtcctctt

SEQ ID NO: 25615 - protein, 451 aa, Panicum virgatum
  misc_feature: Ceres CLONE 1864373
  misc_feature (285)..(422): Pfam Name: CBS Pfam Description: CBS domain pair
  misc_feature (48)..(262): Pfam Name: CBS Pfam Description: CBS domain pair
MDQSKENAEFPSCDAYFEAIQSKKKLPLSLQESLTAAFAQIPVSSFPEVPTGRVIEIPGDTSVLEAVRILSEHNIRAAPVLNPEPWALADWQGRYLGVIDYSAIILWVLENAELASIALSAGSATAAGVGMGAVGAVGVAALGAIGPAAVAGLTAAAVGAAVAGGLTAEKGVAKDGLPAANHLGENFYKILLEQKPFKSTTVHSIVESYRWSPFVPITLNSSMLTVLLLLSKYKLKNVPVIEPDKPVIKNFITQTGVVKGLQQCKGRDWFDYISALPLSNLGLPFMSIDEVITVKSDDLILEAFKCMKDNKIGGVPVVEGPQRKLVGSVSIRDIRFLLLRPDLFSNFRQLTVIEFMKTLGSTLPDSGNDCLVKPPPTCAPDTSLGSVIDSIASRITHRIYVVDGDLEVVGVVTLRDVISCFIHEPPGYCDIYLASANIGEAGGRSQISGES

SEQ ID NO: 25616 - DNA, 1480 bp, Panicum virgatum
  misc_feature: Ceres CLONE 1864376
  misc_feature: Encodes the peptide sequence at SEQ ID NO. 25617
ctgctccattcccctccaagaagagcctccgcctgatccggcacccgagctcttctccgctccacgtctcctccagtccagccgcccatccatcacaactaccaagcttgcaaacacagccttgaccctttcagtccagctgcgccgctgagacgcatggagtgcgagaacggacacgtcgccgccaacggcaatggcgtctgcctgccggtgccgccgcgggccgaccccctgaactggggcaaggcggcggaggacctggccgggagccacctggaggccgtcaggcggatggtggaggagtaccgcaggccgctggtgaagatcgagggcgccagcctcacggtcgcccaggtcgccgccgtggccgcggccgccgaggccagggtcgagctcgacgagtccgcccgcggccgcgtcaaggccagcagcgactgggtcatgaatagcatgatgaacggcaccgacagctacggcgtcaccaccggcttcggcgccacctcccaccgccgcaccaaggagggcggcgcgctccagagggagctcgtccgattccttaacgccggagcgttcggcaccggcgacgacggccacgtgctgccggcgtcggccacgcgcgccgcgatgctcgtccgcatcaacaccctgctccagggctactccggcatccgcttcgagatcctcgagacgatcgccgcgctgctcaacgccaacgtcaccccgtgcctgccgctccggggcaccatcaccgcctcgggcgacctggtcccactctcctacatcgcggggctcgtcaccggccggcccaactccgtggccgtcacgcccgacggcaggaaggtggacgccgcggaggcgttcaaggtcgccggcatccagcacggcttcttcgagctgcagcccaaggaagggctcgccatggtcaacggcaccgcggtgggctccgggctcgcgtccatcgtgctcttcgaggccaacgtcctcgccgtcctcgccgaggtcctgtccgccgtgttctgcgaggtcatgaacggcaagcccgagtacaccgaccacctcacccacaagctcaagcaccacccgggtcagatcgaggccgcggccatcatggagcacatcctggacggcagctcctacatgatgctcgccaagaagctcggcgagctcgaccccctgatgaagccgaagcaggacaggtacgcgctccgcacgtcgccgcagtggctgggcccccagatcgaggtcatccgcgccgccaccaagtcgatcgagcgcgagatcaactccgtcaacgacaacccgctcatcgacgtctcccgcggcaaggcgctccacggcggcaacttccagggcacgcccatcggcgtgtccatggacaacaccaggctcgccatcgcggcgatcggcaagctcatgttcgcgcagttctctgagctcgtgaacgacttctacaacaacggcctgccatccaacctgttcg

SEQ ID NO: 25617 - protein, 441 aa, Panicum virgatum
  misc_feature: Ceres CLONE 1864376
  misc_feature (54)..(440): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MECENGHVAANGNGVCLPVPPRADPLNWGKAAEDLAGSHLEAVRRMVEEYRRPLVKIEGASLTVAQVAAVAAAAEARVELDESARGRVKASSDWVMNSMMNGTDSYGVTTGFGATSHRRTKEGGALQRELVRFLNAGAFGTGDDGHVLPASATRAAMLVRINTLLQGYSGIRFEILETIAALLNANVTPCLPLRGTITASGDLVPLSYIAGLVTGRPNSVAVTPDGRKVDAAEAFKVAGIQHGFFELQPKEGLAMVNGTAVGSGLASIVLFEANVLAVLAEVLSAVFCEVMNGKPEYTDHLTHKLKHHPGQIEAAAIMEHILDGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLF

SEQ ID NO: 25618 - DNA, 501 bp, Panicum virgatum
  misc_feature: Ceres CLONE 1864378
  misc_feature: Encodes the peptide sequence at SEQ ID NO. 25619
attaattttccacgctggtcttgtagacagcatctatcagagtgcggccaggatggtgtacgtgctcctgctggtcgccttggcgtccatcgccgccgcggcggtgctccgccactaccttccgctgctccccccccatggcctccccaagggcagcttcggctggcccttcatcggcgaaaccatcggcttcctccccgcccacccgtccaacaccgccggcggcttcctgcaggagcacgtcgccaagtacgggacggggttcaagtcgcacctgttcggctcgccggcgatcgtgtcgtgcgacgaggagctcaaccacttcctgctgcacaacgaggagcgcctggtccaatgcagctaccccggcgccatccgcaccatcctccgcgaatcctccgccctggtggtcaccggcgagacggaccgccagatacggagaatgttcctctccctcttctcctctcccccgctcacggggtctcatatctcaaccgccta

SEQ ID NO: 25619 - protein, 149 aa, Panicum virgatum
  misc_feature: Ceres CLONE 1864378
  misc_feature: SWISSPROT Homolog: EC 1.14.13.77 Taxane 13-alpha-hydroxylase
  misc_feature: Useful for making plants with modulated oxidative stress sensitivity
MVYVLLLVALASIAAAAVLRHYLPLLPPHGLPKGSFGWPFIGETIGFLPAHPSNTAGGFLQEHVAKYGTGFKSHLFGSPAIVSCDEELNHFLLHNEERLVQCSYPGAIRTILRESSALVVTGETDRQIRRMFLSLFSSPPLTGSHISTA

SEQ ID NO: 25620 - DNA, 1284 bp, Panicum virgatum
  misc_feature: Ceres CLONE 1864385
  misc_feature: Encodes the peptide sequence at SEQ ID NO. 25621
atccaatcggccgtctggtcgtctcgccatttggtccaagacgacctcgtcgtcgtcttccccttctccacccttctcccgttctccgctctccgcctccccggggtggggtgtacaacacccccagtccactcccaccggacccaaaccctacttaaactccgccacggttcctctgctccgacccagacccaccagagcaggcgacgcgacggaggggggaatcgccgaaatgccctccgtgctctacctccccctgctcctgctgctcgccgcctcggcggcggcggctgctgctgcagatgccgtggacccgtcggcgcacgaggcgctgttcgacgcgtggtgcgtggagcacggcagggcctacgccacgcccgaggagcgcgcggcgcggctcgcggtgttcgccgacaacgcggccttcgtggcggcgcacaacgcccgcgccagcgccagcgccaacgccaacgccgcaggcggcgacgggtcggccccgtcctacacgctcgcgctcaacgccttcgcggacctcacgcacgacgaattccgagccgcgcgcctcggccgcctcgcggccggccgggccggggcgacgctccggagcgccggcccgcccctgtacggggggctcggcggcggcgtcgccgcggtgcccgatgcggtggactggaggaagagcggggccgtcaccaaggtcaaggaccagggcagctgcggagcctgttggagcttttccgctacaggtgctattgaaggaataaacaaaatcaagacaggctcgctggttagtctttctgaacaggaactaattgactgtgacagatcgtacaatagcggctgtggtggtggcctcatggactatgcttttaagttcgtggttaaaaatggtggaattgacacagaggaggattatccctatcgtgaagtagatggaacatgcaacaagaacaagctgaaaaggcgagttgtgacaattgatggttactctgatgttccttccaacaaagaggacttattgctccaggctgttgcccagcaaccagttagcgtgggaatatgtggcagcgccagagcatttcagctatactccaagggtatctttgatggtccatgtccaacatctcttgatcatgctgtgctaatcgtgggttatggctccgaaagtggcaaggactactgggtcgtgaaaaattcttggggtgaaagttggggaatgaagggctacatgcatatgcaccggaacactggtgattccagtggtctctgcggtataaacatgat

SEQ ID NO: 25621 - protein, 350 aa, Panicum virgatum
  misc_feature: Ceres CLONE 1864385
  misc_feature (141)..(350): Pfam Name: Peptidase_C1 Pfam Description: Papain family cysteine protease
  misc_feature (35)..(106): Pfam Name: Inhibitor_I29 Pfam Description: Cathepsin propeptide inhibitor domain (I29)
  misc_feature: SWISSPROT Homolog: EC 3.4.22.14 Actinidain
MPSVLYLPLLLLLAASAAAAAAADAVDPSAHEALFDAWCVEHGRAYATPEERAARLAVFADNAAFVAAHNARASASANANAAGGDGSAPSYTLALNAFADLTHDEFRAARLGRLAAGRAGATLRSAGPPLYGGLGGGVAAVPDAVDWRKSGAVTKVKDQGSCGACWSFSATGAIEGINKIKTGSLVSLSEQELIDCDRSYNSGCGGGLMDYAFKFVVKNGGIDTEEDYPYREVDGTCNKNKLKRRVVTIDGYSDVPSNKEDLLLQAVAQQPVSVGICGSARAFQLYSKGIFDGPCPTSLDHAVLIVGYGSESGKDYWVVKNSWGESWGMKGYMHMHRNTGDSSGLCGINM

SEQ ID NO: 25622 - DNA, 808 bp, Panicum virgatum
  misc_feature: Ceres CLONE 1864385-R
acctaaactcccttgagaacctttcttctgttgttcgactacacgtgcatgaatgccctgacctggagagcatcaagaatctccggaaattgaagaagctcacaatctacaaatgccctaagttgaaggcattagagggtgtgcctacattatataggctcattctggtggactggaccatggaaactctcccaggatacctgcaggacgtgaagccaagtcatttgctgttagacaacttcaacttatcgctactcgctgccattgcagcacgggaaacctgcccggaatgggacaagttcagtcatatacagcacgtcaaggcttatgcggctgaagattgcattctaagaaaacggttcgtgctttacacaagggacccctttagctttgtgacaaatgtcagcacttctgacatagctcgagtgcttctttactcgacaacatgttctgttgaagacgagtggatgcttggacaaggtgcctttgcagataaaaaatgcgagcccctctgtctacgcttcaggtggaatgcgtatcgtcatctggctggctggttgtctcgagtgtgcctgcactgcaaagaagctgcctccgtcgtctccaccacctgctagtactagaggttgtcagaaggtactcgattaatttgatgctgcgatgctagtatttggcttgagcgatttgtatttgtaccagctgttgctcttcagtgaatagctagatgaatggacaagtttcgacagctaaatttctatcatactgggaactcaggcgcacaccttttgcctgattgactgttcatcac

SEQ ID NO: 25623 - DNA, 1764 bp, Panicum virgatum
  misc_feature: Ceres CLONE 1864409
  misc_feature: Encodes the peptide sequence at SEQ ID NO. 25624
gcagctcacactcgggcacgtcgagctcaaacgaaagacccccctgaccccctccggaggcgcaacaatgacttccctctcctccgccgtggcattgccgtcctcgtgccgggcccgtccggcgggcggcagccggcgggcgcggctgctggtggcgcgggccgcggcgtcgagccccaagctgccgaacgggcggcggctgcgggtggcggtggtcgggggcggccccgcgggcggcgcggcggcggaggcgctggcgaagggcggcgtggagacggtgctcatcgagcggaagatggacaactgcaagccctgcggcggggccatcccgctgtgcatggtgtcggagttcgacctgccgctggacctcgtggaccggaaggtgaggaagatgaagatgatctcgccgtccaacgtcgccgtcgacatcggccgcacgctcgcgccgcacgagtacatcggcatggtcaggcgcgaggtgctcgacgcctacctccgctcgcgggcccaggacgccggcgcggaggtcgtcaatggcctcttcctgaggtacgaggcgcccaaggaaccgaacggctcgtacgtggtgcactacaaccactacgacagcagcaacggcaaggtcggcggcgagaagcggtcgttggaggtggacgcgatcgtgggcgcggacggcgccaactcccgcgtggccaaggacatgggcgccggcgactacgagtacgccatcgcgttccaggagcgcgtcaagatccccgacgacaagatggcctactacgaggagcgcgccgagatgtacgtcggcgacgacgtctcgcccgacttctacggctgggtgttccccaagtgcgaccacgtcgccgtcggcaccggcacagtcacgcacaaggccgacatcaagaagttccaggccgccacgcgcctccgcgccaaggacaagatcgagggcggcaggatcatccgcgtcgaggcgcaccccatccccgagcacccaaggcccaagagggtggccgggcgtgtgacgctggtgggcgacgcagcggggtacgtgaccaagtgctccggcgagggcatctacttcgcggccaagagcgggcggatgtgcgcggaggcgatcgtggccggctccaccaacggcacgcggatggtggaggagagcgacatgcgcaagtacctggcggagttcgaccgcctctactggccgacctacaaggtgctcgacatcctgcagaaggtgttttaccgctccaacgcggcaagagaggcgttcgtcgagatgtgcgccgacgactacgtgcagaagatgaccttcgacagctacttctacaaacgcgtcgtgccgggcaacccgctcgacgacatcaagctcgccgtcaacaccatcggcagcctcgtcagggccaccgcgctgcgccgggagatggacaaggtcaccttgtgagccgccgtcgagctgccattcacctgaggtgcttgagtcgaagctgatcggtgtattactagtagagattcgcggctgatcaagcaagggggcaaattgaggccaacgagcgtaggcacggagaggaagagattcgtgaggttgtgtaagctgagcaagtcgacccaagtgcttctattggtcgaccctgccctgttcttgtaaaacagagcatctggtgatgttgagaactcggagcagttcgattggatcactgatgacgataagctttgacgtgaatggatgtatcatacatgaaactaaaactctgttttgattactgt

SEQ ID NO: 25624 - protein, 457 aa, Panicum virgatum
  misc_feature: Ceres CLONE 1864409
  misc_feature (44)..(364): Pfam Name: FAD_binding_3 Pfam Description: FAD binding domain
MTSLSSAVALPSSCRARPAGGSRRARLLVARAAASSPKLPNGRRLRVAVVGGGPAGGAAAEALAKGGVETVLIERKMDNCKPCGGAIPLCMVSEFDLPLDLVDRKVRKMKMISPSNVAVDIGRTLAPHEYIGMVRREVLDAYLRSRAQDAGAEVVNGLFLRYEAPKEPNGSYVVHYNHYDSSNGKVGGEKRSLEVDAIVGADGANSRVAKDMGAGDYEYAIAFQERVKIPDDKMAYYEERAEMYVGDDVSPDFYGWVFPKCDHVAVGTGTVTHKADIKKFQAATRLRAKDKIEGGRIIRVEAHPIPEHPRPKRVAGRVTLVGDAAGYVTKCSGEGIYFAAKSGRMCAEAIVAGSTNGTRMVEESDMRKYLAEFDRLYWPTYKVLDILQKVFYRSNAAREAFVEMCADDYVQKMTFDSYFYKRVVPGNPLDDIKLAVNTIGSLVRATALRREMDKVTL

SEQ ID NO: 25625 - DNA, 1259 bp, Panicum virgatum
  misc_feature: Ceres CLONE 1864431
  misc_feature: Encodes the peptide sequence at SEQ ID NO. 25626
gagatcgattagattaaccaccccgccggccggcgcgcgcggccatggagaccaacagcagtaagcccaagcacgggaagccgtacgccgtcgccgtcgccgaggaagatgctactaatagcaataacaagatgataaagaagaacctctccgatgacgacgaggccgccgccggcgagccggagcagaagtaccgagggtggaaggccatgccttacgtcatagggaacgaaacgtgcgagaagcttggcaccatcggcacgacggccaacctgctggtctacctcaccaccgtctacgccatcaagagcgccagcgccgccacgctgctcagcctctggggcggcaccgtcaaccttgcccccgtcctcggcgccttcctcagcgacgcctacctcggccgctacgccaccatcgccctcgcctccatcgcctccttcctcggcatgatcctcctcaccctcaccgccgccgtcccctccctccacccgcacggcgccgcggcggggccctccgcgtcccacatggccgcgctcctcgcctccctggcgctgctcgccatcggcgccggcggcatccgcccctgcaacctcgccttcggcgccgaccagttcgacccccgcacgcccgccggccgccggggcatcaacagcttcttcaactggtactacttcaccttcaccatcgccatgatggtctccgccaccgtcatcatctacctccagagcaacgtcagctgggcgctgggcctcgccgtcccggccacgctcatgggcctctcctgcgcgctcttcttcatgggcacccgcctctacgtccgcgtccgccccgagggaagccccttcaccagcttcgcccaggtcctcgtcgccgcctaccgcaagcgccgcctcgtgtcccccagcgagggcgagctcttcgacccgccgcaccggagcagcctggtgtccaagatcgcctacacggaccagttcgtgtgcctggacaagggggccgtgctgacccccgacgacgagctcacggccggcggcgccgcgtcggcgaacccgtggcggctgtgcacggtgcagcaggtggaggaggtcaagtgcctggtgcggctgctcccggtgtggtcgacggggatcgtctactacatcgcgctcaccaacctgggcaactacaacgtgctccaggcgatgcagacggaccggcgcctcgggcggtcgggggtcagatcccggcgggctccttcgtcgtgtttcacatgctggcgctga

SEQ ID NO: 25626 - protein, 404 aa, Panicum virgatum
  misc_feature: Ceres CLONE 1864431
  misc_feature (121)..(400): Pfam Name: PTR2 Pfam Description: POT family
METNSSKPKHGKPYAVAVAEEDATNSNNKMIKKNLSDDDEAAAGEPEQKYRGWKAMPYVIGNETCEKLGTIGTTANLLVYLTTVYAIKSASAATLLSLWGGTVNLAPVLGAFLSDAYLGRYATIALASIASFLGMILLTLTAAVPSLHPHGAAAGPSASHMAALLASLALLAIGAGGIRPCNLAFGADQFDPRTPAGRRGINSFFNWYYFTFTIAMMVSATVIIYLQSNVSWALGLAVPATLMGLSCALFFMGTRLYVRVRPEGSPFTSFAQVLVAAYRKRRLVSPSEGELFDPPHRSSLVSKIAYTDQFVCLDKGAVLTPDDELTAGGAASANPWRLCTVQQVEEVKCLVRLLPVWSTGIVYYIALTNLGNYNVLQAMQTDRRLGRSGVRSRRAPSSCFTCWR

SEQ ID NO: 25627 - DNA, 614 bp, Panicum virgatum
  misc_feature: Ceres CLONE 1864431-R
  misc_feature: Encodes the peptide sequence at SEQ ID NO. 25628
cgcagcagatgctggcggggctgtcggaggcgttcgcggtgatcgggcaggtggacttctactacaagcagttcccggagaacatgcgcagcgtggccggcgcgctgctgttcctgggcttcgccgtggccagctacgccagcgggctcatggtcacggtggtgcaccggacaacgggggggagcggcgggcggccggactggctgacgcaggacctcaaccaggggcgcctcgacctctactacctgctcatcgcgggcatggccgccgtcaacctcgtctacttcgtggcgtgcgcgcgctggtacaggttcaagcagtcggatgccggcgccgccgtggagctggaggagaaggacggcaaggtcgttgttgctactgctggcgccgccgcacctccacctccacctccagtttgaattcattcagctcaagttcattcgaacaggaaattaaatgaagatatatagatggacagcaggttgaaacaatcgatagatggatggatggatgtgttattgatcgattatagagtttcctgggttcatgcatgagcagaccatgcatcgcagattgatatcagtcaacatgatacatagcacgcatgcgcatcc

SEQ ID NO: 25628 - protein, 138 aa, Panicum virgatum
  misc_feature: Ceres CLONE 1864431-R
  misc_feature: Useful for making plants with modulated nitrogen use efficiency
QQMLAGLSEAFAVIGQVDFYYKQFPENMRSVAGALLFLGFAVASYASGLMVTVVHRTTGGSGGRPDWLTQDLNQGRLDLYYLLIAGMAAVNLVYFVACARWYRFKQSDAGAAVELEEKDGKVVVATAGAAAPPPPPPV

SEQ ID NO: 25629 - DNA, 1340 bp, Panicum virgatum
  misc_feature: Ceres CLONE 1864437
  misc_feature: Encodes the peptide sequence at SEQ ID NO. 25630
atccttgcattcccagcatcgtcggcatcacgacgacttagtacgccatgaacggcgggctcctcgccgccgtgctgatcctcgtgttgcacccgccaccggccgacgcggctacgtcggcgacctgcgacagtagcggcggcggcggccgctacacgcccggcagcgccggcaccaaccagaccgtgtacgccgccgggctgtgccgcggcgacctggtcccctacacctgcctggtgtgcctccagtcgagcttcagcgacgcgcagctccagtgccccctcgacacggacgtgagcatgaactacgacgcctgccacatgcgcttcgccggcgtcgacttcctcgcctccaccaacaactcggtgcagctaccctacttcaccaacttccccgcggtggccgccgcctccgccgccggccgcttcaacggcctcgtggcggagctcctcgccgccaccgcaggctacgcggccgggtcggggaggaggttcgccaccggcgagatggacgtggacagcgactactcccaggggcagttctccaacatattcgcgacggcgcagtgcacgccggacctgacgccggcgcagtgccgcgcttgcctggccggcgccatggcggagatgccacgccaggtgttccccagcaactcgacgggggcgagcttcgtgggcgagcgctgcggcttgcagttcgccccgtatgcgttttataacggcgacaccatggtgaagctgcccattcgactgcaaggaaaaaagtcggcaacgactccagttcttgcaatagtacctgcagtattgggtggactattcgcactaacactaattgccctttgggtttggcggaagaagaggtcaccaagaaaaatgtcactcttcgtaaatgtagaagacatggaaagttttgagtccatatttatcggcctatccacgcttcagtcagcaacaaacaacttcgatgaaaacaacaaacttggcgaaggaggatttggtgttgtttataagggtgctctgccagatggacaagaagtagcagtcaagaggctttctgagagcacaacacaaggactaggccagatgaagaatgagctagctttgatagctaagctacagcacaaaaatcttgttaggattgtcggtgtttgcttggaagaaggtgaacaattgcttgtctacgagtacatgcccaacaaaagcctggacaccattatctttgatcccgataaaagtaaaaagctcgactggggagcgcgattcagaatactcaacggaattgctcgaggcctgcagtacctgcatgaacatttccagccgacgatagtccaccgggatctg

SEQ ID NO: 25630 - protein, 430 aa, Panicum virgatum
  misc_feature: Ceres CLONE 1864437
  misc_feature (305)..(430): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with altered carbohydrate content
MNGGLLAAVLILVLHPPPADAATSATCDSSGGGGRYTPGSAGTNQTVYAAGLCRGDLVPYTCLVCLQSSFSDAQLQCPLDTDVSMNYDACHMRFAGVDFLASTNNSVQLPYFTNFPAVAAASAAGRFNGLVAELLAATAGYAAGSGRRFATGEMDVDSDYSQGQFSNIFATAQCTPDLTPAQCRACLAGAMAEMPRQVFPSNSTGASFVGERCGLQFAPYAFYNGDTMVKLPIRLQGKKSATTPVLAIVPAVLGGLFALTLIALWVWRKKRSPRKMSLFVNVEDMESFESIFIGLSTLQSATNNFDENNKLGEGGFGVVYKGALPDGQEVAVKRLSESTTQGLGQMKNELALIAKLQHKNLVRIVGVCLEEGEQLLVYEYMPNKSLDTIIFDPDKSKKLDWGARFRILNGIARGLQYLHEHFQPTIVHRD

SEQ ID NO: 25631 - DNA, 811 bp, Panicum virgatum
  misc_feature: Ceres CLONE 1864437-R
gcttcggcctcctcctcccacttccgctccctctcgtggagcgtgtcccgcacttggtccgcggcgcggcagctgcaggccatcggggccggcctcgccgcgccgcgcgcgcacgaggcgggcctcgccgcgccggtctactccatgggatgcgtactccacctcgccgcgtgagcgctcgtggccgccgtcccgtgcccggaccgtggcaccgcgctccaggcgcaccacctgcccgccgcgccaccgcgcgccgcattcccctgggcgccgcctctcctctccctgcaagaacgcctagccgaggaggggaagcgcaaggacaggcgccatacttgcggtctgctcaaagagatccattcgctcgagaagtcgacgcaaaagcttgctgaagcaattgacgcagcccccatcccgctctttggtgacagggagaccgatgtgcgggaggctgcagcggagctcgctgccgtgtgtgaagccatgagggatggtctggagccactggaaaggcaggtgcgcgaagtgttccaccgcattgtgcgcagtcgtgtcgatggtcttgattcgtccatgcacaatgctgattgattcgccgatcaaaatcctgccttcaattgggcaatgtggcgatcctaggtagcttttcttgctcttggtttgcttgtttatgttctggtcgtattaagtataaaagtgtatctcttgtaaagaagggatttgaatgtggccatcatgatgtaaagatggctgcttagttcccatgttttttatgctgcatttggtatatatttcatcaaatttttgttag

SEQ ID NO: 25632 - DNA, 694 bp, Panicum virgatum
  misc_feature: Ceres CLONE 1864451
  misc_feature: Encodes the peptide sequence at SEQ ID NO. 25633
ttcctctccataaccgctggcatccagatatccctcctgttgctgatgtaactgaaggagaattgttccgcgttgagatggttgattggactggagggcgggttagggatgacaactctgcagatgatatcaaattccttgatctcacaattactcattatcttagtgggcccctaagaatagttgattctgaagggcttccagcttcacctggtgatcttcttgcagtagagatctgcaaccttggtccacttcctggtgatgagtggggttatactgcaatatttgaaagggagaatggaggtggattcttaactgaccactttcctagcgcaagaaaggccatttggtattttgaaggaatttatgcatattcccctcagataccaggtgttcgttttccaggattaactcatcctggtatagtaggaactgcaccatctgttgaacttcttaatatatggaatgaaagggagaaaaagttggctgagacaaatccagagactcttaaagtgtgtgaagttctacaccaaaggccccttgctaatttaccgacccctgagaactgcttacttggaaaggcatgatgaaccacctctacctccactaatggtgtcgcttcaagatttatgttttcaaactgcaaatggtcgaatcgcatctgtatgattaatttttttttgtgacctatggc

SEQ ID NO: 25633 - protein, 194 aa, Panicum virgatum
  misc_feature: Ceres CLONE 1864451
  misc_feature (1)..(193): Pfam Name: FmdA_AmdA Pfam Description: Acetamidase/Formamidase family
  misc_feature: SWISSPROT Homolog: EC 3.5.1.49 Formamidase
PLHNRWHPDIPPVADVTEGELFRVEMVDWTGGRVRDDNSADDIKFLDLTITHYLSGPLRIVDSEGLPASPGDLLAVEICNLGPLPGDEWGYTAIFERENGGGFLTDHFPSARKAIWYFEGIYAYSPQIPGVRFPGLTHPGIVGTAPSVELLNIWNEREKKLAETNPETLKVCEVLHQRPLANLPTPENCLLGKA

SEQ ID NO: 25634 - DNA, 1262 bp, Panicum virgatum
  misc_feature: Ceres CLONE 1864460
  misc_feature: Encodes the peptide sequence at SEQ ID NO. 25635
acgcccctcgcgcaaccgtcatctccatcctccgccctccgcttcctctccgctgcgccgccgccctgtgggtcgtcacccgccgccaccacgcccggccaacccgcgctcgccgacgccgtcacgccggcccgcgcgccccatcctgcgcctccccgtcgccccctctctcgcggtcgcgacctcgccccgctcaggagaggccccgctccggcatccccaccgcgcctcctcaccgacttcccaccggccctcactgccgatctccagctcctcctccttaaactccccgacgatctgctccgttccgaggccctcgccgtcggccgcccgctcgccattgccccacggacccgcacgccccgtcgccgcactcccgctaccgtgccaaatcccctactcgcacgtcaggggatatcgaatctgtgccattcatcaaagatttcatatcagttgtcctacatactgtcaggtactgggaacttcttgcttattgaccatttttgccaaatatatgcgttagcacgagcacacttactagttggaaggaagggggcaaaaagcaccaaatcgagaaggcgaatcgagttctccatggctgctccgcgcgtgccgctcccccagctgctgctcctcgtcgtcgccgtgctcgttgcagccgcccccgtccggagggcgtctggggccgggcagttcgacgtccgccgccacctctcaaccgtcacgaggtacgatgtggccagagggtccactagtgtggactctatgccacaaatcccagatgggtgccgtgtgatccacctcaatctagtggcaagacatgggactcgtgctcctaccaagaagcgaatcaaggagctggatagattggcaattaggctggaagctcttatgaatgaggcagaacaaggtctcaagagtgattctctgaagaaagttccatcctggataaagggctgggagtcatgttggaagggtagaactaaaggtggtgagctgactagtgaaggagaagaagagctctacaacttagccaccagagtgaaggagaggtttcaggacctgtttgatgatgaatatcaccctgatgtatattcaataagagcaactcaggtttctcgagcatcagctagtgcagtagcatttggtttgggattgctttctgggaaggggaagcttggaccagggaagaactgtgccttttctgttctgagcgagagtcgtgcaagtgatatttgtctgagattctttgacagctgtga

SEQ ID NO: 25635 - protein, 222 aa, Panicum virgatum
  misc_feature: Ceres CLONE 1864460
  misc_feature: SWISSPROT Homolog: EC 3.1.3.62 Multiple inositol-polyphosphate phosphatase
MAAPRVPLPQLLLLVVAVLVAAAPVRRASGAGQFDVRRHLSTVTRYDVARGSTSVDSMPQIPDGCRVIHLNLVARHGTRAPTKKRIKELDRLAIRLEALMNEAEQGLKSDSLKKVPSWIKGWESCWKGRTKGGELTSEGEEELYNLATRVKERFQDLFDDEYHPDVYSIRATQVSRASASAVAFGLGLLSGKGKLGPGKNCAFSVLSESRASDICLRFFDSC

SEQ ID NO: 25636 - DNA, 406 bp, Panicum virgatum
  misc_feature: Ceres CLONE 1864460-R
gtccattcgaggagttcaaggagaggatagtcaaaccacacctgaagcatgactacaatatgatatgcaagatcaatccacctgtggcgagcgaggagcctgcttcgttcaccaccaaggtgtccagtttcttcgtaggattgttctcgcagaaagggtaccgtgccgtgagcgctgaaagcgtcaagacggagttgtaagccaacgcaagccatctgagagcacgagcaaggaacgagattaaccgacgcactaacacgaggtgtttttgtacggccgagtcaaaactcgaaagtatagcctttcaaaaaaagaaactcgaaagtgtacgaggcgtcagttcttcagggaaagatgcctctgacaatgtaaattcatcagtttcagttcggactcttctttgggg

SEQ ID NO: 25637 - DNA, 672 bp, Panicum virgatum
  misc_feature: Ceres CLONE 1864468
  misc_feature: Encodes the peptide sequence at SEQ ID NO. 25638
gtcctcaagcatccacaccaccagtccaccaccaccacagctgcgacgcgcctggctggcttcttctagctcagttgctcgcaacaagacacacatcagctgagagaactctgatccgcgcttgctcctgcgcggcgtcggtggctagcagctagctagccttttgttgttgcccaccgcctcagctcactcacatcgcacgcccacccacaatccctcccacaccataagcacagcgcttctgcctgctgaggaagaggtcgatctctcttagcttggttattgatcgatcgatcgacgacgacgacgccatggtgaggccgccgtgctgcgacaaggagggcgtcaagaagggcccgtggacgccggaggaagacctcgtcctcgtctcctacatccaggagcacggccccggcaactggcgcgccgtcccgaccagaaccgggctgatgcgctgcagcaagagctgccggctccggtggaccaactacctccgcccgggcatcaagcgcggcaacttctccgaccaggaggagaagctcatcgtccacctccaggctctcctcggcaacaggtgggctgccatcgcgtcgtacctgccggagcgaacggacaacgacatcaagaactactggaacacgcacctcaagcgtaaactgcagagcggaggcg

SEQ ID NO: 25638 - protein, 120 aa, Panicum virgatum
  misc_feature: Ceres CLONE 1864468
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 792 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 788 in the 11/435,388 US patent application
  misc_feature: Useful for making plants with modulated low light sensitivity
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 796 in the 11/435,388 US patent application
  misc_feature: The sequence is a functional homolog of SEQ ID NO 743 in the 10/666,642 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 790 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 569 in the 10/374,780 US patent application
  misc_feature: The sequence is a functional homolog of SEQ ID NO 824 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 271 in the 11/479,226 US patent application
  misc_feature: The sequence is a functional homolog of SEQ ID NO 822 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 58 in the 10/666,642 US patent application
  misc_feature: Useful for making plants with altered cell wall content and/or composition
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1002 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1073 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Useful for making plants with altered carbohydrate content
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: Useful for making plants with altered terpenoid content
  misc_feature: Useful for making plants with modulated biomass
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 442 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1681 in the 10/374,780 US patent application
  misc_feature: The sequence is a functional homolog of SEQ ID NO 1010 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 186 in the 10/412,699 US patent application
  misc_feature: The sequence is a functional homolog of SEQ ID NO 1917 in the 10/374,780 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Useful for biocontainment applications
  misc_feature: The sequence is a functional homolog of SEQ ID NO 836 in the 10/412,699 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1692 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 446 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1572 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 126 in the 10/412,699 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 36 in US patent 7193132
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1566 in the 10/374,780 US patent application
  misc_feature: The sequence is a functional homolog of SEQ ID NO 1564 in the 10/374,780 US patent application
  misc_feature: Useful for making plants with modulated flowering time
  misc_feature: The sequence is a functional homolog of SEQ ID NO 1563 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1863 in the 10/374,780 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
MVRPPCCDKEGVKKGPWTPEEDLVLVSYIQEHGPGNWRAVPTRTGLMRCSKSCRLRWTNYLRPGIKRGNFSDQEEKLIVHLQALLGNRWAAIASYLPERTDNDIKNYWNTHLKRKLQSGG

SEQ ID NO: 25639 - DNA, 693 bp, Panicum virgatum
  misc_feature: Ceres CLONE 1864484
  misc_feature: Encodes the peptide sequence at SEQ ID NO. 25640
aaaaccctagaaaccgcccctccgcctccgccgcaggccgctcgccgctcgcgccatgggtatcgatctcgtcgccggcggccggaacaagaagaccaagcgcaccgcgcccaagtccgacgatgtctacctcaagctcctcgtcaagctgtaccgcttcctggttcgcaggaccaagagcgacttcaacgccgtgatcctgaagcggctcttcatgagcaagaccaaccgcccgccgctctcgctacgccgcctcgtcaaattcatggagggcaaggtcccccactctcccctggattcccattctgatttggttgcggagtgtgcttttttgttcctgtggttttgtatgacattgtgtttgtttgcgggcgtgcaggagaaccagattgctgtgatcgtgggcagcgtgaccgacgacaagagggtctacgaggtcccagcgatgaaggtggctgcgctcaggttcactgagacggcgagagcccggatcgtgaatgctggtggcgagtgcctcacctttgaccagctggcgctccgtgcgcctctgggccagaacacggtaattttcacagcccaaccttgattctaatgttcactgctcagataagctgtggagatgaaaaataccctggactaagtttcattagtggggtagtttaaacaatttgttcaactttagttaactgctgg

SEQ ID NO: 25640 - protein, 176 aa, Panicum virgatum
  misc_feature: Ceres CLONE 1864484
  misc_feature (12)..(175): Pfam Name: Ribosomal_L18e Pfam Description: Eukaryotic ribosomal protein L18
MGIDLVAGGRNKKTKRTAPKSDDVYLKLLVKLYRFLVRRTKSDFNAVILKRLFMSKTNRPPLSLRRLVKFMEGKVPHSPLDSHSDLVAECAFLFLWFCMTLCLFAGVQENQIAVIVGSVTDDKRVYEVPAMKVAALRFTETARARIVNAGGECLTFDQLALRAPLGQNTVIFTAQP

SEQ ID NO: 25641 - DNA, 760 bp, Panicum virgatum
  misc_feature: Ceres CLONE 1864487-R
  misc_feature: Encodes the peptide sequence at SEQ ID NO. 25642
tgccgcaacagcgtggcgcacccgcgcgcgcgcccgctcaaggacttccgcacgctgcagacgcactacaagcgcaagcacggcgacaagcgcttcggctgccgccgctgcggcaagcccttcgccgtcaagggcgactggcgcacgcacgagaagaactgcggcaagcgctggttctgcgcctgcggctccgacttcaagcacaagcgctccctcaacgaccacgtccgctccttcggcggcggccacctccccgtcgcgcccgaccagcaggcggcggcggccgccgtgccgccgctcaagcccaaggagcggatcatacgcttcgaccaggcggcggcggcggcgccgtggaacggagcccacgccgcccaggcatgacactgcaacaagttgacatctatcgtcagcacgcatagagatcgatcgaattaatagagttacatcgattggaacggaacaggattatgcatatatactgctgccagctcggaggcgaggcgtacataggcaataagactctggagatcgaggttgcttttggaggctgtgaagtagatgaattttcttcccaaggagacgagagcttcttcagagactgggtatgtctctagactctagctatagctcatcaatttgcaagggagaaaatttctcagcttcacatgccgatatttattaggcaaccttgtatcaatgtatcatgcatgcatgcatgcatgatctgatcctatgaaatctagtacacgtgttaattatt

SEQ ID NO: 25642 - protein, 126 aa, Panicum virgatum
  misc_feature: Ceres CLONE 1864487-R
  misc_feature: The sequence is a functional homolog of SEQ ID NO 1079 in the 10/666,642 US patent application
  misc_feature: The sequence is a functional homolog of SEQ ID NO 306 in the 10/666,642 US patent application
  misc_feature: The sequence is a functional homolog of SEQ ID NO 630 in the 10/666,642 US patent application
  misc_feature: The sequence is a functional homolog of SEQ ID NO 1075 in the 10/666,642 US patent application
  misc_feature: The sequence is a functional homolog of SEQ ID NO 1077 in the 10/666,642 US patent application
  misc_feature: The sequence is a functional homolog of SEQ ID NO 1074 in the 10/666,642 US patent application
CRNSVAHPRARPLKDFRTLQTHYKRKHGDKRFGCRRCGKPFAVKGDWRTHEKNCGKRWFCACGSDFKHKRSLNDHVRSFGGGHLPVAPDQQAAAAAVPPLKPKERIIRFDQAAAAAPWNGAHAAQA

SEQ ID NO: 25643 - DNA, 1297 bp, Panicum virgatum
  misc_feature: Ceres CLONE 1864487
gcggaaccacggcaaaggcatcaggcatgtccgccggcgcccgcgcgacgccgacgcggacaccgccgcggccctcctcgccggcgccccgcaccgaggcggtggtcccgccggactgggcctccgccgtgaccctcgtctcctcccactccacgccccctgtcgtcgtcgtgtgcgggcccaagaacagcggcaagtccaccttctcccgcatcctcctcaacgcgctgctccccaggcacgagaaggttgcttatctggacaccgacgtggggcagccggagttcgggctgcctgggtgcctctcattccacatcgttgacgaagatctcgaagatttgctgaacccaactctacgggaagctgaaaggtacttcttctttggagacgtttcttcgaaaagagatccagaagcatatctgaattgcctattccatttgtacgattacttcgttggaaaatatcggtgtgatgagaatgaaatgctgcctctacttgtcaacactcctggctgggtaaaaggtgctggttttgatatgctcgtagagatgctaagatatatctgccccacaattgttgttcagatacgcatcatagcgcagagcaagaatctccctgatggaatgttttggctcgatgatgagcaaacaggacctgagatgattaacatcaatgctgcatttcacgatgccttgaatagatcgtaagtaatcttttttttttcaatttagagttaaagaaactaaaatagttttcctcatacttggaaaatgttgatggaagcttgtacctaagaacattacgctgtttatggctggatgtactcaaacctgaatttgcatgacagtgattacgcccattaaatactagttctgttgagcaggtttacatgttctctacaatgttgattagataattcattccagcaattttataccacatttggctctatgtggatagaactgaaaacttttgtctaaatccttgggcttctctgatgaccaggattgtttcctattcatgtttgcattgctatctgtttataagttcactcctgcaagcatcttgtttttaagtgataatcattatgcaaactcaatacttctgtaacatgcatccgcttgctcacagcctgcagttgatgagtttataggtataattctacagaaagtgatgacttgagcttctaaggaagcaattgctaacatcatctctatattgccaaggttgttaattcagaaagattcatgtgggatgcgtgaacggcgtctcatggagtacttgaagcaatgtttcc

SEQ ID NO: 25644 - DNA, 1264 bp, Panicum virgatum
  misc_feature: Ceres CLONE 1864493
  misc_feature: Encodes the peptide sequence at SEQ ID NO. 25645
attcccattcctctggcgctgtggtcttgtagctccagccgagcgcgcatggcggcggcgtagtttcgaattactagtgtacctacacaactagcacttgagccaccacctggcgtcccctcccagccagccccagaacaacaagcatggcggccgccgccgtggtgcccaggccgcctccttctcttcctaccagggcctttccttcctcctccacctcctcctcttcccggcggtatcccctaagattaagaagcgtaccccgcccccttgtgtgcgctgctgcatcgtcctccgtctggatgcccgatccggacctggagcctgagcccgcccacgacgacgagccggcgccggagtccaggtcccgccgcatcgccctcttcgtcgagccctcgcccttcgcctacgtctccggatacaagaaccgcttccagaacttcatcaagtacctccgggagatgggcgacgaggtgattgtggtcaccacgcacgagggcgtgcctcaagaattccacggagccaagctgattggatcctggagcttcccttgcccctggtatcaaaaggttccgctctcgctggcgctgagccctcgaatcatcggagaagttgctagattcaaacctgacattattcatgcctcttcccctgggattatggtatttggcgcgctaattatcgcaaagttgctctgcgtccctctagtaatgtcataccacacccatgttccaatttatataccaagatatacgttcagctggcttgtcaagcccatgtggctaatcattaaattcttgcatcgagctgcagatctcacactggtaacgtcagttgcaattggcagggatcttcaagctgcccgtgttacagcagccaataagatacgcctttggaacaagggtgttgattcagaaagcttccatcctcgcttccgaaataaggaaatgcgttcaaggctgactaatggtgaaccacagaagccactaatattgtatgttggacgcttaggagtggagaaaagtttggattttcttaagcgagtcatggaccgacttccaggatcgagaattgcgtttattggagatggcccattcagggctgagcttgagcagatgttctcaggtatgcctgcagtgttcacgggtacgttgcaaggggaagagctatcgcaggcatatgccagtggggatgtgtttgtgatgccttcggagtcagagacgctcgggtttgtggtgcttgaagccatgtcatcaggggttcc

SEQ ID NO: 25645 - protein, 320 aa, Panicum virgatum
  misc_feature: Ceres CLONE 1864493
  misc_feature: SWISSPROT Homolog: EC 2.4.1.57 Phosphatidylinositol alpha-mannosyltransferase
  misc_feature: Useful for making plants with altered carbohydrate content
MPDPDLEPEPAHDDEPAPESRSRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVTSVAIGRDLQAARVTAANKIRLWNKGVDSESFHPRFRNKEMRSRLTNGEPQKPLILYVGRLGVEKSLDFLKRVMDRLPGSRIAFIGDGPFRAELEQMFSGMPAVFTGTLQGEELSQAYASGDVFVMPSESETLGFVVLEAMSSGV

SEQ ID NO: 25646 - DNA, 589 bp, Panicum virgatum
  misc_feature: Ceres CLONE 1864493-R
  misc_feature: Encodes the peptide sequence at SEQ ID NO. 25647
ctgtacacaccaggggatgttgatgactgtgttagcaagatcgagcgtctcttgtcatgcgatgagttgcgagagacgatggggagggctgccaggaaggagatggagaagtttgactggagagcagcaacgaggaagatccggaatgagcagtacagcgctgccatctggttctggcgcaagaagagggcacagctgctgaggcctgtccagtgggcagtccggaggctgttgaggccaacgatgcctggggctggcaacaccatcgcgaagcaatcttagacgaagaggaagaggaagcattctggagcatattgggtcagtgcatctgctcctgcggtgtggattgattggatgcgtgatgctcaacaacattgaagggaaggaagctcaagttcagcgttccaggacactgaagcatggatgttcactcgttatttggtttaggactggtagattgtaaatcgtacatatgtgtgcactactttttcgcttactgcgttgcatttgcatcctactatctattcttagtagaattggtaatatgtctgtctccccgccctgtgtggaaacatgaatactacctctc

SEQ ID NO: 25647 - protein, 93 aa, Panicum virgatum
  misc_feature: Ceres CLONE 1864493-R
  misc_feature: Useful for making plants with altered carbohydrate content
LYTPGDVDDCVSKIERLLSCDELRETMGRAARKEMEKFDWRAATRKIRNEQYSAAIWFWRKKRAQLLRPVQWAVRRLLRPTMPGAGNTIAKQS

SEQ ID NO: 25648 - DNA, 1231 bp, Panicum virgatum
  misc_feature: Ceres CLONE 1864494
  misc_feature: Encodes the peptide sequence at SEQ ID NO. 25649
ctgcccctccgcccgtgacccccacagccccccatcccccctccgatcgatcgtccgcccaagggtttccggcgcctcgtcgcgaggcgagggtccggggccgcctccttccaaccgccgctgcccggggtccgcgggggacgttcgtgccgcgatggacgccttccggcccgcgccggcgggacttggccgcgcgtggccgcgcatcgacgtgcgggatctcgtcgtcaaggtcaaatatggcgacactttgaagcgtttcaatgcttttgtggatggatcacactttgatcatgatcttcctgccctccggttgaagattgcaagtgcctttaagttcagtcctgatgttgaattcattctcacctatactgatgaggatggagatttcgtcatgctggatgatgataatgatctacgagatgctactattaatcagaaattgaaccctcttaggattaatgttcagttgaagagcagcaatgttggggcaactcggacagaagagcagtccacgaattccaaatctccgaggtccatctctctcgaagatcaacttgccctggtgaaatctgctattgatgaagccttgaagtttgtaccagatcaagtccccgctgcccttgcaaaactatctcatgatttgcgttctagggctgcatcatctgcaccatcattggctgaattgctggaccgttttactaaactgattacacgaagtagcaacatgcatccttcttgtggctcttctgatggttcacttaaattgggaaatgcaaagattaagcttgaatctggacttacgacaggttcagcttcagagcccttggatgggcaaaattctgggatatctgaagctggtcttaagagtgtcctatctgaggaccccactgctcaaattgaacaggcaccgtcatgcccttcagttaaggactcactggtctttactagttcaggtgcaatgaaatctgatctcaagagaagtcttgattctgagattaagataaaatctgatgcttgcagtaagggaaaatctgtaatatcatctgtgccacctgtttccaccacttgtcatggtgctcctgcccaacgatctgttcctatgccatatacatcctgtggattcagtggaatggccaatattccggtcgctattccctcccccacctatagtccaccctcccccaccactgcaataccctcccacaccatttttcaccccctacaaccc

SEQ ID NO: 25649 - protein, 358 aa, Panicum virgatum
  misc_feature: Ceres CLONE 1864494
  misc_feature (22)..(107): Pfam Name: PB1 Pfam Description: PB1 domain
MDAFRPAPAGLGRAWPRIDVRDLVVKVKYGDTLKRFNAFVDGSHFDHDLPALRLKIASAFKFSPDVEFILTYTDEDGDFVMLDDDNDLRDATINQKLNPLRINVQLKSSNVGATRTEEQSTNSKSPRSISLEDQLALVKSAIDEALKFVPDQVPAALAKLSHDLRSRAASSAPSLAELLDRFTKLITRSSNMHPSCGSSDGSLKLGNAKIKLESGLTTGSASEPLDGQNSGISEAGLKSVLSEDPTAQIEQAPSCPSVKDSLVFTSSGAMKSDLKRSLDSEIKIKSDACSKGKSVISSVPPVSTTCHGAPAQRSVPMPYTSCGFSGMANIPVAIPSPTYSPPSPTTAIPSHTIFHPLQ

SEQ ID NO: 25650 - DNA, 826 bp, Panicum virgatum
  misc_feature: Ceres CLONE 1864494-R
  misc_feature: Encodes the peptide sequence at SEQ ID NO. 25651
aacaaattatctgcaacgaataagttaaagaaattagctcggcaggttattggtgagcatatttcagagcaggagactgctaggttaagagaaatgttcaaggcaatggacaccgaaaacagaggcatgattagtttgggtgagcttaaagaagggttgagaagatgctgctcagtgtttaatcgtactgaaatcaatggtttaatggatgcgcctgagagcaacaacaccatcagtatccattgggaggagtttattgctgccacagtaccccttggtaaaatagaacacaaagaacacttgatgcctgcctttacatactttgacaaagatggaagtggttatatcactgtcgacaagcttcaaaagcctcaagtggaacaaaacatggaagatgctttccttgaagacataattttggaggttaatcaaaacaatgatggccagaccaactattctgagtttgccacaatgatgcaaagcaacaactctggacttgggtggcaaacaatggaaagcagcttgaatgtacccctgagggaggcacctgaagtttactgattttctgctgcgcaaagataccgttctcttcagctcgtcatggggttcctcactaccctttggcaaagctatgtgaatccaggagaagagaacacagtctgaatagtggggcagtggtcaaagactggctaataatgtctataacatactggtagtagtataggcgtgtgttctatgagaacaaatctgtggttgtcatatatgtatcagtgattggtttgtttggttgctaccctgctatctaataatagatttaatagtatgt

SEQ ID NO: 25651 - protein, 186 aa, Panicum virgatum
  misc_feature: Ceres CLONE 1864494-R
  misc_feature (28)..(56): Pfam Name: efhand Pfam Description: EF hand
  misc_feature: SWISSPROT Homolog: EC 2.7.11.1 Non-specific serine/threonine protein kinase
NKLSATNKLKKLARQVIGEHISEQETARLREMFKAMDTENRGMISLGELKEGLRRCCSVFNRTEINGLMDAPESNNTISIHWEEFIAATVPLGKIEHKEHLMPAFTYFDKDGSGYITVDKLQKPQVEQNMEDAFLEDIILEVNQNNDGQTNYSEFATMMQSNNSGLGWQTMESSLNVPLREAPEVY

SEQ ID NO: 25652 - DNA, 703 bp, Panicum virgatum
  misc_feature: Ceres CLONE 1864500
  misc_feature: Encodes the peptide sequence at SEQ ID NO. 25653
gggtcgatgggcgccgaatgggtcgcacctcgcaagactcgcctccggctccgatctgctaaggtctccgccggatcgggttgcgggtcgcatcccaccgaccccgatccaccaccgctcgccgccgaccaccgccgccgagtgggtgatcgtatgcgcggtaaaatgctggagccaacagcaattgaagtgccaattgccgcctcagtcagcaatgcgctggtgcctgcgcctgcagttcacaatccacggacacgaaaactgcggtctgcagtttggcaggacttcacgaaagagcgccgtgccgatggcaactgtgtggctgtctgtaaacactgcaagaagcagctcacagcgacgagccggtcaggcaccacgcacctgcgcaaccacctcgccatctgcaccaccacatccacacgacgtgctggtaaacgccggaagcttgttgtgcgccgtattcaccacagcaaatcctccgctgatgggcgatctggtgagggtcatgcctcgggcgacgacaatgataatgagggcacacactttgatcaagaactcagccgcagagaccttgtgcacatgattgtccagcatggttaccggttttcaatagtagatgatgtgggcttccaaaagttcgtcaagaacctccagcctcagtttaggatggtgtcatatgacacggtgaggtctgataccatgg

SEQ ID NO: 25653 - protein, 179 aa, Panicum virgatum
  misc_feature: Ceres CLONE 1864500
  misc_feature (35)..(81): Pfam Name: zf-BED Pfam Description: BED zinc finger
MLEPTAIEVPIAASVSNALVPAPAVHNPRTRKLRSAVWQDFTKERRADGNCVAVCKHCKKQLTATSRSGTTHLRNHLAICTTTSTRRAGKRRKLVVRRIHHSKSSADGRSGEGHASGDDNDNEGTHFDQELSRRDLVHMIVQHGYRFSIVDDVGFQKFVKNLQPQFRMVSYDTVRSDTM

SEQ ID NO: 25654 - DNA, 684 bp, Panicum virgatum
  misc_feature: Ceres CLONE 1864512
  misc_feature: Encodes the peptide sequence at SEQ ID NO. 25655
acaagttgcccacgatcgctgccgcccaggacagctttgcctctgcttcgtcttcctccctcctctgactctgctgcactctgctcgaccttccgttccatttccacccatggtgcggcttctgctcgcgctggcgcttcttctcgtcggacggttggccgatgcggcgacggtgaaatacaccttcacggtggggagcatgcaaatcaatcagctctgcagcacaaccagtattattgcagttaacggtcaattgccaggcccgtcgatagaagtgaacgaaggtgacgcggttgaggtcaaagtcatcaacaattcaccatacaacgtaaccatccactggtaactcctagtactactacttaaactcgagaaacttctccttcgtcaccgccgccgtgttgtcgatagacgcgttcttttgggaaaaataaataaatagagagataaaaaatagtagggttttgtcagaaaagaaaagacagcattacagttgctgtgagttgtttgtttttcttagaaacatcaaagtcgccccgcgacatcaagacatgtacaaggtgccgtaaggaacctgccatgccagcgttttatcggatcctttggtgtgatggttttgataaatttttctgaatttcttagccctccatccggaagagacgaaagtgaaacctctgaaaagga

SEQ ID NO: 25655 - protein, 78 aa, Panicum virgatum
  misc_feature: Ceres CLONE 1864512
  misc_feature (27)..(78): Pfam Name: Cu-oxidase_3 Pfam Description: Multicopper oxidase
  misc_feature: SWISSPROT Homolog: EC 1.10.3.2 Laccase
  misc_feature: Useful for making plants with altered cell wall content and/or composition
MVRLLLALALLLVGRLADAATVKYTFTVGSMQINQLCSTTSIIAVNGQLPGPSIEVNEGDAVEVKVINNSPYNVTIHW

SEQ ID NO: 25656 - DNA, 1314 bp, Panicum virgatum
  misc_feature: Ceres CLONE 1864525
  misc_feature: Encodes the peptide sequence at SEQ ID NO. 25657
aaacccgacgacgcgtcactccgtccctcgccgctcgcgcgctccttcccaccacgccccccgcgccggccggcgcgatgccgtccccggcgtcctacctcctcctcctcaaccccgcgaagtcattctccctccgccgcctctcgcacccgcaaccgtccccgcgcctccaggcccgccggccccatgtctcctgcgacgcccagcgtgggggcggtagcaggaccggcggcggcgggaggcgcgaggccatccccaccggcgccagcaaggccaagaagcagatcgtattcttcgacgccgcgccgccggtggcgcagccgcagccgcagcagggcgggagcgccgtagagaaaggggagggcgagaaggcgacgaccaaggcaggcagcggcaacgcggcgctggcgctgctgaggagggccaccaagaagacgctcgcggtgctgtccaacctcccgctcgccatctccgagatgttcgccatcgccgccctcatggccctaggcacggtgatcgaccagggagaggcgccgagctactacttcgagaagttccccgaggacaacccagtcttcggcttcatcacgtggaggtggatcctgacgcccgggttcgaccacatgttctcctcgccggtcttcctcggcctcctcgcgctgctcgccttgtccctcatggcctgcacctacacgacccagctccccatggtcaaggtcgcgagaagatggtcgttcacacaatccagagaaagaatcaagaagcaggagtttgcggattctcttccccgagcatccattcaggatttgggggtcatcttgatgggtgccggatatgaggtattcacaaaggggccgtccttgtatgctttcaaagggctggcaggtcggtatgcgcctataggcgtgcatttagcaatgcttttcatcatggctggagccacgcttagcgcaacgggaagcttcaaaggctcagtggatgtgcctcaagggctgaattttgttataggggatgttatgaaacccagaggggtcctctccgtcgcgcctgatgttttcaatactgaagttcatgtcaaccggttctacatggagtactatgatagtggagaggtcttacaattttatagcgatctttcactttttaaccttgatggtaaagaggtgatgaggaagactatcaaagtgaatgatcccctcaggtacggaggaatcacaatctaccaaacggactggggattttcagcattgcaagtgaggaaaaaatgcgaaggacctttcaatttagccatggcccccttgaagctgaatggcg

SEQ ID NO: 25657 - protein, 412 aa, Panicum virgatum
  misc_feature: Ceres CLONE 1864525
  misc_feature (127)..(412): Pfam Name: ResB Pfam Description: ResB-like family
MPSPASYLLLLNPAKSFSLRRLSHPQPSPRLQARRPHVSCDAQRGGGSRTGGGGRREAIPTGASKAKKQIVFFDAAPPVAQPQPQQGGSAVEKGEGEKATTKAGSGNAALALLRRATKKTLAVLSNLPLAISEMFAIAALMALGTVIDQGEAPSYYFEKFPEDNPVFGFITWRWILTPGFDHMFSSPVFLGLLALLALSLMACTYTTQLPMVKVARRWSFTQSRERIKKQEFADSLPRASIQDLGVILMGAGYEVFTKGPSLYAFKGLAGRYAPIGVHLAMLFIMAGATLSATGSFKGSVDVPQGLNFVIGDVMKPRGVLSVAPDVFNTEVHVNRFYMEYYDSGEVLQFYSDLSLFNLDGKEVMRKTIKVNDPLRYGGITIYQTDWGFSALQVRKKCEGPFNLAMAPLKLNG

SEQ ID NO: 25658 - DNA, 819 bp, Panicum virgatum
  misc_feature: Ceres CLONE 1864525-R
gtcttcttgtgctgacgtgctgtttgttggctgtcgtcgttgtgggacgaactgagcaggggacgaccctagggacgtgaaggcgcggctcaaggtgtgggcgcaggcggtggcgctcgcctccgccgcctcccgcctcggctcgtgaaggtccaggcggcgagtccaagaactcaccatccaagctcttccttcggctaaggatgcgggcacgcgatcaccatgagagataaccccgtcatcatctccaacattaacagtcttccaagttccaatctcatcaaggaaaaaaaaactacaaaaaaaaagaacagttggttctgacaacatttttgcgttccactgtacaaatatgcgtcgtgtactcgtcgtgtgtgtgtgtgtggtcgtagctggtcccaaagaaaaagaaaagaaaagaaagctataggattagcaaacatgtggtttgggcagggagctagccgtacgtgcacaacgggatcgcgcgcctcgctaggggtgacacgtgcagcgcggcggaccgtgtgtgtgtgtgtttcttttgcgttgcatgattgttgttgtacgagtatagagtgcaggcgaagaaaagtggaaaacagaacaaatgtttttttttggcatggatgatgcctgttgtttggccagcggggagcaaggcgaccccaacagctttacaggtgttcttcatccatgcgttccagtacaatagaaaagggtggaggatagattcatgcagaaatggtttccagtagaagggagactagctgtagcagctctagctctgctgatctgtcctctgttggtattgcgatt

SEQ ID NO: 25659 - DNA, 1311 bp, Panicum virgatum
  misc_feature: Ceres CLONE 1864526
  misc_feature: Encodes the peptide sequence at SEQ ID NO. 25660
ccctttcctccggagctgcgaaattttgagaccccagccagacgacgcgaagaccacccacccaaccccaccagcccccgcaattcccgcagattgcagaagcgtccatcgccggcggcgggcgcttcggcgagcggccacgggcgcgcgcgcttccgccctctgcctgcgcgccgagtgggtgcggagggcccgcctcgccggcgccggcgatgggcaactcgctggggtgctcggcctctggcgagcggctcgtgtcggcggcgcgcgacggggacgccatcgaggcgcggatgctgctggaactcagcccggcgctcgcgcgctactccaccttcggcagcctcaacaccccgctccacttcgccgccgccaagggccacctcgatattgtcacgatgctgttggagaaaggtgctgacgttaacgcgcgcaactactgcggccagactgcattgatgcacgcatgtcggcatggacactgggaggtggttcagatgcttcttctcttcagatgcaatgttaccagggcagattacttgagtggccgaacggcattgcattttgcagcacatgatgggtttgttcggtgtgtaaggcttttgcttgcagattttgtccctagtgtggccttggaggatattgccacttcggtagcggatggtgattgtcaaacaaacagcgggagcagtcccaattcttcattggggcaaaagtttaatgaacctgctcgtgtgaggtacataaacaagcctgctgatggtggtgtaacagcacttcacatggcggcattgaatggtgatttaaattgcatgcagttgttgattgatttgggtgctaatgtctcagccgtcacattcccctatggcactactgcaaatttgataggagctggcagtacgccattgcattatgcagccggtggggggaagctggagtgctgtgagctattaatatcaaagggtgctagcaggttgacactcaactgcaatgggtggcttcccatggatgttgctaggatatttggacggcgctctttgaagccattactttctccaaattcacactctattgtccctatatttcaaccgtccagttatcttgccttgccactcatgagcatacttaatatagccagagaatttgggctgcagtatagcgtaccctcagtggatgatagtgatctctgttcagtttgtctggaaaggtcttgttctgttgctgctgaaggttgcagtcatgagttctgcatcaaatgtgctctctacctttgctcaacaagcaacatccgtgtcgagttcacaggaccac

SEQ ID NO: 25660 - protein, 366 aa, Panicum virgatum
  misc_feature: Ceres CLONE 1864526
  misc_feature (44)..(76): Pfam Name: Ank Pfam Description: Ankyrin repeat
  misc_feature (184)..(216): Pfam Name: Ank Pfam Description: Ankyrin repeat
  misc_feature (77)..(109): Pfam Name: Ank Pfam Description: Ankyrin repeat
  misc_feature (227)..(259): Pfam Name: Ank Pfam Description: Ankyrin repeat
  misc_feature: SWISSPROT Homolog: EC 2.4.2.30 NAD(+) ADP-ribosyltransferase
MGNSLGCSASGERLVSAARDGDAIEARMLLELSPALARYSTFGSLNTPLHFAAAKGHLDIVTMLLEKGADVNARNYCGQTALMHACRHGHWEVVQMLLLFRCNVTRADYLSGRTALHFAAHDGFVRCVRLLLADFVPSVALEDIATSVADGDCQTNSGSSPNSSLGQKFNEPARVRYINKPADGGVTALHMAALNGDLNCMQLLIDLGANVSAVTFPYGTTANLIGAGSTPLHYAAGGGKLECCELLISKGASRLTLNCNGWLPMDVARIFGRRSLKPLLSPNSHSIVPIFQPSSYLALPLMSILNIAREFGLQYSVPSVDDSDLCSVCLERSCSVAAEGCSHEFCIKCALYLCSTSNIRVEFTGP

SEQ ID NO: 25661 - DNA, 639 bp, Panicum virgatum
  misc_feature: Ceres CLONE 1864526-R
acccgatctatggactcgccagccactgtctccagagctgaaatcaggcgcaaccgggtggcagctgtctcttcggagctagtctgtccaatcacctgcagcccattcccgtcgtccgccctcccaacctgcaggtgcagcgatgatgatccatgtggtgctacagaagcacaggattccgaggaccaatctccacgcccctcccacagtgctagtatggagctggacaagaggggagaggatctcgaccggaccagctgctcaggcatgttctggagtcgaagaagctgtcacagggagcagcagtgtgatgccgagatcaacgcatgattctttatttctggttgtgaatatatttggattcgtagcagctcaatgcgggagacgggcaccggctatttttcctccccagctgtgttcctttcctatttgcagccaacattttcttgattggtgagatcctgcagcctttgctgccgtagcgtgtgtactgtactgtaacaattttgttacaagtggtcatgtgcctgtgaatctagatagcttcaaagtttctagtcagttactgttctttgtagctgtatgtaaattacagaagctggatgaaattatttttctgattcagatgatgatatattt

SEQ ID NO: 25662 - DNA, 813 bp, Panicum virgatum
  misc_feature: Ceres CLONE 1864528-R
  misc_feature: Encodes the peptide sequence at SEQ ID NO. 25663
agctgattgcggtgtctcgcttgccaacgaaatggggcctcttccgggcttactgctaccaatccaagctcgaaggaactgagcacattgctgttgtgaagggcgatatcagcaacggcgaagacgtcctcgtgagggtgcactcggaatgcctgacgggcgacatcctcggctctgcccgctgcgactgcggcaaccagctggacctggcgctggagctcatcgaaaaggccggccgtggcgtgctcgtgtacctccgcggccacgagggccgcggcatcggcctgggccagaagctccgggcctacaacctgcaggacgagggccacgacaccgtcgaggcgaacgtcgagctcggcctcgccgtcgacgcgcgcgagtacggcatcggcgcccagatactccgtgacatcggcgtgcgcacgatgcggctgatgaccaacaacccggccaagttcatcgggctcaagggctacggcctcgccgtggtggggagggtgccggtgatctccccgatcaccaaggagaaccagaagtacctcgagacgaagcggaccaagatggggcacgtctacggctccgacctccctggcagcctgccggggctcgccaatccgcaagacaccgccgctgacaaagcagacgatacccaaaactgataccaatacacaattacaataacaaattctcgtttctttttggtggttcgttccgaaccatgattgggattgagaacgagatttttacttttgaaagagaagaactgtgctcatattgaaagcaataaattgagaacgagaattgcagagtatt

SEQ ID NO: 25663 - protein, 218 aa, Panicum virgatum
  misc_feature: Ceres CLONE 1864528-R
  misc_feature (1)..(168): Pfam Name: GTP_cyclohydro2 Pfam Description: GTP cyclohydrolase II
  misc_feature: SWISSPROT Homolog: EC 3.5.4.25 GTP cyclohydrolase II
LIAVSRLPTKWGLFRAYCYQSKLEGTEHIAVVKGDISNGEDVLVRVHSECLTGDILGSARCDCGNQLDLALELIEKAGRGVLVYLRGHEGRGIGLGQKLRAYNLQDEGHDTVEANVELGLAVDAREYGIGAQILRDIGVRTMRLMTNNPAKFIGLKGYGLAVVGRVPVISPITKENQKYLETKRTKMGHVYGSDLPGSLPGLANPQDTAADKADDTQN

SEQ ID NO: 25664 - DNA, 678 bp, Panicum virgatum
  misc_feature: Ceres CLONE 1864528
aagtgccaacgccgagcacaaccggcccagccgttggcatctccctccccgaagccatggccatggggcggcccgtacggcttgtgctggatgcctccctcctcctcgagccctccgccaccgggggggaagcggcagctctgcggcccggggcggaggtgcttctgcggcgattgcgctactccaacctgacagtggcaatctgctatgtggagagcatgtcgattaatgagtcaggctttcttgaaaaggtcgcaagttcacactcctttggatgtatgccacttcttgtaaaaagtgggaattgttctccaaacgagtcaatgttggaatggagtcaaacaagttcttgtttttatgccacttcaagagctcacaaaggtttaatttctgagcttcagaatcacaactggaaagttgtttctgtaggtaatgaagttcctggggttttaaatgtcggaatgcttcaggagttgcttctcactttggctactttgataaaaatagaaataggtggctcatctgttctggtgattgggtatgtaatgaaacaatcccgcgaggtggactttgcaaggagaggagcatttcccatatatcctagtaagcacagtcttatctttgttcctctttcattcgaacttcctctaagttcacaattgcaagaagttgatatgg

SEQ ID NO: 25665 - DNA, 1261 bp, Panicum virgatum
  misc_feature: Ceres CLONE 1864540
  misc_feature: Encodes the peptide sequence at SEQ ID NO. 25666
aaaactactccgcaattccccaaccccgaaggaagcgacgtcccctagagcacgagcacgacctggccgcaccgtgccgtctcacggagcccgcccgtctagaagcttcgtcgccgcccgcccgcccgcccgcgccgtcgcacgccgccctagggttccgccggcgcggggggttcgccggagatggactggagcgcggtgacggcggaggacctggtggacgcgctgcgggaggtggactggtccacgccgccgcggcccgtcccggagttcttctcccgcttcaccgtcccccgctcctactccaagtggaccagccgcctcaagtgcaacctctactactacaggacaaactatttcatcttgatcatgttcatccttgggatgggcttcctttggaaaccggttgcaatccttgcagcttttatgactggactcagcattgcatttctcaatgacaggtaagtaaatacttagctaaaaccattcctgtgcttgtgcttgtaatctgtttctttatagtttcaattgttcatttacacaggtgaaaaggtctctttactttgaactagcaaagatattgtgcttttcatccttcattaataaaatacattctactgtaaaattctataagggcgggcctggtgcagcggtagagcctaccgtatgtaaccggaaggtcccgggttcgagccccagcctctgcacatttgtgtgggtaaggcttggggcttaaagacaacccttccccagaccccgcacagtgcgggaagcctacggcactgggtatgcccttttagagtttttttatcttcggaccaatgaaaagctcgtcagtttgaagctgcaatatggggataacccatcttgcaaattatataataaactttgacatttggcatttgactgataacctcatgtatgtgtacaagttaacagtggaattttgacaatttgcagttttctagttcaatttctgctctagtcaagagctttttttatgccttaagccgtaggtccaggtgaatatgagggatcgatgttgtttccacctaagtgcttgagattttacatagaagtgttgagattgttttgagaacacagggatatgtctatatggcactgtaatttccttatacagtccttgtttcttgattctgtcctaatctaccaaaagaccagatagatactatagtaatgtttataacttgtctttctgataatgattgggtaatgaactcaaacaatgttatatccaact

SEQ ID NO: 25666 - protein, 93 aa, Panicum virgatum
  misc_feature: Ceres CLONE 1864540
  misc_feature (16)..(93): Pfam Name: PRA1 Pfam Description: PRA1 family protein
MDWSAVTAEDLVDALREVDWSTPPRPVPEFFSRFTVPRSYSKWTSRLKCNLYYYRTNYFILIMFILGMGFLWKPVAILAAFMTGLSIAFLNDR

SEQ ID NO: 25667 - DNA, 722 bp, Panicum virgatum
  misc_feature: Ceres CLONE 1864540-R
  misc_feature: Encodes the peptide sequence at SEQ ID NO. 25668
gctgtacgtcgtcagcaccggcaccggcgacttcctccagaactactaccacaacgcctccctgtcccgccgctacaacgtcccccggtactgcgacctcctcatcggcatcttctccgacttggccgagaagttgtataagctgggggcgcggcggatcggcgtcacgtccatgccgccactggggtgcttcccggcgtccatcaggctgtacggcaagggccgcagcgcgtgcgtggctaggctcaaccgcgacgccgacaccttcaacaggaagctgaacgccaccgtcaaggtgctcaaggggcggcacgccgacctcaagatagccatcttcgatatctacacgcccctccggaagcttgccgaagcgccggtggagcaaggcttcgctaacgcgagggggacgtgctgccggacgggcacggcgaagacgagggtgtacctctgcaaccccacgacagccgggacgtgccggaacgccagcagctacgttttcttcgatggcgtccacccgtcggaggctgccaacgtctttatggcggagtccatggtcgaagccggcatcgacctggtcacctagtaatggcgtcaataaacaagagcgctatatagcagctgcaggtgctgcaaaacaaggcaggccatatccatgcatgtgttgctgcttatcggtttcctgttccgtccgggaaaaaactgcagtatactgttaatctgtt

SEQ ID NO: 25668 - protein, 193 aa, Panicum virgatum
  misc_feature: Ceres CLONE 1864540-R
  misc_feature (1)..(184): Pfam Name: Lipase_GDSL Pfam Description: GDSL-like Lipase/Acylhydrolase
  misc_feature: SWISSPROT Homolog: EC 3.2.1.51 Alpha-L-fucosidase
LYVVSTGTGDFLQNYYHNASLSRRYNVPRYCDLLIGIFSDLAEKLYKLGARRIGVTSMPPLGCFPASIRLYGKGRSACVARLNRDADTFNRKLNATVKVLKGRHADLKIAIFDIYTPLRKLAEAPVEQGFANARGTCCRTGTAKTRVYLCNPTTAGTCRNASSYVFFDGVHPSEAANVFMAESMVEAGIDLVT

SEQ ID NO: 25669 - DNA, 498 bp, Panicum virgatum
  misc_feature: Ceres CLONE 1864541
  misc_feature: Encodes the peptide sequence at SEQ ID NO. 25670
aaaaagagcaccctctcctcaggctcttcttctccaccgccagcagtccaccgcctcctcctccaaacgctgccgcgcgccgctcccctgagcaccaccacaccacggcaatggcgggcaacgagctgatcgtggagaacgatccgctcaactggggcgcggaggaggaggagctggccgggagccaccagtacgaagagaagcgcatggtggcgcatgcgccgcaccccgtggtaaagatcgagggctccaccctccgcgtcgggcaggtggccgccgtcgccgccgcccgggaagctcccggcctccacgtcgacctcgactaggccacccgcccccgacacaaggccaccaccgagtggatcctcgactgcatcgcccaccgcggcgacatctacggcatcaccaccggcttcagcggcacctcgcaccgtaggaccaaggacgggtccgcgctccaggtcgagctgctcaggaatatcaacgaccagcatcttc

SEQ ID NO: 25670 - protein, 71 aa, Panicum virgatum
  misc_feature: Ceres CLONE 1864541
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MAGNELIVENDPLNWGAEEEELAGSHQYEEKRMVAHAPHPVVKIEGSTLRVGQVAAVAAAREAPGLHVDLD

SEQ ID NO: 25671 - DNA, 713 bp, Panicum virgatum
  misc_feature: Ceres CLONE 1864551
  misc_feature: Encodes the peptide sequence at SEQ ID NO. 25672
atcagtagtggacccacccacccaccaccatcagagccggcggccatggcgatcggagcagcgctgcagcactggagctcgctcttcttcctcgtgctgcccctggccctgtggtgggcgtggcgggtcctgcactccacctggatcgtcccgcggaggctcggccgggccctgcagtcccagggcctccccggcacggcgtaccgcttcccgttcggcgacctgaagcagttcgcgcggctggcggcggcggcccgggccgagcccatgtcgctgtcccacgccatcacgccgcgcgtgcaccgcttctaccacgacctcatcagggagcacggtaagatctccgtgacctggctcggcccgacgccgagggtgatcgtgaacgaccccacgctggtgcgggaggtcctggccaacaggtccggacacttccggaagcgcaggcacaacggcctcgtccggcggctggccaacgggctggtgagccacgacggccacaagtgggccgcgcaccgcaagatcatcaacccggcctttcacctcgagaaactcaagaaaatgctgccggcttttgcagcatgcgcgaacgagctggtggcgcggtgggaggggtatgtggagtctgacggagcccaggaggtagacgtctggccggagttccagaatctcaccggcgacgtgatctcgcgctcggccttcggcagcagtttcag

SEQ ID NO: 25672 - protein, 222 aa, Panicum virgatum
  misc_feature: Ceres CLONE 1864551
  misc_feature: SWISSPROT Homolog: EC 1.3.3.9 Secologanin synthase
MAIGAALQHWSSLFFLVLPLALWWAWRVLHSTWIVPRRLGRALQSQGLPGTAYRFPFGDLKQFARLAAAARAEPMSLSHAITPRVHRFYHDLIREHGKISVTWLGPTPRVIVNDPTLVREVLANRSGHFRKRRHNGLVRRLANGLVSHDGHKWAAHRKIINPAFHLEKLKKMLPAFAACANELVARWEGYVESDGAQEVDVWPEFQNLTGDVISRSAFGSSF

SEQ ID NO: 25673 - DNA, 639 bp, Panicum virgatum
  misc_feature: Ceres CLONE 1864551-R
ctcctcttgttatacttggcacgtttccaacaggtttggcactgtttatcgagaagaagagcagaagaattgagatctccctgtactgccttgccagagccatcgagagctttttcacaggcatgaccgatgcaggactctgcccgccgatactgcagataaagcgagcagatgtagtcgtgtttagcatagccacctcaatcatcatgcattgctatgcacaggaaagagaagttttccggtccaagtacctgaatgtgctcgactgggtatttggtgtgccaccgccactcgacaatgagggtaagagttgctatcaaccagatgaagccaaaaagtgccagtgatatggtggcttgcagagtccattgcatggtttttgtatcatcttgtgactgtagcgggagagtagactcatcaaaggatttcaagcttacagtgagcctcgcacaggaggctctttgcaagaatcagaatttagtgggtatagcaaagtagatttattcaattgattcatcagaacgttgcccatatgctgggcatatgtattgtaacttaatgatcttcatgtgtgcatgtaacttatgatctcgaagtttttagccggcaaatgaagttgtcggactcttgttatctcag

SEQ ID NO: 25674 - DNA, 665 bp, Panicum virgatum
  misc_feature: Ceres CLONE 1864573
  misc_feature: Encodes the peptide sequence at SEQ ID NO. 25675
atggccaccacccacgccctcgccgccgccacctccgcttgcgccgcgcttccccagcagtctctctctcgctcccgctctttgccatggcggcggcgtcgccgcggtttcctcccttcgccgcggcgctggcggcggtcgcggtgctggctgctgcgggctgggccgcggccggggacccgccgctctcgcccaaggggctcaactgcgaagtggcggcgctgatggcggtgaagagccggctgcgggacgagaagggggtcatggcgctgtgggacatcaactccgtcgacccctgcacctggtccatggtcgcctgctcccccgacaagttcgtcgtctcgctccagatggccaacaacggcttgtccgggacgctgtcgccgagcatcgggaacctcagccacctgcagacaatgtcactacaaaataacaaaatatcaggtgatattcctccagaaatagggaagctgaccaatctgaatgctcttgacctttctagcaatgagtttgttggtgatattccaagttcattggggcagttgactcgactaaattacctgcgccttgataggaataacttgtctgggcagatccctgtggatgttgctaagcttccaggtctcacattccttgacttatcattcaacaatttaagtggccca

SEQ ID NO: 25675 - protein, 192 aa, Panicum virgatum
  misc_feature: Ceres CLONE 1864573
  misc_feature (39)..(79): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Useful for making plants with modulated nitrogen use efficiency
MAAASPRFPPFAAALAAVAVLAAAGWAAAGDPPLSPKGLNCEVAALMAVKSRLRDEKGVMALWDINSVDPCTWSMVACSPDKFVVSLQMANNGLSGTLSPSIGNLSHLQTMSLQNNKISGDIPPEIGKLTNLNALDLSSNEFVGDIPSSLGQLTRLNYLRLDRNNLSGQIPVDVAKLPGLTFLDLSFNNLSG

SEQ ID NO: 25676 - DNA, 629 bp, Panicum virgatum
  misc_feature: Ceres CLONE 1864584
  misc_feature: Encodes the peptide sequence at SEQ ID NO. 25677
aaccccaagcggccaagcctcctctcttcctctccggtcgctccagcctccacctgtctcctcctcctctgctctgcacgccacgcgcggctcggtcctcgataccaatcgcattcctcgagcaccaacgagcgataggcatggccggcgcccagtcctggaggtcgtacctgtgctgcgtcggcggcagcgccgcggtggaggacgacgactcgacgccgcggcggcggcggatcgggggcaaggacagcccgcggtcgtcgtcgcgcaagtcgttctcgagcctcagctcgtcggagacgctgtccccggaggacctctcgctcacgctctccggctccgacctgcacgccttcacgtacgccgagctccgcgccgccacgggcagcttctcccgcgccaactacctcggctgcggcgggttcggccccgtctaccggggcgccgtcggcgagggcctccgcccgggcctgcgcgcgcaggacgtcgccgtcaagtacctcgacctcgaaggcggcacgcaagggcacaaggagtggctggtgagcagagatttctctcccccccgcgggcaatgcacggtctcgatcggcaattaatcctcgtttggtgagactgggcaggccgag

SEQ ID NO: 25677 - protein, 152 aa, Panicum virgatum
  misc_feature: Ceres CLONE 1864584
  misc_feature: SWISSPROT Homolog: EC 2.7.11.1 Non-specific serine/threonine protein kinase
MAGAQSWRSYLCCVGGSAAVEDDDSTPRRRRIGGKDSPRSSSRKSFSSLSSSETLSPEDLSLTLSGSDLHAFTYAELRAATGSFSRANYLGCGGFGPVYRGAVGEGLRPGLRAQDVAVKYLDLEGGTQGHKEWLVSRDFSPPRGQCTVSIGN

SEQ ID NO: 25678 - DNA, 698 bp, Panicum virgatum
  misc_feature: Ceres CLONE 1864586
  misc_feature: Encodes the peptide sequence at SEQ ID NO. 25679
atcagctcaactcatcactctaccacccaggcacccacatcaatacttccattccatttccatcaccaccagccggctaccggcagcaagacagcaacgccgcagcccctatagctcgtgcgtacgtcccgatggagcttccaccatgggcagcttttctcggcgtggtgctcgccaccgtgatgcttctcaaggccgtcctcggccgccgcgggcgccgcgcgtacaacctcccgccggggcccaagccgtggccgatcatcggcaacctcgacctgatgggcgcgctcccgcaccgctccatccacgagctgtcaaggaagtacggcccgctgatgcagctccggttcgggtccttccccgtggtcgtcggctcgtcggtggacatggccaagttcttcctcaagacccacgacgtgatgttcacggaccggcccaagaccgctgccggcaagtacaccacctacaacaaccgggacatcacctggtccccgtacggcgcctactggcggcaggcgcgcaagatgtgcctcaccgagctcttcagcgccaagcgtctcgagtcgtacgagtacatccgcgccgccgaggtccgcgcgctgctgcgcgacctgcacgcggcgtccggctccggccgcgccgtcatgctcaaggactacctgtccacggtgagcctgaacgtgatcacgcgcatggtg

SEQ ID NO: 25679 - protein, 188 aa, Panicum virgatum
  misc_feature: Ceres CLONE 1864586
  misc_feature: SWISSPROT Homolog: EC 1.14.13.21 Flavonoid 3'-monooxygenase
  misc_feature: Useful for making plants with altered carbohydrate content
MELPPWAAFLGVVLATVMLLKAVLGRRGRRAYNLPPGPKPWPIIGNLDLMGALPHRSIHELSRKYGPLMQLRFGSFPVVVGSSVDMAKFFLKTHDVMFTDRPKTAAGKYTTYNNRDITWSPYGAYWRQARKMCLTELFSAKRLESYEYIRAAEVRALLRDLHAASGSGRAVMLKDYLSTVSLNVITRM

SEQ ID NO: 25680 - DNA, 1369 bp, Panicum virgatum
  misc_feature: Ceres CLONE 1864621
  misc_feature: Encodes the peptide sequence at SEQ ID NO. 25681
gcttaattttggcagccacagctcccttcgcttcgcttgctgctgtccgagagcctccgcttcgccttgctgtcggtctcactccctcggctcttctgccccgccctgccgccggcgccgggggcgggagctagtcggcgggcgggggcggcgccgggcgcggatcggccgcgggtgcatggtggaggccgccgcggggcgccggtcgggcaccagccgtcggcggcctagcggcagcggaggggagcaccagcgcctggtcgcgctcgccgtcgccgcgcgcgtcgtcatggtcaccacccgctccgcggggccagcggcggcgggaggaggccgtggagcggcggcagcaagggaaattgaaggaggcggcagcggcggcggccggtgcgtggaggacttcttccactgcctactcggcgtgctcggagcgctcggcgtcacgtggggggcgcccgcgcggccccagaggcagccgctgccgcgcggggttggcgcggcgcccacgcccgcggacgcccggcgcttcgcggcggagctcagggcgaccccaggccggatcgccggcaatggctcctgcgccgtcgcgtctctgtacacgctgcagggcaagaagggcgtcaaccaggatgccatgatcttctgggagaacttctgttcgagagatgatacaatcttctgtggtgtgtttgatggtcatggaccttacggccatttggttgctaagagagtaagagatctcctgcctgtaaagttaggagcagatttggcaatggaagatggtagagaaacatcctctagcaacattaagagcaacacaaatgaagtacgttcaccagaacacacagacagaggagatactgtcatttcctctgaagctgagcagaatggagagtatgcagagatcttcccagcattgagaacttcattcttgaaggccttccatgtaatggatagggatctcaagttacataaaaatattgattgcttcttcagtgggactacagcagtggcagtgatcaagcagggacacaatcttataatcggcaacttgggcgattcaagagctgtcttgggcaccagagatgaaaatgatcagcttgttgccatccaattgacagttgacctcaagccaaacattccaagtgaagcgcagagaatcaggcaacgcaggggcagaatatttgcactccctgaagaaccagaggtagctcgtgtttggctaccaaagtacaactcacctggattggccatggctagggcatttggagacttctgtctgaaggatcatggtgtaattttcatgcctgatgtttcctatcaccgcatcacagaaaaggatgattttattgtgctggctacggatggg

SEQ ID NO: 25681 - protein, 396 aa, Panicum virgatum
  misc_feature: Ceres CLONE 1864621
  misc_feature (135)..(396): Pfam Name: PP2C Pfam Description: Protein phosphatase 2C
  misc_feature: SWISSPROT Homolog: EC 3.1.3.16 Phosphoprotein phosphatase
MVEAAAGRRSGTSRRRPSGSGGEHQRLVALAVAARVVMVTTRSAGPAAAGGGRGAAAAREIEGGGSGGGRCVEDFFHCLLGVLGALGVTWGAPARPQRQPLPRGVGAAPTPADARRFAAELRATPGRIAGNGSCAVASLYTLQGKKGVNQDAMIFWENFCSRDDTIFCGVFDGHGPYGHLVAKRVRDLLPVKLGADLAMEDGRETSSSNIKSNTNEVRSPEHTDRGDTVISSEAEQNGEYAEIFPALRTSFLKAFHVMDRDLKLHKNIDCFFSGTTAVAVIKQGHNLIIGNLGDSRAVLGTRDENDQLVAIQLTVDLKPNIPSEAQRIRQRRGRIFALPEEPEVARVWLPKYNSPGLAMARAFGDFCLKDHGVIFMPDVSYHRITEKDDFIVLATD

SEQ ID NO: 25682 - DNA, 557 bp, Panicum virgatum
  misc_feature: Ceres CLONE 1864621-R
aatgaggtttctgttgtcgaaacagttgcaaggccagtcaccctcacggatctgctgaaggatggttgaggcacaaagcaaggcatcatcatcaagtgacggtggctgctgcctgtgattgggatctgctgcgcaatcagtggttcaggcacagagtggaggcaacttgtacatgctgtacctgtgattttggcatctttgggaccgaagatatagcacgtcggggagttgctgcttgctattttttatgcacgcaagtgtgactaggatttgcagttttgccttgtgtagggtacagcgtcagtttcgcgtccagttctttgtaataattttgttcattttcatcgtcaagaggttgagatcatagtatcatgtaggaatgagcctattgagttttggtgtttcttgtaaatattcatcattctatatctgtggtgtctgatccaactgtgtgccccttaaaattccataatcagacaggataaaagaaaaaagaccccacagatataagcaaacaccttatattttggacataaccaaaacaccttatatttcgg

SEQ ID NO: 25683 - DNA, 730 bp, Panicum virgatum
  misc_feature: Ceres CLONE 1864623
  misc_feature: Encodes the peptide sequence at SEQ ID NO. 25684
atccgcccgagtctccgccccgcgcccgcgcccgcgcccgcgtaacgttaacctgctcccccccctccccgcaacctatatagcacctcccctcgccattttcgccatcaccaattctctctcttcctctctctctcgctctcttctcagcagtcagctaaggacatcctccggtcggttcaacgttttcggcgagcttcaactgaaacggcatcgcggcgcacggattcgttttattagcaacgcttctacgggagacgatcaatggttctgtcgatgtctcgcgcgacgagggccgcgtctaggctggtgccggagatcccgctgctgaggcggggcggcaagcagcaggcgcccgaggaggtggcggtgccggcgcacttcgtgtgcccgatctcgctggacctgatgcgggaccccgtcacggcgcccacggggatcacctacgaccgggagagcgtcgagggctggctggcgcgcgggagcgcgcggtgccccgtcaccggccgcccgctgcggctcgccgacctggtccccaactacgccacgcgccggatgatccaggactggtgcgtcgcgaaccgctcccagcgggtgccgacccccaaggtgccactcgaaaacgccgacgccgccgaggcggcggccgcagtgtcgcacgccgcggggcgcgtggacatgcccgcgtgcggggcggtcgccgctacggcgagggcgctccgcaaggaga

SEQ ID NO: 25684 - protein, 155 aa, Panicum virgatum
  misc_feature: Ceres CLONE 1864623
  misc_feature (35)..(109): Pfam Name: U-box Pfam Description: U-box domain
  misc_feature: SWISSPROT Homolog: EC 5.2.1.8 Peptidylprolyl isomerase
MVLSMSRATRAASRLVPEIPLLRRGGKQQAPEEVAVPAHFVCPISLDLMRDPVTAPTGITYDRESVEGWLARGSARCPVTGRPLRLADLVPNYATRRMIQDWCVANRSQRVPTPKVPLENADAAEAAAAVSHAAGRVDMPACGAVAATARALRKE

SEQ ID NO: 25685 - DNA, 740 bp, Panicum virgatum
  misc_feature: Ceres CLONE 1864623-R
caaaccagggatatcttccatacaacaactatgttgcaccttgggcccaaactggaccagtctctcagcctggagcatatcagactcaaccccagcaatatgtgtccagctatccagcaccatcatgggttatgcctgcaaatgccaactcaaccaatcctttccagcctgcgacataccaaatgccaaaccctcccgttgcttctgtttcccctgcagctacctatccagctccgtcgaagccgtatgctgctccgccaatgcaacatgttccgtctccaaaccccaagccgatgcatagttacaactcttttgtttctcaaacatacaatggtccaaacatggcatcagatgctcggatgaatgggaatcagcggccaaaagaaactccagcgacagcagccagaccgtattacatgccagacaatttgtttggcgatttgatcgacgtgaagagttttggcgctggaagcaagatcaataggtcgaccagcatgccaagtcctaagggtggtggccagcctatgataggtagaaataaataggcctccgcagttcaaatttgagatgatcatattgattagtcgctactgtcgtttggcttgatgtaaatttgatgtatatcactgtatcggccagtcagtattggttactttggtaaatatcatggttgcggcgtgcgtatttttactagagatggtagaacgtcattgctactgatgatcaatgacattcttgtg

SEQ ID NO: 25686 - DNA, 1411 bp, Panicum virgatum
  misc_feature: Ceres CLONE 1864630
  misc_feature: Encodes the peptide sequence at SEQ ID NO. 25687
gttggcagccgcgatccttcgaaagcttcgaagccgacgaaccccaccaccgccaccgccccacgcagaggagggagaagaggacgagcggtttgcccgccccgtgaccgcctccgcggaaggcgacgcaactgacaccgacgcggtcgtcccgtcttccttctctccccagtccttctcgtcgcgcgatggcttcggccgcgtccgccggggtcgcggcgctcgggatctccggcgccgacggcgagtgggcggccgcgtgcccaccgctgcggcggaacctgcacctgctcgcgcccgacgaggttgaacttgcaaaaatgctgttgaatgagggccaaatgcacctgtttgaacactggcctgaaccaggtgttgatgatgacaagaaaaaaagcttctttgatcaggttcgtcgacttaattcaagctatcctggagggctggtatcgtacatccagaatgccaaaaaacttttggcagattcaaaggcaggcaaaaatccatatgatggttttactccttctgttccttcaggggaggtattgacctttggcgatgacaattttgtttcactggaagcagctggggtaaaagaagcacggagtgctgcatttgttcttgtagctggagggcttggtgaaagacttggctataaaggaattaaggtagcactcccccgggaaacgattactggaaaatgtttccttcaacattatatagagtctattctgtctttacaagaggccagctgcaaaatggttgatgacgggtgtcatacacagattccatttgttattatgacttctgatgatacaaatgcgcttactatccagcttttggagtcgaactcctattttggaatggaaccatctcaagtgaaaatactaaagcaggaaaaagtagcgtgtctagctgacaatgatgcaaggcttgcattagacccaaatgacaagtacaaaattcagacaaagccacatgggcatggggatgttcattctcttctttattcaagtggcttgcttgagcaatggaaaagtgaagggcggaagtgggttctctttttccaggatacaaatggactgcttttcaatgcaataccatcagcattaggtgtcagtgctactaagggttacaacgtaaattctcttgcagttcctaggaaggcaaaagaagcaattggaggaattaccaaacttactcatgtcgatggtagaacaatggtcatcaatgtagaatacaatcagcttgatcccctccttcgtgcaactggatatcctgatggagatgcaaattgtgaaacaggctattctccatatcctggaaatattaaccagctgatactggagcttggaccgtacattgaggagctcaaaaagacacatggcgccatttctgaatttgtaatccc

SEQ ID NO: 25687 - protein, 407 aa, Panicum virgatum
  misc_feature: Ceres CLONE 1864630
  misc_feature: SWISSPROT Homolog: EC 2.7.7.64 UTP-monosaccharide-1-phosphate uridylyltransferase
MASAASAGVAALGISGADGEWAAACPPLRRNLHLLAPDEVELAKMLLNEGQMHLFEHWPEPGVDDDKKKSFFDQVRRLNSSYPGGLVSYIQNAKKLLADSKAGKNPYDGFTPSVPSGEVLTFGDDNFVSLEAAGVKEARSAAFVLVAGGLGERLGYKGIKVALPRETITGKCFLQHYIESILSLQEASCKMVDDGCHTQIPFVIMTSDDTNALTIQLLESNSYFGMEPSQVKILKQEKVACLADNDARLALDPNDKYKIQTKPHGHGDVHSLLYSSGLLEQWKSEGRKWVLFFQDTNGLLFNAIPSALGVSATKGYNVNSLAVPRKAKEAIGGITKLTHVDGRTMVINVEYNQLDPLLRATGYPDGDANCETGYSPYPGNINQLILELGPYIEELKKTHGAISEFVI

SEQ ID NO: 25688 - DNA, 675 bp, Panicum virgatum
  misc_feature: Ceres CLONE 1864630-R
  misc_feature: Encodes the peptide sequence at SEQ ID NO. 25689
gacactttcaacgggcaagaggtagaggtttggccacgcataacctggagtccacggtggggtcttaccttcaagaatgtcaaggagaaagtgcgtggggactcttccatttctcaggggtcagctttggctatcaatggtcggaacatcttccttgaaggcctttcattggacggcactcttattatcaacgctgttgatgaagctgaggttaaaattacgggtcgtgtacaaaataaaggctggcctatcctgcacgtcgactacaaggacacctcagagaaggaagagatcagaatccgtggatttaagttcgagaaggttgaacagctagaggtgaactacacggaaccaggaaagcattccttgagtgcgtgaacaaagcattccttgattgcttcaggttccaaccactagaaatagttcacgtcatgattgcctcccagattttaggaggccattagcaatgacctgaaagtgttcttgtccttggcaagtactaataaggagcaatgttcttcaccaatcagtcatcattcttgatgtatatttgtacttgtatagtaccctcgtttatagtcaaacctttttcccacttttgtgtaatcaaagttgaatatttatattggatctgatgttgctgcaataattaatagtgaatcaaaacttggcgcc

SEQ ID NO: 25689 - protein, 125 aa, Panicum virgatum
  misc_feature: Ceres CLONE 1864630-R
  misc_feature: SWISSPROT Homolog: EC 2.7.7.64 UTP-monosaccharide-1-phosphate uridylyltransferase
DTFNGQEVEVWPRITWSPRWGLTFKNVKEKVRGDSSISQGSALAINGRNIFLEGLSLDGTLIINAVDEAEVKITGRVQNKGWPILHVDYKDTSEKEEIRIRGFKFEKVEQLEVNYTEPGKHSLSA

SEQ ID NO: 25690 - DNA, 715 bp, Panicum virgatum
  misc_feature: Ceres CLONE 1864651
  misc_feature: Encodes the peptide sequence at SEQ ID NO. 25691
gcctctattcttggcaataccgatctcgatcgcgaggcccgaggagtgcagggaaagttggcgggcgaggggatggggaaatgaaatccaggctttccgagccggaaagatctccagatgaatttctatgccttttctcagtttctggattgggttgattgagctaggggaggatcttgtcggctgcttttgtttgttcggtgggtgatttacgaatgacgatggccccgccggatttccgtgcgccattcgcgcgcgtgcaggcgcgcagccgtacatcggcgtcaactacggcgaggtggcggacaacctgccgccgccggaggagacggcgcggctgctcaagtccacggccatctccaaggtccggctctacggcgtcgacgcggggctcatccgcgcgctggccggctccaacatctccgtcgtcgtcggcgtggccaacggcgacatcccctcgctggccgcggacccggccgcggcgtcgcggtggctcgccgccaacgtgctcccgttcgtcccggccacggccatctccgccgtggccgtgggcaacgaggtgctcgagtccggggacgcctccctggccgcggcgctgctcccggccatgcagaacctccgcgccgccgccgcgggcggcgccgccgcgggggtcaggttctcccacgtcaacaccatgggcgtgatggcgcagtcggacccgcccgtccacggg

SEQ ID NO: 25691 - protein, 35 aa, Panicum virgatum
  misc_feature: Ceres CLONE 1864651
  misc_feature: Useful for making plants with altered carbohydrate content
MQNLRAAAAGGAAAGVRFSHVNTMGVMAQSDPPVH

SEQ ID NO: 25692 - DNA, 1357 bp, Panicum virgatum
  misc_feature: Ceres CLONE 1864658
  misc_feature: Encodes the peptide sequence at SEQ ID NO. 25693
gccccaccaccgcgcaccatttcctttccatccccctctggccgcgccccctctttgcctgagtcgctcggcccccctctgcctccatcgtcgtctcgcctcatcgccgtggaccgcgtccccttccgcctctgcagcggccgtgagcgcggtcaactctcccgccggcggagcgagagcgggaccggagcagggagaggcgggagggggtccccggatctgagctgagctgcgctccccgtgcgcccgccgctggtcaccgcccgctcagatctcgagcccccgcggatctgctgctgctgctgctgcgcctcgtgtaagtaagatctagaccgaacaagagggggcttccagctccggttggtggcggttggtcggtgacgaggaggcggcggcaggggaggctgcgaggatgtcgtcgagcacgatccggaaggcgctgggggcggtcaaagaccagaccagcatcagcctcgccaaggtcaccagcaacatcgccccggagctcgacgtgctcatcgtcaaggccaccagccacgacgacgagcccgccgaggagcgccacatccgcgagatcctccacctcacctccggatctcgcgcccacgtcgccgctgccgtggccgcctgctctcgcaggctctcccgcaccagcgactacgtggtggcgctcaagtcgctcatgctcgtgcaccgcctcctggccgagggcgacccatccttccaccgcgagctcctccacgctaccaggcgcggcacccgcctgctgaacctctccgatttccgtgacgaggcgcactctgggtcgtgggatcactctgcctttgtgcgcacctacgcgctctacctcgaccagcgcctcgagttcttcctccatgagcggaagcagggatcaaattctggcagcagtgctaatggtccgtcgccccgtgaccgttggggctcgcctgacccctatggccgccgctcaccctcctactcatcaccccctgggtatggcggatatgatgattaccgtgagaggaatggtggcaacaatgatgataagaggccgccaaccccggtgagggacatgaagccagagcgggtacttgcccgcatgcaccaccttcaacagctgcttgacaggttccttgcttgccgccccactggtggcgcaaagcacagcaggatggtgctggttgcattgtaccagattgtgagagagagcttccagctctatgcagatatctgtgaggtgctggcagtgctgctggacaggttctttgacatggaatatgctgagtgtgtgaaggcttttgaggcctatgctagtgctgcgaagcagattgatgagctctgtgcattctatgcatgg

SEQ ID NO: 25693 - protein, 314 aa, Panicum virgatum
  misc_feature: Ceres CLONE 1864658
  misc_feature (29)..(314): Pfam Name: ANTH Pfam Description: ANTH domain
MSSSTIRKALGAVKDQTSISLAKVTSNIAPELDVLIVKATSHDDEPAEERHIREILHLTSGSRAHVAAAVAACSRRLSRTSDYVVALKSLMLVHRLLAEGDPSFHRELLHATRRGTRLLNLSDFRDEAHSGSWDHSAFVRTYALYLDQRLEFFLHERKQGSNSGSSANGPSPRDRWGSPDPYGRRSPSYSSPPGYGGYDDYRERNGGNNDDKRPPTPVRDMKPERVLARMHHLQQLLDRFLACRPTGGAKHSRMVLVALYQIVRESFQLYADICEVLAVLLDRFFDMEYAECVKAFEAYASAAKQIDELCAFYA

SEQ ID NO: 25694 - DNA, 788 bp, Panicum virgatum
  misc_feature: Ceres CLONE 1864658-R
  misc_feature: Encodes the peptide sequence at SEQ ID NO. 25695
tcgacctgtgtggataaaatcacatgctccgaaaaaagggtttgaagaggcaaaaccagttattgctgctctaaaggagaagggagtatctgctgttggggctgcaggttactgctggggcggaattgttgttgtggagttggcaaaagttcatgagatccaggctgctgtagtattgcaccctgggcctattacaattgatgatattaaagaggtcaagtgcccgatttcgatacttggagctgagatcgatcatgtttctccaccagaattaatcaagcaattcgagcaggtcctttcagcaaactcaggatttgctcacttcgtaaagattttccctggtgtggcacatgggtggagcgtgagatacagccatgatgatgcggctgccgtggcgagtgctgaggaagcgatgggggacacaatcaactggttcaacaagaacctgaaatgaaccctgaagccgcagctttaattgcaatatgtcattcctactcatcgctgcaaatattcttggttttcttctgctgtccaagacctgcatcttcagttgatttggtgtcttgcgctgttttctagttgtatattgtatactttagcacaggctggttcagctgaatgcctgaatctgtgatagaactagcacgctagtatattacatgtatacctgtatgtaacgaatgtgctctatgtttcagtccaatcagtgaatctggttgatttaagttgagggatcagaaaaatgtatttggatgaatctgaagtaaaaatatattgtagttatggtg

SEQ ID NO: 25695 - protein, 150 aa, Panicum virgatum
  misc_feature: Ceres CLONE 1864658-R
  misc_feature (1)..(149): Pfam Name: DLH Pfam Description: Dienelactone hydrolase family
RPVWIKSHAPKKGFEEAKPVIAALKEKGVSAVGAAGYCWGGIVVVELAKVHEIQAAVVLHPGPITIDDIKEVKCPISILGAEIDHVSPPELIKQFEQVLSANSGFAHFVKIFPGVAHGWSVRYSHDDAAAVASAEEAMGDTINWFNKNLK

SEQ ID NO: 25696 - DNA, 658 bp, Panicum virgatum
  misc_feature: Ceres CLONE 1864672
  misc_feature: Encodes the peptide sequence at SEQ ID NO. 25697
atctcctaaatccggccggggcgggaacgagtcgtgaaccccccgactcgaggcgcggccccctcgccgagacccgcgggccggcgcagcccaaggaagaaaggaaccaagcgaagcgagcaccaccggccaccccacccgcggcgaatattcggacgaggaagccgcgtgacccgttccggcttcccgtggtctccctttaccccccggcgatcgatcgatggcgggggaggaggcggagaggttagcggcgtcggcggcggcggcgtggggggaggcggaggagggggaggggaagccgggcgcgggggccaagaagaggaagcgatacgggctcgtcgagtaccgggcgctgccgggctacctgcgggacaacgagtacatccaccggcactaccgctgcgagtggccgctcccgcaggtgctgctctccgccttctccatccacaacgagaccctcaacgtctggacgcatttgattggatttttcatcttcctagctctgaccatatacacggcaactcaagttccaaatgtagtagacatccagagcctacagcatttgccagatgtgctgagaaatgctgatattcataagattcaggcagagcttctgtcatgccttccatcattacctcaccttcctgatttacaaaat

SEQ ID NO: 25697 - protein, 145 aa, Panicum virgatum
  misc_feature: Ceres CLONE 1864672
  misc_feature: Useful for making plants with altered cell wall content and/or composition
MAGEEAERLAASAAAAWGEAEEGEGKPGAGAKKRKRYGLVEYRALPGYLRDNEYIHRHYRCEWPLPQVLLSAFSIHNETLNVWTHLIGFFIFLALTIYTATQVPNVVDIQSLQHLPDVLRNADIHKIQAELLSCLPSLPHLPDLQ

SEQ ID NO: 25698 - DNA, 816 bp, Panicum virgatum
  misc_feature: Ceres CLONE 1864672-R
  misc_feature: Encodes the peptide sequence at SEQ ID NO. 25699
aaacacgccaaaatttgggcaaacttgaagaatctacctctcgtgtaaacccgatttcgacaccagaatttttcaaggtgatggatgctcttaaaacaagctctgcggagcttcacagtgtagtggaggatccacttccggctgcaaaggcagctgcagatgaggtggtggctacaagggtggataggacagttaatttaaatgctgaaactggtcagccagcagcttgtggcactgccggctcaagtgtgcttcatgaaaagaacaatggtccaaataaaggcacacctcccagccttatggattggaacgcgacggcacagacctttcagtgggaggactcgcctgatcctgagggttcagaaccagcattgcgtagaccgcacttgcctagccctaggagaacaccagtttctcctttgccaccggcagaaaacaaaaataagcgtagaagggcaaggaagtggtgcttgttagaagaagaaacactaagaaagggtgttgaactgtatggtagcggtaattggaaggatattctgagtaacaacccagatgtttttatcggcagaacaccagtggacttgaaggataagtggaggaacatgatgaggtagtgggtaaccttttatctggacaaggtaatggagcctgtgttcattctggctgaagtaacctcacgttctggcgtttgctgtggtgaagtagagagccttcaaccatttcgtgacgttactaataatgtaacaaatgctcaccgaataaactgcttcactgaagggctgtattgaacctatgtatagcacgttgcctgtgtgt

SEQ ID NO: 25699 - protein, 203 aa, Panicum virgatum
  misc_feature: Ceres CLONE 1864672-R
  misc_feature (152)..(202): Pfam Name: Myb_DNA-binding Pfam Description: Myb-like DNA-binding domain
TRQNLGKLEESTSRVNPISTPEFFKVMDALKTSSAELHSVVEDPLPAAKAAADEVVATRVDRTVNLNAETGQPAACGTAGSSVLHEKNNGPNKGTPPSLMDWNATAQTFQWEDSPDPEGSEPALRRPHLPSPRRTPVSPLPPAENKNKRRRARKWCLLEEETLRKGVELYGSGNWKDILSNNPDVFIGRTPVDLKDKWRNMMR

SEQ ID NO: 25700 - DNA, 694 bp, Panicum virgatum
  misc_feature: Ceres CLONE 1864679
  misc_feature: Encodes the peptide sequence at SEQ ID NO. 25701
atagatcagtttcccttctcgcgatccagcaattgcaagtgttcttccttctcgttcccggttccaagaccgcatcttttgagcttcttgtttggagagcagccggatctttttcaggaggtttccgatttgcgccgctgcccactggccactcggttttgcgtgtcggtgacgtttcccttatccggagatgtcttttcggagtatggttcgtgatgtaagagaaagctttggttatatatcgaggcgtaactttgaggtgagaattcatcacagagggaagtctcttggaagtgacctgcaagacgggcctatggtaattcagcaaagcagatgggctagccttcctcctgagttactccgcgatgtgataaaaaggttggaggaagatgagagtagctggccatcccgtaaggatgttgtttcttgtgcctctgtttgtacaacctggagggacatgtgtaaggatatagtgacaagtccagaaatttgcgcaaagctcacatttccagtatcacttaagcagcctggaccacgagatggagtgatccaatgtttcataaaaagggacaaatcaaaactgacgtaccgtctctacttgtgccttagctctgctgtgcttgatgagaacgggaagttcctactagctgccaaaaggagccggaggacgacgcacacggactatgccatttct

SEQ ID NO: 25701 - protein, 167 aa, Panicum virgatum
  misc_feature: Ceres CLONE 1864679
  misc_feature (47)..(102): Pfam Name: F-box Pfam Description: F-box domain
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: The sequence is a functional homolog of SEQ ID NO 462 in the 10/666,642 US patent application
MSFRSMVRDVRESFGYISRRNFEVRIHHRGKSLGSDLQDGPMVIQQSRWASLPPELLRDVIKRLEEDESSWPSRKDVVSCASVCTTWRDMCKDIVTSPEICAKLTFPVSLKQPGPRDGVIQCFIKRDKSKLTYRLYLCLSSAVLDENGKFLLAAKRSRRTTHTDYAI

SEQ ID NO: 25702 - DNA, 759 bp, Panicum virgatum
  misc_feature: Ceres CLONE 1864679-R
ctctcccatcgccggcatggccgcggccgcgctcgtcgagcgccaccgccaggccacctccgggcgcggcgccacgatcacggtgttcctgctcatgccgcagttcgtgctcgtcggcgccggcgaggcgttcacgtacatgggccagctcgccttcttcctgcgcgagtgccccaagggcatgaagaccatgagcacggggctcttcctcagcacctgcgcgctcggcttcttcttcagcacgctgctcgtcaccatcgtcgataaggtcacgggccacggcgcccacgggggatggctcgcggacaacctcaattacggcaggctcgactacttctactggttgctcgccgtgatcagcgccatcaacatcgtcctcttcacgctcgctgccaggggatacgtctacgtggagaagcgcctggccgacgccggcatcgagctcgccgacgaggaagccatagccgtcggccattgatcgatcgatgctgccacgaccacgtgcgtgcatgtgcatgcgtgaatgtgcgcgcgcatccttctttcttcttgtatgttttgatgacttattttggcgtgtatgtactcgcggtgggggtatgcgtacgtgatgtattttggcacggtgtgaccccgtcctacctacgtacgtgagggtgaagaaatgtacatagaagggaatatacggcttaataagtgccaatagagataagttgtattatgcttctccttgatgaaatgaacagtagcgttgctgcc

SEQ ID NO: 25703 - DNA, 511 bp, Panicum virgatum
  misc_feature: Ceres CLONE 1864686
  misc_feature: Encodes the peptide sequence at SEQ ID NO. 25704
tgcacgtcgacaccgccagcatcctcctcctgggggcgccgctggcacaaggatcgtcttcacctgatcaccggcatcacaaagcacaccgcatcctggggctgccggggcagcccaccggcgtggcgttcgacatgtacggcggctacgtcaccgtggacgagcaggccggccgcgcgctctactactggttccaggaggccgaccagccggaggcagcaccgctcctcctgtggctgaacggcgggcccgggtgctcctacatcggtggcggcgcgctggaggagctcggcgcctttcgcgtccacaccgacggccagacgctcctgctcaacgagtacgcatggaacaaagcggcgaacgtgctcttcttggagtcgccggtcggcgtgtggttctcttacagcaacaccagctccgacctcgtcgtcggcgacgacagaacggctcaggacgcgtacattttcctggagaaatggttcgagagatttcctcagtacaagtaccgtga

SEQ ID NO: 25704 - protein, 169 aa, Panicum virgatum
  misc_feature: Ceres CLONE 1864686
  misc_feature (35)..(169): Pfam Name: Peptidase_S10 Pfam Description: Serine carboxypeptidase
  misc_feature: SWISSPROT Homolog: EC 3.4.16.6 Carboxypeptidase D
HVDTASILLLGAPLAQGSSSPDHRHHKAHRILGLPGQPTGVAFDMYGGYVTVDEQAGRALYYWFQEADQPEAAPLLLWLNGGPGCSYIGGGALEELGAFRVHTDGQTLLLNEYAWNKAANVLFLESPVGVWFSYSNTSSDLVVGDDRTAQDAYIFLEKWFERFPQYKYR

SEQ ID NO: 25705 - DNA, 582 bp, Panicum virgatum
  misc_feature: Ceres CLONE 1864694
  misc_feature: Encodes the peptide sequence at SEQ ID NO. 25706
cgtcctttccctttcctccgcattccctcttcctccggctatccgtcgccatctccccccgtcgtcctttggtccggaatgagactggccatgcttgctgcccccgcatcaccgggggctggaggtcatggtccccagcttcttcctctgccccatctcgctcgacgtcatgcgctctcccgtcagcctctgcaccggcgtcacctacgaccgcatctccttccagcgctggctctactcctgcaacacctcctgccccgccaccatgctcccgctcccctccaccgatctcgtccccaacctcaccctccgcagcctcatctcgcactgggccacctcggccgccacctgctcacccaccgcctccggaggaacctccgaggatcatactgcctcccccgacagcctagtccgccatgtcgcggcatcaggagcccacccctccccggccctgcggaagctggcgacctacctctccgacgactacttctacaaattcgaaaacaacacgctcatgggcgccggccgcgccgccgagacggtcgcatcggtgctccggacgagaggcgacgagtatgccgc

SEQ ID NO: 25706 - protein, 151 aa, Panicum virgatum
  misc_feature: Ceres CLONE 1864694
  misc_feature (2)..(75): Pfam Name: U-box Pfam Description: U-box domain
MVPSFFLCPISLDVMRSPVSLCTGVTYDRISFQRWLYSCNTSCPATMLPLPSTDLVPNLTLRSLISHWATSAATCSPTASGGTSEDHTASPDSLVRHVAASGAHPSPALRKLATYLSDDYFYKFENNTLMGAGRAAETVASVLRTRGDEYA

SEQ ID NO: 25707 - DNA, 650 bp, Panicum virgatum
  misc_feature: Ceres CLONE 1864710
  misc_feature: Encodes the peptide sequence at SEQ ID NO. 25708
tccctgtcaatcgactcatccagtcgccacccctcggcggctcggccctcgccattgccgccggggctgagaagaagaagggaggcggggcctgcgcggctaacaccatcatcgattgctcctcctttagtttagtggtctgggaaagtaggaagcggccatcaaaagaggcgtccctttgggctttggggctgggggctcggcccccacagagttctttggtggcctagctagattggatattatgatggttggatgagtgttcgtcttggccgcccacctcgtccgcctcgttggctccgcacggctgcatctctcttgagacgaggacgggccgcgcgcttctctgcgtagtccttcgagcaggataggaggcctctgactctctgagctgcacaccatctgagcgacgccatgggagaggtcgcagacatgtacacccaagacgggaccgtcgacatgaagggcaacccggccgtgaagaagggcaccggcaactggcgcgcctgcccttacatcctcgcgaacgagtgctgcgagaggctggcgtactacggcatgagcaccaacctggtgaactacatgaagacccgcctcggccagggggactccgtcgccgccccacacgtcaccaactggagcggaacgtg

SEQ ID NO: 25708 - protein, 78 aa, Panicum virgatum
  misc_feature: Ceres CLONE 1864710
  misc_feature: Useful for making plants with altered carbon content
  misc_feature: Useful for making plants with altered nitrogen content
MGEVADMYTQDGTVDMKGNPAVKKGTGNWRACPYILANECCERLAYYGMSTNLVNYMKTRLGQGDSVAAPHVTNWSGT

SEQ ID NO: 25709 - DNA, 655 bp, Panicum virgatum
  misc_feature: Ceres CLONE 1864714
  misc_feature: Encodes the peptide sequence at SEQ ID NO. 25710
caaatgagcatgggaatgaggagagtgaaaggaagtgggacacgactgggcttggcgcagtaccactaaaattagtggagggtgataaagtgtcaaggaattggtggcgaaagttggagcttgttcgtgggctcgtgtccgaatctgttgacgatcagagtcgtttggaggcacttacatactctgctatttacctaaagtggatttatacaggtcagataccatgctttgaaggtggtggtcaccatcgacccaataaacatgctgaaatatccagggaaatctttcgtgtaattgaaaggacatactatgggaaaaacacatcacctcaggatttgcttgtgatacgcaagattcatccttgtttaccttcatttaagtcagaatttactgcctctgttcctctaacacgaattcgtgatattgctcatcgaaatgacatcccacatgagctcaagcaagaaatcaagcatactatacaaaacaagctccaccgtaatgctggccctgaggatcttattgctaccgaagccatgcttgctaggattacaaagactcctggagaatacagtgaagcttttgttgaacaattcaagatattttatagcgaactaaaaagatttctttaatgctggcagcctactggagcaagtgc

SEQ ID NO: 25710 - protein, 208 aa, Panicum virgatum
  misc_feature: Ceres CLONE 1864714
  misc_feature: SWISSPROT Homolog: EC 2.7.9.5 Phosphoglucan, water dikinase
NEHGNEESERKWDTTGLGAVPLKLVEGDKVSRNWWRKLELVRGLVSESVDDQSRLEALTYSAIYLKWIYTGQIPCFEGGGHHRPNKHAEISREIFRVIERTYYGKNTSPQDLLVIRKIHPCLPSFKSEFTASVPLTRIRDIAHRNDIPHELKQEIKHTIQNKLHRNAGPEDLIATEAMLARITKTPGEYSEAFVEQFKIFYSELKRFL

SEQ ID NO: 25711 - DNA, 789 bp, Panicum virgatum
  misc_feature: Ceres CLONE 1864714-R
  misc_feature: Encodes the peptide sequence at SEQ ID NO. 25712
caagaactagcaaagcccaatgtgcttgaaaggtttcttgaaaataaggaggaaattgctaagcttcgtaaatgctttgctggtctatggagtttggatgatgaagagattgttaaaactgcaattgaaaagcctgagttgtttgtgttgaagcctcaacgtgaaggcggagggaacaatatttatggccttgatttgagagagacacttaccagactccagaaggaaggaggggatgcacttgcagcgtacatacttatgcaaagaatcttcccaaaagcttctcttgcttatctagttcgtggtggtatttgccatgagggtcttgtgatttcggagcttggaatatatggtgcttacttgcggaacaaagataaggtagtaatcaatgagcaaagtggctacttgatgcggacgaaagtttcttcatcagatgaaggcggcgtcgctgcagggtttgctgttttggatagcttatacctgactgacaagtgaggtaacgaaaggagcctcagctacagctttcagcaagcttacatcgacaactgattcaacatcatgttctccattaaacaatgccggagaagctgctgcaggctacagccatatctcatctcgtttgatgatttcctactgcccgttcctagggagagaataagtgtattatgtgtggcttgcatgtacatgaaatccatgaaaacaatgatgaacaatcatgttatatgtagatcatgccaatgacctgcgcaggataatctcagccgcttgctcggcccattgccaaacacg

SEQ ID NO: 25712 - protein, 164 aa, Panicum virgatum
  misc_feature: Ceres CLONE 1864714-R
  misc_feature (1)..(162): Pfam Name: GSH_synth_ATP Pfam Description: Eukaryotic glutathione synthase, ATP binding domain
  misc_feature: SWISSPROT Homolog: EC 6.3.2.3 Glutathione synthase
QELAKPNVLERFLENKEEIAKLRKCFAGLWSLDDEEIVKTAIEKPELFVLKPQREGGGNNIYGLDLRETLTRLQKEGGDALAAYILMQRIFPKASLAYLVRGGICHEGLVISELGIYGAYLRNKDKVVINEQSGYLMRTKVSSSDEGGVAAGFAVLDSLYLTDK

SEQ ID NO: 25713 - DNA, 1318 bp, Panicum virgatum
  misc_feature: Ceres CLONE 1864716
  misc_feature: Encodes the peptide sequence at SEQ ID NO. 25714
ttcgaattctcctcccccgttctcccctctcctctcctctcctctcctccgcagcgccgaaccaagccacacggcagcgcgagctgagccaaggcgaagccaagcgcagcggagcaagggtttgtttgctcgcccccacccgaccgcagagccccagaggttctgctcttgagcgtaggaagcctggcgacctgccatggacctggtgggaccgttgctggtggccatggctggcttacttgacgccccaggcctcccgttcttcggctggctcatcaccgcgggctccttcggcctcgccgcgctcatctacgcgctcctccggctgcagcgcgcggcctcgctctactggaccaaggcggccgccagggagaagcgcgccgcctggaagaccctgcggtgccccagctccagccacacgtggaccgaggactacttccgcggcgggcagccatcgacgtgctgcgtgtgcctgtcgtccctcggctccgcgcagggtgtggcgggctccagggccgccgaggccgacgtggtccaccgctgctctgtttgcggggtggcggcgcactcctactgctccaggggcgccgagaaggactgcaagtgcgtcgcgcaggctggtgcgtcgcccttgctgcaccactggtcggagaggtgggtcgagctggacgacaacccggagatatcctccttctgcttctactgcgacgagccgtgtggtgtgccgttcctcggagtctctcctatatggcgctgcctgtggtgccagcggcagatccatgttgattgccatgcaaagctgttgaaggagactgggaacacttgtgatcttggccttctcaggaggcttattgttcctccccagtcggtgaaagaaattagtgaaggtccagcaatcagtggaatgttgaactcgatcaaggaggggcttgtcaattcatcccgtgggagtcgggataggaggccacgcagcaagaagcgcatgaacaaccattcctgtggcaagacagatccgactcccacaaacagctcaatccttgattcagtgcttgaaggatttgctagattgcagggcctggatggaaagtatgcactggcaaagcctaaattatctcaaaattctgtcaaccaaacatatggatctggtattactaatgaagtgaaaaggaagtatgaacttgttgatttaccacaagattcaaggccactgctggttttcatcaatgccaagagtggaggccgaaatggaccttctcttagaagaagactgaacatgttgttgaatcctgtacagatatttgagctaagcgcttctcag

SEQ ID NO: 25714 - protein, 373 aa, Panicum virgatum
  misc_feature: Ceres CLONE 1864716
  misc_feature (148)..(209): Pfam Name: C1_1 Pfam Description: Phorbol esters/diacylglycerol binding domain (C1 domain)
  misc_feature: SWISSPROT Homolog: EC 2.7.1.107 Diacylglycerol kinase
MDLVGPLLVAMAGLLDAPGLPFFGWLITAGSFGLAALIYALLRLQRAASLYWTKAAAREKRAAWKTLRCPSSSHTWTEDYFRGGQPSTCCVCLSSLGSAQGVAGSRAAEADVVHRCSVCGVAAHSYCSRGAEKDCKCVAQAGASPLLHHWSERWVELDDNPEISSFCFYCDEPCGVPFLGVSPIWRCLWCQRQIHVDCHAKLLKETGNTCDLGLLRRLIVPPQSVKEISEGPAISGMLNSIKEGLVNSSRGSRDRRPRSKKRMNNHSCGKTDPTPTNSSILDSVLEGFARLQGLDGKYALAKPKLSQNSVNQTYGSGITNEVKRKYELVDLPQDSRPLLVFINAKSGGRNGPSLRRRLNMLLNPVQIFELSAS

SEQ ID NO: 25715 - DNA, 800 bp, Panicum virgatum
  misc_feature: Ceres CLONE 1864716-R
  misc_feature: Encodes the peptide sequence at SEQ ID NO. 25716
ttggcagtcacgcctacggatagttatgggagtagtgtactgtctgggctacaggcatcagcagaacgctcctgtaactctaaggaatctaaacagttcatgcatatacttgactgaagacaatgccgcaaaggtttcagacatcagctttggcgttggcaagaaagaagatgaagatgaagatgatgctcctgatgagtacaacacagtgtataagttcgctctgctactgcttgagacgatctctggaaggcgtccatattctgaagatgacggcctccttgttctatgggcacacagatatcttaatggtgttagccccgtgatgggtatggtcgacccaacgctaaattcagtcccggaagagcatgtcagagcattctcagagctaattcgtttatgcataagcgaggaccgaaggcagaggccgacaatggcagagcttaccaagaggatgcaggaaatcaccgggatcactcaagatcaggcgattccgaggaaaagtgctctgtggtgggctgaacttgaaatcattacagcttagggagtcaattgtgctgacttgcagcaactctgcaattctgatcgtttgctaggagaaatggagaagattgtacagtttagcgcttttaggcagggcaatagttgtacagatatgcctggttacaccattcttttttgtttttattaccaagcattctttcattctttgatctatgaaaagcaaataaaattcagagagcctgcaaagtacaaggatatgccatttctggtatcatcaaatatgagtgaagtgaacc

SEQ ID NO: 25716 - protein, 180 aa, Panicum virgatum
  misc_feature: Ceres CLONE 1864716-R
  misc_feature: SWISSPROT Homolog: EC 2.7.11.1 Non-specific serine/threonine protein kinase
WQSRLRIVMGVVYCLGYRHQQNAPVTLRNLNSSCIYLTEDNAAKVSDISFGVGKKEDEDEDDAPDEYNTVYKFALLLLETISGRRPYSEDDGLLVLWAHRYLNGVSPVMGMVDPTLNSVPEEHVRAFSELIRLCISEDRRQRPTMAELTKRMQEITGITQDQAIPRKSALWWAELEIITA

SEQ ID NO: 25717 - DNA, 1257 bp, Panicum virgatum
  misc_feature: Ceres CLONE 1864719
  misc_feature: Encodes the peptide sequence at SEQ ID NO. 25718
gcatatacaaacacgagggggaggaggaaagagagagagagagagggatcattgaaaactgcacccatcatcgatccgccccggcccgtttgttcgccaccatttctcccccctcgacgaacccctccctcccgtccctcgctttccccctcgtcggagcaggaatttttatgcgcgctttgggaaagcgcgagttagttttgctctgaagcagcctgctttttatccatccggagccgcgggcgttgggggaggcgaggcgaggcggagctccgtgcgctgctccggccgggcgggcgtgggcaccgaggaggcggcggcgagcgagcgagccagggatctacccatgtcgtcggcggaggacgggtactgcagctcggattcgccgcgggcggagtcccccgaggagtcgcaggcggcggcggacgcggagtcgcctcgcaccggggccaagcgcgagcgcgacctctgcgacatccccgcctcgccgtcgtcgccgctgccggcagctaagcgcagccggagatcggtggagaagcgggtcgtgtcggtgccgctcgccgagtgcggggaccggcccaggggcgccagcggggaggggccgccgccgtcggactcgtggacgtggcgcaagtacgggcagaagcccatcaagggctccccctaccctcgggggtactaccgctgcagcagctccaaggggtgcccggcgaggaagcaggtggagcgcagccgcgcggaccccaccgtgctgctcgtcacctacaccttcgagcacaaccacccgtcgccgcagcccaagagccacagctgccaccagcagggcaaggcgtccccacggccggcgccgaagcccgagccggcggtcgagcaggctgagctcggtccggagcatgagctgaagacagagccagaagcgccggagcaggagctggaaccggagcaggagcagaaggccctcgcaagtctggtcgagccggagacggcaacaaccgcaacggtggctccggtggccgaggaggacgagagcttcgacttcgggtggttcgaccagtacccgacgtggcaccggtcggcgctgtacgcgccgctgctgccgcccgaggagtgggagcgggagctgcagggcgaggacgccctgttcgcggggctcggcgagctgcccgagtgcgccgtcgtgttcggccgccggcgcgagctcagcctcgcggctaccgcgccgtgctcctgatggcagcttcttctccttttcccttt

SEQ ID NO: 25718 - protein, 294 aa, Panicum virgatum
  misc_feature: Ceres CLONE 1864719
  misc_feature (88)..(148): Pfam Name: WRKY Pfam Description: WRKY DNA -binding domain
MSSAEDGYCSSDSPRAESPEESQAAADAESPRTGAKRERDLCDIPASPSSPLPAAKRSRRSVEKRVVSVPLAECGDRPRGASGEGPPPSDSWTWRKYGQKPIKGSPYPRGYYRCSSSKGCPARKQVERSRADPTVLLVTYTFEHNHPSPQPKSHSCHQQGKASPRPAPKPEPAVEQAELGPEHELKTEPEAPEQELEPEQEQKALASLVEPETATTATVAPVAEEDESFDFGWFDQYPTWHRSALYAPLLPPEEWERELQGEDALFAGLGELPECAVVFGRRRELSLAATAPCS

SEQ ID NO: 25719 - DNA, 817 bp, Panicum virgatum
  misc_feature: Ceres CLONE 1864719-R
catcaattatcacggaaggttctagtggaggaccttggagaaagagaattactgatttggatggaactgagggtgatctcccttggtggtgtgtggactgtgtcacccacaatcgatatccaaaggagaatacaaaatgtggcttttatttgcatcctgctgaaggctcgcctgcgccaaacataactcaagggaagctgagtgctccacggatattgagaattcacaaagtagctaattatgtggttgagaaactcgttcttgataaaccgttggatggaggctctgacagcacatttgcgatgggattgagttctggtcaatcacaaccctcagcgctagatagttcttcgcggatcggactaaagctgtggcaaaaactaaagccatgtgtagagatattgtgcaataaccaggttctatcgcaagagatgagtttggctacagtgagaacatatatttggaagaagccggaagacttgattcttcactatagagtggtccaatcgagatgatcgcagcttcagatgtacatgctcacttggttctccagacgcgttcagcatgtctgcacagtagatggtgttgttttggtggcgttgaactgttgaagatacctatggcttagagagaaaatcatcatcttacagaaatattttgctcgtcaccttagtcgttccttgaaacgtgacttctttgtaaagttcctgatcttgccctgctagtaagatgtatcatagcacaggtataaggttctctggtggatgccaagcttgtaaatgtagagactgggtgcttaataaaagattaaatggat

SEQ ID NO: 25720 - DNA, 1239 bp, Panicum virgatum
  misc_feature: Ceres CLONE 1864723
  misc_feature: Encodes the peptide sequence at SEQ ID NO. 25721
tctcccccctcctctcccactccccccaacggccatcaccaacgccgacctcgccgcgattggcaacctcaacccagagtttggcaatcccaatcggcgatcgcctagcgatgcagactctcacggctagttcccctgcttcttcctcttcgatacaccgccgccgccgccgcggcgagtacagagccgccccgcgcggctccgtgcggctagcgccccgggccgcggcggccgcggccaactcggtcctccgcgcgccgccgtccgccgtgcgctacgtgccgccgcccgcacccgcccccaatgccgccccggcgccggcgcggcgcggcggcagcggccaggacgacgccgacgagaaaggcctgagcttcctgcagcgcgcggcggcggcggcgctggacgcgttcgaggccggcgtcatcaccaacctgctggagcgcccgcgcgctctcccgcgtgcggcggaccccgccgtgcagatcgccggcaacttcgcgcccgtgggcgagcagccgcccgtgcgcgcgctccccgtctccggccgcatcccgcccttcatcaacggcgtctacgcgcgcaacggcgccaacccctgctacgagcccaccgccggccaccacctcttcgacggcgacggcatggtgcacgccgtgcgcatccgcaacggcgccgccgagacctacgcctgccgcttcaccgagacggcgcgcctccgccaggagcgcgcgctggggcgggccgtcttccccaaggccatcggcgagctccacggccactcggggatcgcgcgcctcgccctcttctacgcgcgcggcctctgcggcctcgtcgacccctcgcgcggcaccggcgtcgccaacgccggcctcgtctacttcaacggccgcctcctcgccatgtccgaggacgacctcccctaccaggtgcgcgtcaccgacgacggcgacctcgagaccgtcggccgctacgacttcgacggccagctcggctgcgccatgatcgcgcaccccaagctcgaccctgcctccggcgagctcttcgcgctcagctacgacgtcatcaagaagccgtacctcaagtacttctacttccgccccgacggcaccaagtccgccgacgtcgagatcccgctcgaccagcccaccatgatccacgacttcgccatcaccgagaaccacgtcgtggtgcccgaccaccaggtggtgttcaagctcgccgagatgctccgcggcggct

SEQ ID NO: 25721 - protein, 376 aa, Panicum virgatum
  misc_feature: Ceres CLONE 1864723
  misc_feature (105)..(376): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature: Useful for making plants with modulated water use efficiency
  misc_feature: The sequence is a functional homolog of SEQ ID NO 6 in US patent 7049487
  misc_feature: Useful for making plants with modulated drought sensitivity
MQTLTASSPASSSSIHRRRRRGEYRAAPRGSVRLAPRAAAAAANSVLRAPPSAVRYVPPPAPAPNAAPAPARRGGSGQDDADEKGLSFLQRAAAAALDAFEAGVITNLLERPRALPRAADPAVQIAGNFAPVGEQPPVRALPVSGRIPPFINGVYARNGANPCYEPTAGHHLFDGDGMVHAVRIRNGAAETYACRFTETARLRQERALGRAVFPKAIGELHGHSGIARLALFYARGLCGLVDPSRGTGVANAGLVYFNGRLLAMSEDDLPYQVRVTDDGDLETVGRYDFDGQLGCAMIAHPKLDPASGELFALSYDVIKKPYLKYFYFRPDGTKSADVEIPLDQPTMIHDFAITENHVVVPDHQVVFKLAEMLRGG

SEQ ID NO: 25722 - DNA, 635 bp, Panicum virgatum
  misc_feature: Ceres CLONE 1864723-R
  misc_feature: Encodes the peptide sequence at SEQ ID NO. 25723
cgacatgcggctggaggccacggtccagctcccctcccgcgtcccctacggcttccacggcaccttcatcggcgcccgggagctggaggcccaggcctgactgacaaccatggttccttggttctttacactacctacctctccggccgacgatccatggccgccgctcctcctctgctctcctctcctggcttcttggagctgcaaggaagaagcaggagacacaggacggcgaagcaggggaggaattggagggaaatggctttaccagagggagcctgagccgtacataggaggtccccggagccttgtccccatccactgcatacagttactagcggttactcttctttcttttttcccatgtttttacagggtttaatcttatcacactagtgatgacagtccttattagagagagtgaggctgcagcttgcaggtctctgttttcacctcctgctactagtgtagtgagtgttggaggtggtaatagctagtagtaattagcctagtaaatagtgatatagtgggtctcatcaggctgcctctgcagctgctctctgttcagttcctatgtgttgctagtagatgaattggatcaccacccagttgctgcaactgaggtgttattgttc

SEQ ID NO: 25723 - protein, 32 aa, Panicum virgatum
  misc_feature: Ceres CLONE 1864723-R
  misc_feature: SWISSPROT Homolog: EC 1.13.11.51 9-cis-epoxycarotenoid dioxygenase
  misc_feature: Useful for making plants with modulated water use efficiency
  misc_feature: The sequence is a functional homolog of SEQ ID NO 6 in US patent 7049487
  misc_feature: Useful for making plants with modulated drought sensitivity
DMRLEATVQLPSRVPYGFHGTFIGARELEAQA

SEQ ID NO: 25724 - DNA, 642 bp, Panicum virgatum
  misc_feature: Ceres CLONE 1864743
  misc_feature: Encodes the peptide sequence at SEQ ID NO. 25725
agagcagagagagagaggccccgcctccaccaagcactcccatggcggccatggacatcctctcctgcaagctccgctccttccgcctcaattcgtcgcttctcccctcgcctccttccccatcccgctccgtccccacctcccgccgcctccgccgccgccgccatgctcccctccactgccgcctcaccacctcatcctctccatccacttccaccaccaccactacggaagaggcggatgcgaaaagccaggacctttcctccctcctctcctcatcctcctcggacccctccgccgccggcaccggcaagaagaagcggtcgggcggcagcagcggcgcgtcgagcatcccgtcgggggtgcggctggagggcatctccaagtcctacaagggcgccacggtgctcaaggacgtgtcctgggaggtgcagcgcggcgagaaggtggggctcgtcggcgtgaacggcgccggcaaaacaacgcagctccgcatcatcgcggggctcgaggagcccgacggcggcgccgtcatcaaggcaaaggagaacatgaagatcgcgttccttagccaggagttcgaggtctccgcctcccgcaccgtctgggaggagttcttcagcgccttcgaggaggagatga

SEQ ID NO: 25725 - protein, 200 aa, Panicum virgatum
  misc_feature: Ceres CLONE 1864743
  misc_feature: SWISSPROT Homolog: EC 3.6.3.17 Monosaccharide-transporting ATPase
MAAMDILSCKLRSFRLNSSLLPSPPSPSRSVPTSRRLRRRRHAPLHCRLTTSSSPSTSTTTTTEEADAKSQDLSSLLSSSSSDPSAAGTGKKKRSGGSSGASSIPSGVRLEGISKSYKGATVLKDVSWEVQRGEKVGLVGVNGAGKTTQLRIIAGLEEPDGGAVIKAKENMKIAFLSQEFEVSASRTVWEEFFSAFEEEM

SEQ ID NO: 25726 - DNA, 1219 bp, Panicum virgatum
  misc_feature: Ceres CLONE 1864748
  misc_feature: Encodes the peptide sequence at SEQ ID NO. 25727
actgctctctcccaattatggcagccatggaagtgggaaagaggactcgccgagcaatcccccccgaccccaccacgtccggtcacgatctcaccacccgcacccgcacgcgcccgccaccaccactcgaggccgcgcctgcgccactgcggccgcgcggacgcccgctcccgcctgcacgcgtggagccacagccagagccaccggcggcgagcgcgcgagcggtggaccggtggtaggtggccaagcaatggtggcgccgggtggtggtggaggcccggcgcggtggccttcggaggaggagttggaaattgtacgaaagatagttgtggagattagtggaagggatgaacgtgaggttaaagtcgctgcttgcccttacagaatttgccctttgggggctcacattgatcatcagggtggaattgtcacaacaatgaccataaattatggagtactccttggttttgtgccctctaatgattctgaggttttactccaatctggccaatttgaaggtgttatacgattcagagttgatgacttacaaaagcctattgataacccagagaacataaactgggaaagctatgcaagaggtgctgtttatgcactgcagaatagtggatatgatctcaggaagggtatcataggctatatttctggtgtgaaaggtcttgatagctcagggcttagttcttctgcagcggttggcattgcctatttactggctttagaaaatgtaaatgatctggttgtatcatctgtggataacattcagttggacaagtccattgaaaataaatacttgggtcttgaaaatggcattctagatccatctgccattttgttgtcacagtatggttatctcaccttcatggactgcaagactgcttcaccttcctacgtctacttctcagagctgagtaaaagccagcagcctcagggacatctactgttcaagattttgttggcattttcaggactgcaacataatctgccgaagaagcgtggatataatacacgagtttttgagtgcaaagaggctgcccgtgctcttttgcagtgagttcttctgttagtgtagctaagtttggtcatacaaaaaaaaaatactcttaagttcaactataaaaaggttgagatttattgtttttcagtatcttttaatagctgccatgttaataatgcagacaatttttttttactatcttttttg

SEQ ID NO: 25727 - protein, 272 aa, Panicum virgatum
  misc_feature: Ceres CLONE 1864748
  misc_feature: SWISSPROT Homolog: EC 2.7.1.6 Galactokinase
MVAPGGGGGPARWPSEEELEIVRKIVVEISGRDEREVKVAACPYRICPLGAHIDHQGGIVTTMTINYGVLLGFVPSNDSEVLLQSGQFEGVIRFRVDDLQKPIDNPENINWESYARGAVYALQNSGYDLRKGIIGYISGVKGLDSSGLSSSAAVGIAYLLALENVNDLVVSSVDNIQLDKSIENKYLGLENGILDPSAILLSQYGYLTFMDCKTASPSYVYFSELSKSQQPQGHLLFKILLAFSGLQHNLPKKRGYNTRVFECKEAARALLQ

SEQ ID NO: 25728 - DNA, 716 bp, Panicum virgatum
  misc_feature: Ceres CLONE 1864748-R
  misc_feature: Encodes the peptide sequence at SEQ ID NO. 25729
accatccactgtccttaacctcattatcccaactaaatctgctagcaatggggctgcgacccctttcaaaccgggacacgatccaatcttgaatgggacactgaccctcttcgaccccgaccctcgaatcggaacgacgttcccgggtcgagggacgaggcatcgaccccgaatcttgtgactatgttccagcacttctgcatccaccccggcgggagccgggtgctgaacgaggtgcagcggggactcggcctctccgacggcgacatggaggcgtcgcgcatgacgctgcaccggttcggcaacatgtccggcagctcgctgctgtacgagctggcctacatcgaggccaagggccggatgaagaagggcgaccgggtgtgcatgatcggcttcagccccggcatagactgcagcagcgtggtgtgcgagtgcatcaggccggcggcgcgccccgacgacggaccctgggccggctgcatccaccgctaccctgtcccttggaatctttagccatggagatcttcgttcgccacgggtggagatttggcaatatattgttgagctcttgatgaagaacttctgtttcaattcgcttggtgtgaactttgtttgcttgagactgtcaagtctagtgaaactctggaataatcaaacattcttggatgtagagaccggggtattttattttcttaatgatagagctccctttatat

SEQ ID NO: 25729 - protein, 109 aa, Panicum virgatum
  misc_feature: Ceres CLONE 1864748-R
  misc_feature (1)..(84): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MFQHFCIHPGGSRVLNEVQRGLGLSDGDMEASRMTLHRFGNMSGSSLLYELAYIEAKGRMKKGDRVCMIGFSPGIDCSSVVCECIRPAARPDDGPWAGCIHRYPVPWNL

SEQ ID NO: 25730 - DNA, 649 bp, Panicum virgatum
  misc_feature: Ceres CLONE 1864749-R
  misc_feature: Encodes the peptide sequence at SEQ ID NO. 25731
cttgcaggggcacaacaagaatattcaatcgctttgttgggattctgctggtgactatctggcttctgtcagtgaagactctgtcagaatatggtcattcacttctggacatgatggtgaatttgtgcatgagttgaattgcagcgggaacaaattccactcatgtgttttccacccaacttatccatctttgcttgtaattggttgttacgagtctttggaactttgggacataagggagaagaacaccatgaccttcaacaatgcacatgagggtatgattgcagccctagcagcatccagcgcgacagggaaggttgcctcagtaagccatgatagatttgttaagctctgggaatgatttgtgtaatagcgaccggtgttgcctgggtcgacttctacattctggttcttagatgatagcgaaacaagattggttttctgcctcagatgaccacatgacgaaaagggtagctaacacgatctcttgagccacttgggcccaagaactaacagtgttttgttttgtggttgtcgctgtatgctgttcactatgcttctgaaacctgtagttgtaaacttgttccttatagaaacgttgttgaagacttcaaatttgtacccaggtcaagttccaaacagttatttt

SEQ ID NO: 25731 - protein, 119 aa, Panicum virgatum
  misc_feature: Ceres CLONE 1864749-R
  misc_feature: SWISSPROT Homolog: EC 2.3.1.48 Histone acetyltransferase
LQGHNKNIQSLCWDSAGDYLASVSEDSVRIWSFTSGHDGEFVHELNCSGNKFHSCVFHPTYPSLLVIGCYESLELWDIREKNTMTFNNAHEGMIAALAASSATGKVASVSHDRFVKLWE

SEQ ID NO: 25732 - DNA, 1264 bp, Panicum virgatum
  misc_feature: Ceres CLONE 1864749
ggaaaggaaacacaaacacctggtttctgtgcactcaaaagcaagcgcacaacacttttgtgactcccagattcattttactgccttctggatgttcttgtaattgatgtttttctttggtgaaaacatgcatgtctggtggttgtatttgcgttttttttttactccgtagctgctcctgtccttcgatctgttttctccagattccgtaaggttcgggcaaagcagagtcgatcaaatggagattttgttccgtggcttgttggtcgctgttttctagtctaccttcgtctttcgtttggtgatcgaatgtttttggtggcaaatgttggcaaactttgtcgaaagacgagaatcaaatcaaaagctagccactctatctactgcttggctggcctcctgaaatctcgctcgtatctttctttacacctcagatcacccaagaaccacacgattttgtctacaacaagccttggaaatttggaacgcaacatctgatgattgaaatttgcaacaaccattttcatatttgttttgacattttgggaaaaaaatgctacaacttttttgaacacatttgttgctaatcctctctgcgctctgctatcaattgcagcaccaaggagagctcgttggtgaacatggtcctgacggcggtgcacgtggcgttcatcctgttcatcatcgtcatcgggttcgtgcacggcgacgcgcggaacctgacgcaccccgccgacccgtcccagaaccccggcggcttcttcccgcacggcgccatgggcgtgttcaacggcgcggccatggtgtacctgagctacatcgggtacgacgccgtgtccaccatggcggaggaggtggagcggcccgcacgcgacatccccatcggcgtctcgggctccgtcgtcgtcgtcaccgtgctctactgcctcatggccgcctccatgtccatgctccttccctacgacgcgattgacccggaggcgccgttctcgggagcgttcagggggcggaaggggatggcgtgggtgtccaacgtgatcggcgccggcgctagcctcggcatcctgacgtcgctgatggtggcgatgctcgggcaggcgcggtacctctgcgtcatcggccgctccggcgtcatgccggcctggctcgccagggtgaacccccgcaccgccacccccgtcaacgcctccgccttcctcggcctcttcacggcggccctggcgctgttcacggagctggacatcctgctcaacctcgtctgcat

SEQ ID NO: 25733 - DNA, 692 bp, Panicum virgatum
  misc_feature: Ceres CLONE 1864767
  misc_feature: Encodes the peptide sequence at SEQ ID NO. 25734
ttcatacctgatcctaatcaggagctcctagatgccaagccattaaggtctttagctcccatgttccctgcacccatgggagtcaatgttaatcagtcaagtacaccaccattggtctgtgtcactccggttggccaattcccaacagggtttggtgcggggaaccttcctgcctttggatcgtttgctactttcagtgccactgcaaatggagtttcttatgccggcaccagtgccaacggccccattgatgctacccctatctctgcatacaagacgagatcaaacatgtcagttgatggtgatgatgatccttacttgggtaaccaaactttgtcatctgaacggaagaggagaggccgtcctcctggttctggtgcacatggctcaaatggtaagttcaagaaacctaagcccacgtacaagaatttcgttgctggcaaggagcttgcctttctgccatctacatccgatcccagggagattgtggaagcagttcacatgacctttgaggcactccgccgaagacatctgcagatggatgaaacacaggatgctagcagacgcgcagacctgaaggctggcgccatcatgatggccagtaacatcagggccaattctggtaagagggtaggaactgtccctggagttgagataggtgatattttctatttcaagatggagctgtgtat

SEQ ID NO: 25734 - protein, 230 aa, Panicum virgatum
  misc_feature: Ceres CLONE 1864767
  misc_feature: SWISSPROT Homolog: EC 2.1.1.43 Histone-lysine N-methyltransferase
FIPDPNQELLDAKPLRSLAPMFPAPMGVNVNQSSTPPLVCVTPVGQFPTGFGAGNLPAFGSFATFSATANGVSYAGTSANGPIDATPISAYKTRSNMSVDGDDDPYLGNQTLSSERKRRGRPPGSGAHGSNGKFKKPKPTYKNFVAGKELAFLPSTSDPREIVEAVHMTFEALRRRHLQMDETQDASRRADLKAGAIMMASNIRANSGKRVGTVPGVEIGDIFYFKMELC

SEQ ID NO: 25735 - DNA, 1116 bp, Panicum virgatum
  misc_feature: Ceres CLONE 1864782
  misc_feature: Encodes the peptide sequence at SEQ ID NO. 25736
agtctcctcctccttcctcccctaccctctccccccccctgtatcgccgctccctttctcccccctgcctgcggccctgtccctgaatccgcggcggctcctgaggcgggcggcgcagcggcgggctcccgaggcgccgcctggtgagcggcgaggcgccggatctgcggcggcgatggaggagtgatttgggcgggaggtaggcgagaggtggggtgctggttttcccccgcgcaggagatggcggaggcgcggggaggggacttccccgtggggatgaaggtgctggtggtggacgacgacccgacttgcctcgtcgtgctcaagaggatgctcctcgrgtgccgatacgacgtaacaacgtgtcctcaggctacaagagcactaactatgttgcgagagaataggcgcggttttgatgttataataagtgatgtccacatgccagatatggatggattcaggttacttgaacttgtrggccttgagatggaccttccagttaccctgatgtctgctgattcaagaacggatattgtaatgaagggaataaagcatggagcgtgcgactatttgataaaacccgtcagaatggaggaattgaaaaacatctggcaacatgttgttaggaaaaaattcagtgaaaacaaggatcatgagcattcaggtagcctagatgacactgatcgtaacagaccaactaataatgataatgaatatgcttcctctgcgaatgatggaggcgatggtagttggaaatctcagaaaaagaaaagagagaaagaagaggatgaagctgatcttgaaaatggcgatccttcttctacatcaaagaaaccaagagttgtttggtcagttgagcttcatcaacaatttgtaaatgcagtcaatcaccttggaatagacaaagctgttccgaagaaaattttggagttgatgaatgtccctggcttaactagggaaaatgttgccagccatttgcagaaattcagactctatctgaagagaatagctcagcatcatgcaggaatacctcatccatttgttgcgcctgccttctagtgctaaaagttgccccactaagaggattggaatttcaagctttggctgcttccg

SEQ ID NO: 25736 - protein, 273 aa, Panicum virgatum
  misc_feature: Ceres CLONE 1864782
  misc_feature (13)..(126): Pfam Name: Response_reg Pfam Description: Response regulator receiver domain
  misc_feature (201)..(251): Pfam Name: Myb_DNA-binding Pfam Description: Myb-like DNA-binding domain
  misc_feature: SWISSPROT Homolog: EC 3.1.4.17 3',5'-cyclic-nucleotide phosphodiesterase
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 934 in the 10/666,642 US patent application
  misc_feature: Useful for making plants with altered lignin content
  misc_feature: The sequence is a functional homolog of SEQ ID NO 936 in the 10/666,642 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 580 in the 10/666,642 US patent application
  misc_feature: The sequence is a functional homolog of SEQ ID NO 935 in the 10/666,642 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature (34)..(34): Xaa is any aa, unknown, or other
MAEARGGDFPVGMKVLVVDDDPTCLVVLKRMLLXCRYDVTTCPQATRALTMLRENRRGFDVIISDVHMPDMDGFRLLELVGLEMDLPVTLMSADSRTDIVMKGIKHGACDYLIKPVRMEELKNIWQHVVRKKFSENKDHEHSGSLDDTDRNRPTNNDNEYASSANDGGDGSWKSQKKKREKEEDEADLENGDPSSTSKKPRVVWSVELHQQFVNAVNHLGIDKAVPKKILELMNVPGLTRENVASHLQKFRLYLKRIAQHHAGIPHPFVAPAF

SEQ ID NO: 25737 - DNA, 1671 bp, Panicum virgatum
  misc_feature: Ceres CLONE 1864789
  misc_feature: Encodes the peptide sequence at SEQ ID NO. 25738
cttcccttcccgttccgttccgtttccctcccctctccccaaccaaagcggagcaggcggcggcggagggggagcaggcggacgccgcggcggcgattcggccatggagctgtcgatgagcggcagctcgctgcggactttcggccggtgcgtcaccttcctcgcgcgcgtcgcatccgagctcgtcctccaggcgctccccgccaagctggagctgcacacgctcaacagctcgcggtcggcgtacggttcggtctccctcgcgcgcgacttcttcgacagctaccacctcgacgccgcggcttcggcgccgtcgtccacgccgctgcagtgcagcgtcctcctcaagtccctgctcgccgtcctccgcacgccgcacgccgcgctcgaccgcctcgctatctccctcccagaacccgacgcgcccaagctccagttcaccctccactgcctcaacggtgtcaggaagacgtactggatcgtatgcagcgcggaacccgaggtgcagtcgctggcgctcgaccgggggcggttcccgagccgcctcaccatccggccccgggagctcgcgcgcctgctctccaacttccagtcctcgctgcaggagctcacaatcatcgccacagatcctgctgcagggctgcctgatgccggcggggacgttgggggcaaggccgttgagctccggagctacaatgaccctgcaaaagatgactgtgacactagactgcacacgcagctgtggatcgaccctgttgaggagttcgtggagtatgtccatgctggtgatccggtggatgtcacctttggggtaaaagaactaaaggcgtttttgacattttgtgaagggtgtgaggttgacgttcttctgttttttgagaagactggcgaacctgttcttttggttccgagatttggattggatgatggatcaacctctgattttgaagccacacttgttctggccactatgactgtatcgcaactagttgacagcagtgatgcccaacagccagctacatcggcacaacacaatggagaaccaaggcctgccactacaccgtcagtctcaaaccatactaaaatatggtcagagctttcaggcaatactcccaaaagctttgaagctaacagagaaacacatgccccaaagaagagcaatgcaggcactagtatgctgaacgacactgttttgcccaatgctacaaatgctccacggaagccaccagctgcagataatgcaaacaatataatgcagcctatgcagatggatcacttggaagagcatcctgaagtcctcagtgctatcccaaggtcgcagcatcacccgagcaactgggtaggtgctgatgataacgacgatgacaatgaagatgaggagcttctagtccaaacaacacctcactacatggactgaggaaaattgctgattctgaaatatgcagactacatggacttaggataactgctgattctgaaacatgtagggacatttcagcctagagtgtagtgggctaagggttcttcatagttcctgtagggcaggagtttacaactttgactaactttccccagccatgtaaaaaagtagcagctctctgtatccagtgtgagtgtgtgacttccatttctttccataatgtaggaaaacatcgaaggcgatttgttctg

SEQ ID NO: 25738 - protein, 437 aa, Panicum virgatum
  misc_feature: Ceres CLONE 1864789
  misc_feature (13)..(290): Pfam Name: Rad9 Pfam Description: Rad9
  misc_feature: SWISSPROT Homolog: EC 3.1.11.2 Exodeoxyribonuclease III
MELSMSGSSLRTFGRCVTFLARVASELVLQALPAKLELHTLNSSRSAYGSVSLARDFFDSYHLDAAASAPSSTPLQCSVLLKSLLAVLRTPHAALDRLAISLPEPDAPKLQFTLHCLNGVRKTYWIVCSAEPEVQSLALDRGRFPSRLTIRPRELARLLSNFQSSLQELTIIATDPAAGLPDAGGDVGGKAVELRSYNDPAKDDCDTRLHTQLWIDPVEEFVEYVHAGDPVDVTFGVKELKAFLTFCEGCEVDVLLFFEKTGEPVLLVPRFGLDDGSTSDFEATLVLATMTVSQLVDSSDAQQPATSAQHNGEPRPATTPSVSNHTKIWSELSGNTPKSFEANRETHAPKKSNAGTSMLNDTVLPNATNAPRKPPAADNANNIMQPMQMDHLEEHPEVLSAIPRSQHHPSNWVGADDNDDDNEDEELLVQTTPHYMD

SEQ ID NO: 25739 - DNA, 689 bp, Panicum virgatum
  misc_feature: Ceres CLONE 1864790
  misc_feature: Encodes the peptide sequence at SEQ ID NO. 25740
ctcgctagctccgtccaccgggcaacccacctcctctgtagcctcttctcctccgcccagttccgttggctcctagctgcaggagcggcaatggcggcttcctggagggccatggcgctggcgatggcggccgtgggctgggttcttggcggtggtttcgtgtgggggttcccggccgaggatttggtgaccaggctgcccgggcagccgccggtgacgttcaggcagttcgccgggtacgtggacgtcgacgtcaaggccggcaggagcctcttctactacttcgccgaggcgcaggaggacgccgccgccaagccgctcacgctatggctcaatggaggtcctggctgttcttcgattggaggtggggcattcacggaactgggtccattttatccgagaggagatggcaggggtctcagattgaacaagaagtcatggaacaaagcgtccaatcttctatttgtcgaatcaccagctggagttggatggtcttactcaaatacttcatcagactacaacaccggcgatgtgcgcactgctgatgacatgtacacatttttgcttggatggtacgagaaattcccagagtacagatcgagagccctgtttcttactggggagagctatgcagcagggcattacataccacaacttaccgatgtactccctacccataatgagaaatc

SEQ ID NO: 25740 - protein, 199 aa, Panicum virgatum
  misc_feature: Ceres CLONE 1864790
  misc_feature (37)..(199): Pfam Name: Peptidase_S10 Pfam Description: Serine carboxypeptidase
  misc_feature: SWISSPROT Homolog: EC 3.4.16.6 Carboxypeptidase D
MAASWRAMALAMAAVGWVLGGGFVWGFPAEDLVTRLPGQPPVTFRQFAGYVDVDVKAGRSLFYYFAEAQEDAAAKPLTLWLNGGPGCSSIGGGAFTELGPFYPRGDGRGLRLNKKSWNKASNLLFVESPAGVGWSYSNTSSDYNTGDVRTADDMYTFLLGWYEKFPEYRSRALFLTGESYAAGHYIPQLTDVLPTHNEK

SEQ ID NO: 25741 - DNA, 683 bp, Panicum virgatum
  misc_feature: Ceres CLONE 1864795
  misc_feature: Encodes the peptide sequence at SEQ ID NO. 25742
aaccaagaagcacgcgcagccacaccaagtcagggagaaggccatggccggcgtgaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacgtgaacctcttgtattaaaaaaaaaagggagtcctcccttctcccgcgac

SEQ ID NO: 25742 - protein, 150 aa, Panicum virgatum; identical to SEQ ID NO: 12907
  misc_feature: Ceres CLONE 1864795
  misc_feature (9)..(150): Pfam Name: PsaN Pfam Description: Photosystem I reaction centre subunit N (PSAN or PSI-N)

SEQ ID NO: 25743 - DNA, 1976 bp, Panicum virgatum
  misc_feature: Ceres CLONE 1864807
  misc_feature: Encodes the peptide sequence at SEQ ID NO. 25744
aaggccatcttgtctgcatcgccctccttccttacacttacaccgggatcatctcagcttgcccattggccatcttcgtcgtccatggacaggctcctcgccggcctgcttggcttcctattggtcagtccctcgctcactaccacgcagctcgctcgtcttgtgtgcttcttctcccataatttcgttccttcagacttcagctgctagtgatccttaattccctatggcctatgctgttcatttggcgaaacatttatgtgaatctggaaaacattcagaagaggttcaagcgttcagctagcttacaaaccatgctaagaagttctatgcttttagtaggagcttttgctgctgttgtatcgatgcttcttcagacgatgtttacattctcatcaccatagtaatgatataataataaggttgaagttctcgatctgacgcatctctttcaaaaaaaaaaggagaaaattctctgatgcatagagatactgttgtggtttgctgcatgcagcttgcgtcagtaggaagccatgcagctcgagctccggatcagtactggaaatctgctctccccaacacgcccatgccaagctccctctcccaactcctaaacaccccagccggcggcacgaccgtgaacgtcggccgcggcggtgtccatgtcgacgccgggcatggcaagcccgggggcacgaccgtcgatgtaggcaagggcggcgtcggcgtcaacgtcaaccctggcagcggcaagcccggcggcaccacggtcggtgtcgggaaaggtggagtcggcgttaacgtcaagcctggttatggcaagcccggcggcaccacggtcggcgtcggcaagggcggagtcggcgttaacgtcaagcctggttatggcaagcccggcggcaccaccgtcggcgtcggcaagggcggcgttggcgtcaacgtcaaaccagggagcgggaagcccggcggcaccacggtggccgtcgggaagggcggggttggcgttaacgtgaagccccgcggcaagtccgtccacgtcgacgtcgctcctttccattacaactacgccgcaacggagacgcagctgcacgacgaccccagcgtcgcactcttcttccaggagaaggagctccaccccgggaagaagatgaccgtccagttcaccaacaccgtgcccggcaccaagttcctcccccggagcgaggccgatgccatcccgttctcctcggagaaggtgcccgagatcctcagccgcttctcggtgagcccggactccgtcgaggcggcggagatggcgcagacgctgcgcgactgcgaggcgcccgcggccaagggcgagaagaaggcctgcgccacgtcgctggagtccatggtcgacttcgccacggccggcctcgggaccagccacgtgagggccgtctcgaccgtcgtggcgaggccggactcgccgaagcaggagtacaccatcaccggagtgaagcgcgtggccggcgccgacgacggccggctcgtcgcctgccacgcggagccgtacgcgtacgccgtgttcgcgtgccaccagacgcggcagacgcgggcgtactcggtgtcgatgctcggcagagacagcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttggatggccgccgtgcctgttcttgctgcgcaggtttcatctacgttctagtagccggcctctgagcgaactgtcatcttgtatcatgtgtttgcttatgttttcagtacttgatacttgtatgaatggtgttgccagccagtatcgtgtatcgactatcgatcacctgctaggttctgctgtatagttctaaataaacagacatctctc

SEQ ID NO: 25744 - protein, 427 aa, Panicum virgatum
  misc_feature: Ceres CLONE 1864807
  misc_feature (210)..(426): Pfam Name: BURP Pfam Description: BURP domain
MHRDTVVVCCMQLASVGSHAARAPDQYWKSALPNTPMPSSLSQLLNTPAGGTTVNVGRGGVHVDAGHGKPGGTTVDVGKGGVGVNVNPGSGKPGGTTVGVGKGGVGVNVKPGYGKPGGTTVGVGKGGVGVNVKPGYGKPGGTTVGVGKGGVGVNVKPGSGKPGGTTVAVGKGGVGVNVKPRGKSVHVDVAPFHYNYAATETQLHDDPSVALFFQEKELHPGKKMTVQFTNTVPGTKFLPRSEADAIPFSSEKVPEILSRFSVSPDSVEAAEMAQTLRDCEAPAAKGEKKACATSLESMVDFATAGLGTSHVRAVSTVVARPDSPKQEYTITGVKRVAGADDGRLVACHAEPYAYAVFACHQTRQTRAYSVSMLGRDSTAVDAVAVCHADTSGWNPKHVAFQVLNVKPGTVPVCHFLPQDHVVWTRSG

SEQ ID NO: 25745 - DNA, 1428 bp, Panicum virgatum
  misc_feature: Ceres CLONE 1864812
  misc_feature: Encodes the peptide sequence at SEQ ID NO. 25746
gcttcaaacaccagacccgcaaaccgggagccccccgtcactccctccccccctcttcctccgtcagccccccagcccggcactcagccatgggcaaccgcgggtcgcgctaccactgccacgcagccgaccagcagcagccggcggcgccgcccaagccccagccccatgcgccgccgccgccgccgccgcagcagcagcagcagccgcaggcgaggcccaagccggcggccgcgcaggcggcggcggcggcggacgcgggggcggtggggcgcgtgctggggcggccgatggaggacgtgcgcgcggcctacaccttcgggcgcgagctcggccggggccagttcggggtcacctacctcgtcacgcaccgggagaccggccagcgcttcgcctgcaagtccatcgccacgcggaagctcgtccaccgcgacgacatcgaggacgtgcgccgggaggtgcagatcatgcaccacctcacgggccaccgcaacatcgtcgagctccggggcgcctacgaggaccgccactcggtcaacctcgtcatggagctctgcgagggaggggagctcttcgaccgcatcatcgccaggggacactacaccgagcgcgccgccgccgcgctctgccgcgagatagtcgccgtcgtccacagctgccactccatgggggtcttccaccgggatctcaagcccgagaacttcctcttcctcaacgacaaggatgactcgccgctcaaggccacggacttcggcctctccgtcttcttcaagcccggggagactttcaaggatcttgtgggaagcgcatattatgttgctcctgaggtactcaaacggcactatggggcagaggctgatatttggagtgctggagttattctttacatccttctttccggtgttcctcccttttgggcagataatgaggatggcatatttgatgccgtcttgcgtggtcacattgatttctcttctgatccttggccttcaatatctaatggtgccaaggatttggttaagaagatgctgcagcaagacccaaaagagcgcctgactgctgctgaaattttgaatcatccatggattagagaggatggagaggccccagataagccacttgacattacagtcatcagtagaatgaaacagttcagggcaatgaacaagctcaagaaagttgctttgaaggttgttgctgagaacttatcagatgaagagattatgggccttaaagaaatgtttagatctcttgatacagataacagtgggacaattactcttgaagagctaagatctggtttaccaaaacttggcactaaaatttctgaatcagaaatcagacagttgatggaggcggctgatgttgatggaaatggtaccattgattatgcggagttcatatcagccactatgcacttgaatagat

SEQ ID NO: 25746 - protein, 446 aa, Panicum virgatum
  misc_feature: Ceres CLONE 1864812
  misc_feature (75)..(333): Pfam Name: Pkinase Pfam Description: Protein kinase domain
  misc_feature (380)..(408): Pfam Name: efhand Pfam Description: EF hand
  misc_feature (416)..(444): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNRGSRYHCHAADQQQPAAPPKPQPHAPPPPPPQQQQQPQARPKPAAAQAAAAADAGAVGRVLGRPMEDVRAAYTFGRELGRGQFGVTYLVTHRETGQRFACKSIATRKLVHRDDIEDVRREVQIMHHLTGHRNIVELRGAYEDRHSVNLVMELCEGGELFDRIIARGHYTERAAAALCREIVAVVHSCHSMGVFHRDLKPENFLFLNDKDDSPLKATDFGLSVFFKPGETFKDLVGSAYYVAPEVLKRHYGAEADIWSAGVILYILLSGVPPFWADNEDGIFDAVLRGHIDFSSDPWPSISNGAKDLVKKMLQQDPKERLTAAEILNHPWIREDGEAPDKPLDITVISRMKQFRAMNKLKKVALKVVAENLSDEEIMGLKEMFRSLDTDNSGTITLEELRSGLPKLGTKISESEIRQLMEAADVDGNGTIDYAEFISATMHLNR

SEQ ID NO: 25747 - DNA, 692 bp, Panicum virgatum
  misc_feature: Ceres CLONE 1864812-R
  misc_feature: Encodes the peptide sequence at SEQ ID NO. 25748
agttggaagaagctcttgaagaagtatgatatgggagatgataaaacaataaaagagatcattgctgaagtagatacagatcacgatggaagaattaattaccaggagtttgttgccatgatgaggaacaacagccctgagattgttccgaaccggaggcgcatgttctaactgccgtgtacaatttgagtggacacttttggggatattttgcccttagacatcttctcctggagccattttcttttggggaaagccattaagaaaactacatttgagatccatatctctgcagccaggaccagtttgtaccagaatgggacgcatgatattgggactcaaacctagatgctatggagtctgggtgcagtgtttcaactcactgtacgcataatgccttcgagattgttttgcggctttatctgtatctttccccaccttcaatttagtgtgccccaatgaggtgatcagttaaattgcacaattgagagtgttgtgacttgtgatccatgtgctgttatcctcgtagcctttatattagaactggcattgtaagagggtgtttagcgatcttatctggcaatgttgtatcattgttaataaacacagcacacaaatttggtcctggattggccttaggttaagtgctgatccatctgcgttcttcagtaaacaaggttgcaggttcttag

SEQ ID NO: 25748 - protein, 56 aa, Panicum virgatum
  misc_feature: Ceres CLONE 1864812-R
  misc_feature (16)..(44): Pfam Name: efhand Pfam Description: EF hand
  misc_feature: SWISSPROT Homolog: EC 2.7.11.1 Non-specific serine/threonine protein kinase
SWKKLLKKYDMGDDKTIKEIIAEVDTDHDGRINYQEFVAMMRNNSPEIVPNRRRMF

SEQ ID NO: 25749 - DNA, 597 bp, Panicum virgatum
  misc_feature: Ceres CLONE 1864858
  misc_feature: Encodes the peptide sequence at SEQ ID NO. 25750
aagggaaaacaaccaggcattccacagccagagaagcgagggcaaatcaggcgaggcgacggcgatggcgatggcggcgctgcgacgcgaggggaggctcctcctcctctcccccaccgtccccaacccctccccggcggccgcggccgcgcggtcctctgtcatatcttcaccggagactactccacttggcgtgcggtctatttcacctccagttgttacgaaccggatgaagagtgtcacgaacattcccaagatccctcaggctatgaacatggttgcaccacctcagcttcgagctgttcacactaggactgaaaattcacctggcctgtgggagccgtttactgcccttcttggggatgctccaaccgtcgacgtcaagaagaatgtcatcgcggccattacctctgacaagggactctgtggtggtattaattcaacatcagtgaaagttagcacggctcttcacaaattgacatctggtccagataagtcactcgcggctcgccacagccgaactccccccccactcgcccgcctcctctgcaaccaaattcgcacgccccgcctcggcaaattctagctccttcctcg

SEQ ID NO: 25750 - protein, 173 aa, Panicum virgatum
  misc_feature: Ceres CLONE 1864858
  misc_feature (47)..(170): Pfam Name: ATP-synt Pfam Description: ATP synthase
  misc_feature: SWISSPROT Homolog: EC 3.6.3.14 H(+)-transporting two-sector ATPase
MAMAALRREGRLLLLSPTVPNPSPAAAAARSSVISSPETTPLGVRSISPPVVTNRMKSVTNIPKIPQAMNMVAPPQLRAVHTRTENSPGLWEPFTALLGDAPTVDVKKNVIAAITSDKGLCGGINSTSVKVSTALHKLTSGPDKSLAARHSRTPPPLARLLCNQIRTPRLGKF

SEQ ID NO: 25751 - DNA, 668 bp, Panicum virgatum
  misc_feature: Ceres CLONE 1864871
  misc_feature: Encodes the peptide sequence at SEQ ID NO. 25752
atcgccgccccgcattgcttcccacctcaaaaccctaaccctaaacccctcatcgcgcgagctctctcccatggagaaccccaggccgcagcccccggcacccacccctcccatggctccgctccccgttcctgcccacccgcccatcgcccccatccccgtccctccgcctcgcgcgcccatccccgccgccgcctccgtggcctccacctccgcctccgccgcggggggtgggagcggcgacgaggtcgagtatgaggtctccgacgaccaccgcgccgcccgggaacgccacgagcgcgcggtgcaggagctcctccagcggcgccgcgcgtacgccatggccgtgcccaccaacgactccgccgtgcgggcccgcctccgccgcctcggtgagcccatcacgctcttcggcgagcgcgagatggagcgccgcgaccgcctgcgggccctcatggtgcgactcgaggccgatggccaggtcgaccgcctcctccgcgcacaggaggacgaccaggccgcgcgcgtcggcgaggaggaagaggaggagcagatccagtaccccttcttcaccgagggcacgcaggacctgctcaatgcgcgcgtcgacattgcactgtactcgctgccccgtgccaaagccaggatcgagagggccaagcgccgcc

SEQ ID NO: 25752 - protein, 199 aa, Panicum virgatum
  misc_feature: Ceres CLONE 1864871
  misc_feature (100)..(129): Pfam Name: PRP4 Pfam Description: pre-mRNA processing factor 4 (PRP4) like
MENPRPQPPAPTPPMAPLPVPAHPPIAPIPVPPPRAPIPAAASVASTSASAAGGGSGDEVEYEVSDDHRAARERHERAVQELLQRRRAYAMAVPTNDSAVRARLRRLGEPITLFGEREMERRDRLRALMVRLEADGQVDRLLRAQEDDQAARVGEEEEEEQIQYPFFTEGTQDLLNARVDIALYSLPRAKARIERAKRR

SEQ ID NO: 25753 - DNA, 324 bp, Panicum virgatum
  misc_feature: Ceres CLONE 1864871-R
aaggttcaattcaaaaagtacatggtggaagagatttcgttaaaatgactctagagctgcaattgttcattgatattttggagaaggtggacaaaaagcgccacgacgtgtccgctaccctcgatctgcagataggcaaccttcgtgacaaactggatccatcccagtagcagctgcctggggctaagaagaagaaatgaagggcaggtagcatgtttctgagtggacaaatctacctagatatggggtatctatctctgtatttgtaataacctgtggttagttttggactatggttagttgtaatatcctgtggttagttct

SEQ ID NO: 25754 - DNA, 627 bp, Panicum virgatum
  misc_feature: Ceres CLONE 1864924
  misc_feature: Encodes the peptide sequence at SEQ ID NO. 25755
acctcgctctctcgcttgcgctcgcactagcaagcttgctgctccttccgcgatcgccagcttaatttggtctcgtcttcttggcagtggcctgtctcgagaaccactcactgcacgacgcttctgacgagctagtagcttagcactctcatttatttgatttccatggcgagccaccaccggtccgccgccatgggcagggcggagctgtcccggacggtgaggcaggccacgctgaaccacgcgcgactgctgtaccaccgcctgccgcacatcctcgccgtcacgctcctcgtcgccgcggcccagctcgtgccgtcctcctcctcgtcgtcgctcgcgggggcggcggcgctccgcgactgggcgcgcgcccacgcggggctcgccgccgcggcgtgcgcgggggtggccgccgcggcgtgcgcgtacgccgcgtcccgcccccgccccgtctacctcgtcgacctgtccaggtacaagccgggccccgcgcacgaggccacccgcgcccagtccatccgccacttcgcggtggccgggcggttcacggacgagagcatcgcgttccagacccggatgctagaacgcgccggggtgggcgaggccacgcacttcccgggttct

SEQ ID NO: 25755 - protein, 144 aa, Panicum virgatum
  misc_feature: Ceres CLONE 1864924
  misc_feature: SWISSPROT Homolog: EC 2.3.1.119 Icosanoyl-CoA synthase
MGRAELSRTVRQATLNHARLLYHRLPHILAVTLLVAAAQLVPSSSSSSLAGAAALRDWARAHAGLAAAACAGVAAAACAYAASRPRPVYLVDLSRYKPGPAHEATRAQSIRHFAVAGRFTDESIAFQTRMLERAGVGEATHFPG

SEQ ID NO: 25756 - DNA, 558 bp, Panicum virgatum
  misc_feature: Ceres CLONE 1864924-R
  misc_feature: Encodes the peptide sequence at SEQ ID NO. 25757
ccgacgtcaagccctacgtgccggacttcaagctggcgctggagcacttctgcatccacgcgggcgggcgcggcgtgctggacgagctggagcgcagcctcggcctgagcgcctggcacatggagccgtcgcggatgacgctccaccgcttcggcaacacctccagcagctcgctctggtacgagctcgcctactgcgaggccaagggccggatcaggaagggcgaccgcgtctggcagatcgccttcgggtctggattcaagtgcaacagcgccgtctggaaggcgctcaggacggtcgacgacgccggggagaccaacccatgggccgccgaggtcgaccgcctcccggtgcacgtgcccaaggtgacgcccatcgtgctcgacgacgacgaccaggcgccccgcaacaaggaagacgacggaggacacggtagtagtgcctagctgctagtagccactaagtctgctattcgctagtactccctccttccccgtttataaggcatggtggaacatgacacggtcttctaaataatactttgaccatttatttatc

SEQ ID NO: 25757 - protein, 147 aa, Panicum virgatum
  misc_feature: Ceres CLONE 1864924-R
  misc_feature (13)..(95): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
DVKPYVPDFKLALEHFCIHAGGRGVLDELERSLGLSAWHMEPSRMTLHRFGNTSSSSLWYELAYCEAKGRIRKGDRVWQIAFGSGFKCNSAVWKALRTVDDAGETNPWAAEVDRLPVHVPKVTPIVLDDDDQAPRNKEDDGGHGSSA

SEQ ID NO: 25758 - DNA, 554 bp, Panicum virgatum
  misc_feature: Ceres CLONE 1864935
  misc_feature: Encodes the peptide sequence at SEQ ID NO. 25759
atcgcctccctcctgtcctgtgctcaatgggcacctaacgcgaggggcaacgcatccagctccaccaattcaaatcgaatccagcacagtgccagaggcagctactccccacctaccacaccacctggatgcagagcgatggacctcaccctctgggagaaggcccttatgggcctgttcgcggaggcggtgctggacatcgccgtggcgaaactgacagggaatcggctccggctgccccccggtcccgcaggctcccccagggtgggcaactggctgcatgtctgctacaacctgaaccacctcaacctgatggagctggagaagcggttcggcgacttcttcctcctacagatgagcgtgcgcgacctggtgttggtgaccacgcccgagctcgactaggaggtgctgcacacgccgggcgtggagtacggataccacacccgcgacgacgtcttctacatcttcaggggcaaggtccaagacgtggtgttcttcgtctacggtcaccactggcacaagatgcgagagcatcatgaccctccccttcttca

SEQ ID NO: 25759 - protein, 87 aa, Panicum virgatum
  misc_feature: Ceres CLONE 1864935
  misc_feature: SWISSPROT Homolog: EC 1.14.13.11 Trans-cinnamate 4-monooxygenase
  misc_feature: Useful for making plants with altered carbohydrate content
  misc_feature: Useful for making plants with altered lignin content
  misc_feature: Useful for making plants with modulated biomass
  misc_feature: Useful for biocontainment applications
  misc_feature: Useful for making plants with altered cell wall content and/or composition
  misc_feature: Useful for making plants with modulated flowering time
  misc_feature: The sequence is a functional homolog of SEQ ID NO 8 in US patent 7148406
MDLTLWEKALMGLFAEAVLDIAVAKLTGNRLRLPPGPAGSPRVGNWLHVCYNLNHLNLMELEKRFGDFFLLQMSVRDLVLVTTPELD

SEQ ID NO: 25760 - DNA, 2515 bp, Panicum virgatum
  misc_feature: Ceres CLONE 1864936
  misc_feature: Encodes the peptide sequence at SEQ ID NO. 25761
agcagcagcggcgtccaccgtaccgagctgttgcgagccgtaattgccggcccgaccgtaaccaaggctcgctcaccgccgctgccgcgcacagcattcaatctcccctcccccctgccgccgcctcacctaccaccagccaaccaacccccggcgccgagctgacgatggactcggcggcgtcgtcgggcgcgatggagctggtggcggcgctgctgcgtgggcgcgtcccgccggagctgggcgggggcggcgccgagggccgcgcgctcgtcgccacgctcgcggccgccgtgctcggcgccgcgctgctcgtgctctggcggcgggccgccgccggcaagaagcggaagcaggaggcggccgccgcggcggaggccgtgcacttcaaggccaggagcgccaaggtcgccgacgaggaggcggaggcggcggccgacaggaagaaggtcaccgtcttcttcggcacgcagaccggcaccgccgaggggttcgccaaggcgcttgctgaggaggcaaaggcaagatatgacaaggcaatctttaaagttgtggacatggatgattatgcagcagaggatgaggaatttgaggaaaatttgaagaaagagaagatagcgttgttcttcgtggcaacgtacggagatggtgagccaactgacaatgccgctaggttctacaaatggttcacggagggaaatgagaggggagtctggttgagtgatcttgagtatgctgtgtttggtctgggcaatcgacagtacgagcatttcaacaagatagccgtggtagttgacaacctcctaactgaacaaggtggaaaatgccttgttccagttggtctcggagatgatgatcaatgcattgaggatgacttcaatgcatggaaagaagctctctggccagagttggatcgtttacttcgtgatgaaaatgatgtctccacaggcactacttacacagctgctattcctgaataccgggttgaattcatcaagcctgagcaagcagttcatttggagaaaaacttcagccttgcaaatggtcatgccgtccatgatgctcagcatccttgccgggctaatgtggctgtgcggcgagagctccacactcctgcttctgatcgttcatgcactcacttggaatttgacattgctggatctggtcttatgtatgaaactggtgaccatgttggtgtatacactgagaactgccctgaagttgtggaggaggcagagaggttgttaggctactcgccggagacatttttcaccatccatgcagataaagaggatggtactccactaagcggtgcttctcttccttctcctttcccctccccaatcattgtgaggaacgcacttgcccgatatgctgatcttctgaattcaccaaagaagagttctttggttgcattagctacctatgcttcagatcctgctgaggctgaccgtttaaaattcttggcctctcctgctgggaaggatgagtatgctcaatgggttgtggcaagtcaaaggagcctgttggaagtcatggcagagttcccttcggcaaagcctccactaggagtcttctttgcagctgttgcccctcgtcttcaaccgagatactattctatttcatcttcacctagtatggcaccaactaggattcatgtcacatgtgcgcttgtgaatgaaacaacacccgctggaagggtacataagggggtatgctcaacttggatcaagaatgctgttccatcagaagagagcaaggattgcagctgggctccgatatttgtgagacaatcaaacttcaaactgccagctgatccttcagttccaattatcatgattggccctgggactggtctagcacccttccgtggcttcttgcaggagaggctagctcaaaaagaatctggaaccgagcttggtcaatcggtgttcttctttggatgcagaaatagcaagatggacttcatctatgaggatgagctgaacaatttccttgagcaaggagcactatctgagctggttcttgccttctcacgtcagggtcctaccaaggaatatgtgcaacacaaaatggcgcagaaagcatctgaaatctgggacatgatttcccaaggtgcttatatctatgtatgcggtgacgccaaaggcatggccagagatgtacataaagttctccacaccatcgttcaggagcagggttcacttgacagttctaaagccgagagcttcgtgaagaatctccaaacagagggcagatatctgagggatgtgtggtaagggccggacatggaaaattcctgatattcattggggaacattcattcatgttatacaaatgtacaactattgccggaagagtattgacaacggaccaagatcagatgtttctagtggctctgcattttttttctttttctctcttatttcttttgtttttgagatattctcgagaggtctttgcacctgtgtagtacaaattctttatatgtataagatgaggacaattttgacac

SEQ ID NO: 25761 - protein, 703 aa, Panicum virgatum
  misc_feature: Ceres CLONE 1864936
  misc_feature (295)..(520): Pfam Name: FAD_binding_1 Pfam Description: FAD binding domain
  misc_feature (97)..(240): Pfam Name: Flavodoxin_1 Pfam Description: Flavodoxin
  misc_feature (556)..(668): Pfam Name: NAD_binding_1 Pfam Description: Oxidoreductase NAD-binding domain
  misc_feature: SWISSPROT Homolog: EC 1.6.2.4 NADPH--hemoprotein reductase
MDSAASSGAMELVAALLRGRVPPELGGGGAEGRALVATLAAAVLGAALLVLWRRAAAGKKRKQEAAAAAEAVHFKARSAKVADEEAEAAADRKKVTVFFGTQTGTAEGFAKALAEEAKARYDKAIFKVVDMDDYAAEDEEFEENLKKEKIALFFVATYGDGEPTDNAARFYKWFTEGNERGVWLSDLEYAVFGLGNRQYEHFNKIAVVVDNLLTEQGGKCLVPVGLGDDDQCIEDDFNAWKEALWPELDRLLRDENDVSTGTTYTAAIPEYRVEFIKPEQAVHLEKNFSLANGHAVHDAQHPCRANVAVRRELHTPASDRSCTHLEFDIAGSGLMYETGDHVGVYTENCPEVVEEAERLLGYSPETFFTIHADKEDGTPLSGASLPSPFPSPIIVRNALARYADLLNSPKKSSLVALATYASDPAEADRLKFLASPAGKDEYAQWVVASQRSLLEVMAEFPSAKPPLGVFFAAVAPRLQPRYYSISSSPSMAPTRIHVTCALVNETTPAGRVHKGVCSTWIKNAVPSEESKDCSWAPIFVRQSNFKLPADPSVPIIMIGPGTGLAPFRGFLQERLAQKESGTELGQSVFFFGCRNSKMDFIYEDELNNFLEQGALSELVLAFSRQGPTKEYVQHKMAQKASEIWDMISQGAYIYVCGDAKGMARDVHKVLHTIVQEQGSLDSSKAESFVKNLQTEGRYLRDVW

SEQ ID NO: 25762 - DNA, 418 bp, Panicum virgatum
  misc_feature: Ceres CLONE 1864941
  misc_feature: Encodes the peptide sequence at SEQ ID NO. 25763
agccgtctcctcccctcctcccattcccccactcccaatccaatccgcgagatctccctccctctgctatggcgctctccgtggaaaagacctcctgggggcgggagtgcaatgtaaaggagcctgtcacaagccgagtgcggccgtgtccagatcgagctgggtgagggcgagatgcccggactcatggtgtgtcgtgccgagttcggtccatcctcgcccttagccggcgcccggatatcgggttccctacccatgaccatccagaccggcgccctcatcgagaccctcaccgcgctcggcgccaaggtcctctggtgcacctgcttcatcttctccacgcaagaacacgccaccggcacaatagcgcggaattccgacgcggtgttcccgtgtaaagaggagacgataggaagat

SEQ ID NO: 25763 - protein, 81 aa, Panicum virgatum
  misc_feature: Ceres CLONE 1864941
  misc_feature (1)..(81): Pfam Name: AdoHcyase Pfam Description: S-adenosyl-L-homocysteine hydrolase
  misc_feature: SWISSPROT Homolog: EC 3.3.1.1 Adenosylhomocysteinase
MPGLMVCRAEFGPSSPLAGARISGSLPMTIQTGALIETLTALGAKVLWCTCFIFSTQEHATGTIARNSDAVFPCKEETIGR

SEQ ID NO: 25764 - DNA, 664 bp, Panicum virgatum
  misc_feature: Ceres CLONE 1864948
  misc_feature: Encodes the peptide sequence at SEQ ID NO. 25765
caggctcaacagcaaccagctcctgggcctcgtgccacctggcctcgccgccttacccgacctccaggagctcaagctcaacaacaacaacctcttgggccccatcccgcccgtcaaggcgcccaatttcaccttctccggcaacgggttctgtgccgccaagcccggggacacctgcgcgccggtggtcatggcattgctccaattcctcgccgacgtccagtaccccaccgggctcgtcgatacctggtccgggaacgacccctgcgcggcgggttgggctggcgtttcctgcgtccagggcaaagtcaccgtgctcaacctgccggacaaaggcctcaacggcacaatcagcccgagtctcggcaacatcaccacgctcttagacgtcatcctcggcgggaaccatctcagcggccaagtgccggacagcctcaccaaccttgactcgcttcggaagctggacttgtccatgaatgacttatctgggccactgcccaccttcaagccgagcgtccaggtggatgtctctggtaatctcaacttcaatagcacggcggcgccgccggatgcgcaaccaaacagctcccctcattctccagcaactcccagcggcgcaccaggctcacatggcagtaatgcagccatcccggggaatgtgagg

SEQ ID NO: 25765 - protein, 220 aa, Panicum virgatum
  misc_feature: Ceres CLONE 1864948
  misc_feature: SWISSPROT Homolog: EC 2.7.11.1 Non-specific serine/threonine protein kinase
RLNSNQLLGLVPPGLAALPDLQELKLNNNNLLGPIPPVKAPNFTFSGNGFCAAKPGDTCAPVVMALLQFLADVQYPTGLVDTWSGNDPCAAGWAGVSCVQGKVTVLNLPDKGLNGTISPSLGNITTLLDVILGGNHLSGQVPDSLTNLDSLRKLDLSMNDLSGPLPTFKPSVQVDVSGNLNFNSTAAPPDAQPNSSPHSPATPSGAPGSHGSNAAIPGNV

SEQ ID NO: 25766 - DNA, 1914 bp, Panicum virgatum
  misc_feature: Ceres CLONE 1864970
  misc_feature: Encodes the peptide sequence at SEQ ID NO. 25767
gcggccagcactagtgtcgcttgcagcgaaccagcagctcgccccgcaggctcgcgcgtcgtacgtggcaggaggtaggcgtcgcgcgctgcgccatggaggaggaggcggcgcgggcggcgccgctgctgcagccgcggccgcgcggcgaggcggcgggggccgccgacaccaaggcggggcgcgcgaggctggcggcggcggagtggtgggtggagtcgaagaagctgtggcgcatcgtggcgccggccatcttccagcggatcgcgctgttcgcgatcaacgtcgtcacgcaggccttcatcggccacctcggcgacctcgagctcgccgccttctccatcgccgccaccgtcgtcgccggcttcaacttcggattcctgctgggcatggcgagcgcgttggagacgctgtgcgggcaggcgttcggggcgaagaagcaccacatgctgggggtgtacctgcagcgctcgtgggtcgtgctgctcatcttcgccgccgcgctgacgccgacctacatcttcatggaggacctgctgctgctgatcgggcagtcgccggagctgtcgcgcctggcggggcagatgagcatgtggctgctcccgcagcacttcgccatggcgatgctgctcccgctcacgcggttcctgcagagccagctcaagaactgggtcaccgcggccaccgcggccgtcgcgctcgccatccacgtcgccgtcacctacgtgctcgtgcagcacctccagctcgggatcgtcggggccgtcgctgctgccgacatgtcgtggtggctcgtcgtgctggggcagttcgtctacgtcgtcggcggggggtgcccgctgtcctggaagggcttctcgatggaggcgttcgccgacttctgggagttcatcaagctctcctcggcttccggagtgatgctctgcttagagaactggtacttcaaattgctggtgttgctgacagggtacctgaagaacgctgaaatcgctgtggatgcactctccatatgtcagacgatcaacggatgggagctgatgattccgttcggcttcctagcagcaacaggggtgcgagtggcaaacgagctcggcgccgggagcggcagaggcgcgcgcttcgccatcatcgtctccatcacgacgtccgtggtgatcgccctcttcttctggtgcctgatcctctacttcaacggccagctcgcgctcctcttcacgtccagcgaggccgtgctcgccgccgtgaaggacctctccgtgctgctcgccttcaccatcctcatcaacagcgtgcagcccgtcctctcaggggtggccatcggttcaggatggcaagccttggtcgcctacgtgaacgtcgggagctactacctcatcggagtccccttgggtatcttgctcggttggccgctgcatttcggagtcgggggaatctggtcggggatgattggcgggaccgccgtccaaacagtgatcctggcctacattaccatgaaatgtgactgggatgaagaggcgaggatagcaagtatgagaatgcagaaatgggccgactcaaaataaagctcctcgatcagtaccggtgcactttgttacctagacacgtacggggaacattggagctcagcaatgatcaagatacagtcatagagagttccaggcttcaccaactacatttggcaactggcctggcaaccagtttctgaagatagtatccacggcacctccgaaagaggacttcaaacataattatatttgtgatccttttgcagatttgtaacatggattatattgcaccactgttacagtgtgcaaatactgtctgccattattgagcgaatctagcatgaatattgtggtgtgatctcttactcaattgatcaatatatgtcggcgctcatgtgtttctgaattc

SEQ ID NO: 25767 - protein, 488 aa, Panicum virgatum
  misc_feature: Ceres CLONE 1864970
  misc_feature (271)..(434): Pfam Name: MatE Pfam Description: MatE
  misc_feature (51)..(211): Pfam Name: MatE Pfam Description: MatE
MEEEAARAAPLLQPRPRGEAAGAADTKAGRARLAAAEWWVESKKLWRIVAPAIFQRIALFAINVVTQAFIGHLGDLELAAFSIAATVVAGFNFGFLLGMASALETLCGQAFGAKKHHMLGVYLQRSWVVLLIFAAALTPTYIFMEDLLLLIGQSPELSRLAGQMSMWLLPQHFAMAMLLPLTRFLQSQLKNWVTAATAAVALAIHVAVTYVLVQHLQLGIVGAVAAADMSWWLVVLGQFVYVVGGGCPLSWKGFSMEAFADFWEFIKLSSASGVMLCLENWYFKLLVLLTGYLKNAEIAVDALSICQTINGWELMIPFGFLAATGVRVANELGAGSGRGARFAIIVSITTSVVIALFFWCLILYFNGQLALLFTSSEAVLAAVKDLSVLLAFTILINSVQPVLSGVAIGSGWQALVAYVNVGSYYLIGVPLGILLGWPLHFGVGGIWSGMIGGTAVQTVILAYITMKCDWDEEARIASMRMQKWADSK

SEQ ID NO: 25768 - DNA, 486 bp, Panicum virgatum
  misc_feature: Ceres CLONE 1864973
  misc_feature: Encodes the peptide sequence at SEQ ID NO. 25769
acatcatcagcaacctagctcgcttttttcctggcctccactatcggtactgtgatctacacctaccatggcttcatacattggcaacaagtctcgcatcacggcagccttgatgctgcttgttgctgccataaccatgacgagccacatcgccctcgaggtggacgcccgggacccgtcggctggaacccacggcaaggaggccatgaaggagaggcacctcaagtggatggcgcagcacggccgcacctacagcaaccaggcagagaaggcacaccgattccaggaattcaaggactgtgctgcttttgttgaccaatccaaccctgcatctggcaagaagcatcacctgtgcatcaacaaaatcgccaacatgaccatctactagtccatggacatgtacactggcttcaagccagtgaccaccggggacaacaagacacccggttttatgtacggaaatgttacactggcttcacatgacca

SEQ ID NO: 25769 - protein, 106 aa, Panicum virgatum
  misc_feature: Ceres CLONE 1864973
  misc_feature (51)..(106): Pfam Name: Inhibitor_I29 Pfam Description: Cathepsin propeptide inhibitor domain (I29)
  misc_feature: SWISSPROT Homolog: EC 3.4.22.33 Fruit bromelain
MASYIGNKSRITAALMLLVAAITMTSHIALEVDARDPSAGTHGKEAMKERHLKWMAQHGRTYSNQAEKAHRFQEFKDCAAFVDQSNPASGKKHHLCINKIANMTIY

SEQ ID NO: 25770 - DNA, 1312 bp, Panicum virgatum
  misc_feature: Ceres CLONE 1864975
  misc_feature: Encodes the peptide sequence at SEQ ID NO. 25771
aaagctactcggtttcccccatcctcgtcctcgtcgcctccccgctagcgctagctttgcccccacccctcgaaaccctacccgcaccatgcgcgatcgatcggtcgatcgcgaattccccagccgcgagcgcggggatcggccgccacccgggatgctgggccctccgcgccgcgggccggcgtacaagacgaagatgtgcgcgctgtggcagcgcggcggctgctcccgcgacacctgcagcttcgcgcacgggcgcgccgagctccgccggttccccggctcccgcacctcgttcccgccccgcgccgggaggggagattatagaggcggtgacttcagagaaaggtttgataggaggcgttcgcctcataggaggcattcccttgatagagattccaggggtcatcgtcctcttcatgatcgaaaaccaacttctcaagaaagggaatctagctattcacgatcccccagcaggaagagcgataggaggcatgataagaaccctgatgatggagaaaccaactcatccaggagcttgagtgtctctgacaaaaatgacgatagaaaaaaggagaaaatcttaagtggtgatgataaagaggatcaagaaatacagctgaaacaaataagacaggatacggaacttctgcgtgaggataaatctcacttggagaacattttggatgagaagaacgctgaagtacgcaagatttctagcagggtaaatgatcttgatctgcagataaggaaggagaaagaggaatgccacaggatgacctcaaaaataaagaagttcattaaagctcatgctcgctttttgaaagcacaggaagaattgaaaaggtcacaagctcgttttgagagacttggtgatttgcttgcttcggatattctgaagcgtggtgctaacgaagaagtttccagtgtcaatgttgatgaagatccaaatgggccttatgagaggagcccaaatgctgctacagctaagaagagatcaatcccttactcaacaagtgaagaagcaaaagccgtaaagaaaaggagagatcgtgattcagaatttgataaatcaagcaagggaactgagccaacaaaagctttatatttgaagaagaaattgtgggaagatgaaaaggataaaataggcaatgttgtttcctcggccaacactgacaaggtcaaagattctccagccaaacatgttttaccctccactggtatggctgctcatgctgtggatgatctatttgaagctgttgaactggaggataggcatgatccaataaacacatcagtagaaaatgatgct

SEQ ID NO: 25771 - protein, 385 aa, Panicum virgatum
  misc_feature: Ceres CLONE 1864975
  misc_feature (11)..(35): Pfam Name: zf-CCCH Pfam Description: Zinc finger C-x8-C-x5-C-x3-H type (and similar)
MLGPPRRGPAYKTKMCALWQRGGCSRDTCSFAHGRAELRRFPGSRTSFPPRAGRGDYRGGDFRERFDRRRSPHRRHSLDRDSRGHRPLHDRKPTSQERESSYSRSPSRKSDRRHDKNPDDGETNSSRSLSVSDKNDDRKKEKILSGDDKEDQEIQLKQIRQDTELLREDKSHLENILDEKNAEVRKISSRVNDLDLQIRKEKEECHRMTSKIKKFIKAHARFLKAQEELKRSQARFERLGDLLASDILKRGANEEVSSVNVDEDPNGPYERSPNAATAKKRSIPYSTSEEAKAVKKRRDRDSEFDKSSKGTEPTKALYLKKKLWEDEKDKIGNVVSSANTDKVKDSPAKHVLPSTGMAAHAVDDLFEAVELEDRHDPINTSVEND

SEQ ID NO: 25772 - DNA, 686 bp, Panicum virgatum
  misc_feature: Ceres CLONE 1864980
  misc_feature: Encodes the peptide sequence at SEQ ID NO. 25773
aaacccctcccaccctttcccgtagcgcggagccgccactcccccacaccagcacaccacgctgaggaaaacctagatccggacccctcgccgccggccatggcgacgcgccgggccctctcctccatcctccgctcggcctcccgcatccgcgccgcctccccgaccccgtgcccgcgcccccgcgcgccgctccaccaccgcccgtcccctgcgggcttcctcctcaaccgcgccgccgcctacgcctcatccgccgcggcacaggcggcgcccgccccgccgtccccgtccaccggcaagacgaccggtggtggcaagatcaccgatgagttcaccggcgccggcgccatcggccaggactgccaggtcatcggtgccgtcgtggacgtgcggttcgacgaggggctgcccccgatcctgacggcgctcgaggtgctcgacaacaacatccgcctcgtgctcgaggtggctcagcatctcggggagagcatggtccgcaccatcgccatggacgggaccgaggggctcgtccgcggacagcgtgtgttaaacactggctctcccatcactgtccctgttggtagggctacactaggacgtattatgaatgttattggcgagcctatcgatgagaagggagatataacgacaagccacttcctccctatccatcgtgaagcccc

SEQ ID NO: 25773 - protein, 195 aa, Panicum virgatum
  misc_feature: Ceres CLONE 1864980
  misc_feature (88)..(154): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MATRRALSSILRSASRIRAASPTPCPRPRAPLHHRPSPAGFLLNRAAAYASSAAAQAAPAPPSPSTGKTTGGGKITDEFTGAGAIGQDCQVIGAVVDVRFDEGLPPILTALEVLDNNIRLVLEVAQHLGESMVRTIAMDGTEGLVRGQRVLNTGSPITVPVGRATLGRIMNVIGEPIDEKGDITTSHFLPIHREA

SEQ ID NO: 25774 - DNA, 701 bp, Panicum virgatum
  misc_feature: Ceres CLONE 1864984
  misc_feature: Encodes the peptide sequence at SEQ ID NO. 25775
cttaatgtctacataaaccatgacaagaaatttgcttttgttgagatgagatctgtggaagaagcaagcaatgcaatggccttagacggcataatgttcgagggagcaccagtgaaggttagaaggccgacggactataatccttccctagcagctgcgctgggcccaagccagcctaacccgaatcttaatcttgctgctgttggcttaacccctggctctgctggaggattagaaggtcccgatcgcatttttgtgggtgggctaccctattacttcactgaggcccaagtgcgggagttgctcgagtcctttggtcctctgcggggatttgatcttgtgaaggatagggaaactggtaactcgaagggctatgcattctgtgtgtaccaggatcttaatgttaccgacattgcctgtgctgctcttaatggcatcaagatgggagacaagacccttactgttagacgggcgaaccaaggaacctctcagcctaggccagagcaggaaagcatcctgatgcaggcacatcaacaggtgcaaatgcagaaactcgtgtaccaagttggaggtgctcttccaacaaaagtcgtatgcctgacacaggtagtcacagcagatgaactgagagatgatgaggaatatgaggacattgtggaggacatgagggaagaagggcgcaaatacgtcccacataatgc

SEQ ID NO: 25775 - protein, 233 aa, Panicum virgatum
  misc_feature: Ceres CLONE 1864984
  misc_feature (84)..(155): Pfam Name: RRM_1 Pfam Description: RNA recognition motif. (a.k.a. RRM, RBD, or RNP domain)
  misc_feature: SWISSPROT Homolog: EC 2.7.11.1 Non-specific serine/threonine protein kinase
LNVYINHDKKFAFVEMRSVEEASNAMALDGIMFEGAPVKVRRPTDYNPSLAAALGPSQPNPNLNLAAVGLTPGSAGGLEGPDRIFVGGLPYYFTEAQVRELLESFGPLRGFDLVKDRETGNSKGYAFCVYQDLNVTDIACAALNGIKMGDKTLTVRRANQGTSQPRPEQESILMQAHQQVQMQKLVYQVGGALPTKVVCLTQVVTADELRDDEEYEDIVEDMREEGRKYVPHN

SEQ ID NO: 25776 - DNA, 653 bp, Panicum virgatum
  misc_feature: Ceres CLONE 1864988
  misc_feature: Encodes the peptide sequence at SEQ ID NO. 25777
aaccacagcaaccagctgaaagaaaaaactcacgcatccctgcaagatcgcaatggcggcgccggggcggccgctgacggtggactttgaggcgctgagctacatcagcagcctggtggaggcgttccaggcgttcgactccgacaacgacgggctcgtgacggcgcccgagctccgcggcctgctggcgtcgctgggcctggacaagtcggaggccgaggcgcgcgacatgctggcgcgcgccgacggcgaccgcgacgggcggctcagcgtcgaggagctcctggacgtgatgaacgccggggagctcgggctgggcgcgctcggcgacctgctgcagtcggcgctgcccgcgctcgaggccgccgggggcgcgctggtcggcgcggacgagctcgccagggcgctcggcgtcatgggcgccgccagcgccgaggactgcgcggccatcgtcgagtgcctggacggcgacggcgacggcgccatcaccatcgaggagttcaggctcatggccgacctgctctagatcgaccctaggctgccgcacctacgcttggaacggtgtcttatttgctctgtgctcgttgtggtgttcagctatgtactgagcttgacaataaatcagtgcgtgttcttctgtaaaaaaaaaaaaa

SEQ ID NO: 25777 - protein, 157 aa, Panicum virgatum
  misc_feature: Ceres CLONE 1864988
  misc_feature (20)..(48): Pfam Name: efhand Pfam Description: EF hand
  misc_feature (56)..(84): Pfam Name: efhand Pfam Description: EF hand
  misc_feature: SWISSPROT Homolog: EC 2.7.11.1 Non-specific serine/threonine protein kinase
MAAPGRPLTVDFEALSYISSLVEAFQAFDSDNDGLVTAPELRGLLASLGLDKSEAEARDMLARADGDRDGRLSVEELLDVMNAGELGLGALGDLLQSALPALEAAGGALVGADELARALGVMGAASAEDCAAIVECLDGDGDGAITIEEFRLMADLL

SEQ ID NO: 25778 - DNA, 689 bp, Panicum virgatum
  misc_feature: Ceres CLONE 1864991
  misc_feature: Encodes the peptide sequence at SEQ ID NO. 25779
acgcttagcttacctccaagtccatctccggcgcgagctagctctcgctgctcgatcggtccagatccacaaccaacagcaagcggctgcggggctgcaatgccgggtccggggagcatgccgctggcgctgggcctggacacggcgggggtgcaggtgccctggtacttccggtgccccatctccctggagctcatggccgaccccgtcaccgtgtccacgggccagacctacgaccgcgccagcatcgagtcctgggtcgccaccggcaacaccacctgccccgtcacccgcgcgccgctcgccgacttcacgctcatccccaaccacaccctccgccgcctcatccaggactggtgcgttgcgcaccactccatgggcgtcgagcgcatccccacgcccaagcagcccgccgacccagacctcgtccgctccctcgtcgcccagggcccgggcctccccgcgctccgcaggctcagggcgctcgccagggagtccgacaagaacaggctcgtcatggccacgcgcgagaccagggccgcgctcctcgaggtcgccttcgcctccggctccgacgagctccaggccgaggccatggcggtgctcgcgctcgtcggcctcggggaggccgaggccgccgaggtcgtggcccgggaggagcgggtggccaggctcgggcaggtcctcgc

SEQ ID NO: 25779 - protein, 196 aa, Panicum virgatum
  misc_feature: Ceres CLONE 1864991
  misc_feature (19)..(93): Pfam Name: U-box Pfam Description: U-box domain
MPGPGSMPLALGLDTAGVQVPWYFRCPISLELMADPVTVSTGQTYDRASIESWVATGNTTCPVTRAPLADFTLIPNHTLRRLIQDWCVAHHSMGVERIPTPKQPADPDLVRSLVAQGPGLPALRRLRALARESDKNRLVMATRETRAALLEVAFASGSDELQAEAMAVLALVGLGEAEAAEVVAREERVARLGQVL

SEQ ID NO: 25780 - DNA, 1089 bp, Panicum virgatum
  misc_feature: Ceres CLONE 1864999
  misc_feature: Encodes the peptide sequence at SEQ ID NO. 25781
gcctcaaactttccactcccggcatgtggaccacaacgacacgccggccagatgcaagatcttccgcggtgtccgtatgcaactcagctactcaaactcgagcttcttcgttagcgtgctccatggttgcgaacagcaggagctgaggccaagggcaaaacgccagaaggcagattgtttcaggcgacaggaactagcgtgtaggcggcagcggcggcgtgctcagtcatggagacggaggcgcgggcggcggtggagaggccggcgcagccgttcctgccgctgcggtgggagagcacgggcgaccagtggtggtacgcgacgcccatcgactgggcggcggccggcggccactacgacctcgtccgcgagctcctccgcctcgacgccaacctcctcgtcaagctcacctccctccgccgcatccgccgcctcgagtccgtctgggacgacgacgcgcgcctcgcgggcgccgccaggaaccgcgccgccgtcgcccgccgcctcctcctcgactgcgaccccggcggcgtcggccccagcaaccgcctcctccgggccgggtacggcggctggctcctctacacggcggccgcggccggggacgccggcttcgtccgggacctgctcgcggcgcagccgctgctcgtcttcggcgagggggagtacggcgtcaccgacatcctctacgccgcggcgaggagcgggcgccccgaggtgttccggctcctgctcgacgccgtgcattccccggcgtcctgccctgtcggtgaggaattcacgagcgagatggtgaaccgcgccgtgcacgccgcggcgaggggaggcaacctggaggtgctcagggagctccttcgcgggtgctccgacgccgcggcgtaccgagacgcgcagggatcgaccatcttgcacgccgccgctgcaaggggccaggtcgaggttgtcaacgatctcattgcatcttttgatatagtcaactctgtagatgaccaagggaatacagcgttgcatatagcagcctttagaggctatctgcctgtggttgaggttcttgtttactgcatcatcatttcttgtatcggcaacaaa

SEQ ID NO: 25781 - protein, 286 aa, Panicum virgatum
  misc_feature: Ceres CLONE 1864999
  misc_feature: SWISSPROT Homolog: EC 2.7.11.1 Non-specific serine/threonine protein kinase
METEARAAVERPAQPFLPLRWESTGDQWWYATPIDWAAAGGHYDLVRELLRLDANLLVKLTSLRRIRRLESVWDDDARLAGAARNRAAVARRLLLDCDPGGVGPSNRLLRAGYGGWLLYTAAAAGDAGFVRDLLAAQPLLVFGEGEYGVTDILYAAARSGRPEVFRLLLDAVHSPASCPVGEEFTSEMVNRAVHAAARGGNLEVLRELLRGCSDAAAYRDAQGSTILHAAAARGQVEVVNDLIASFDIVNSVDDQGNTALHIAAFRGYLPVVEVLVYCIIISCIGN

SEQ ID NO: 25782 - DNA, 557 bp, Panicum virgatum
  misc_feature: Ceres CLONE 1865001
  misc_feature: Encodes the peptide sequence at SEQ ID NO. 25783
aatcttctgggcacccgtctccctccccagcggtcgcctcgccgccccaggtcgcgttgccctccggggccgctggtgccgcgtttccttccgtcgcggccgcctccactccgatggcgaagtcggatggcgaccagaaggatatgaagctttggggcgggcgcttccaggagggcgtcatggacgccgtggagcgcttcaccgactccatctcctacgactggcacctctactagtacgacttcatgggcagcatggctcatgccaccatgctcgcctcccagggtgtgataactgctggcgatagggatatcatctttgagggtctcgattccattgagacacttattcacgaaggcaagattgagtggacaaaggatcgggaggatgtgcatatgaacattgaatcagctctgattgagatggctggtgatccatcgaacaaactgcccactgatagtagccgcaatgaccaacttgtgacggatctaaggctatggtgccgtgatgctatcgagaagattttgattcctatcaagcagcttcaggtgtgtttg

SEQ ID NO: 25783 - protein, 103 aa, Panicum virgatum
  misc_feature: Ceres CLONE 1865001
  misc_feature: SWISSPROT Homolog: EC 4.3.2.1 Argininosuccinate lyase
  misc_feature: Useful for making plants with modulated salt sensitivity
MGSMAHATMLASQGVITAGDRDIIFEGLDSIETLIHEGKIEWTKDREDVHMNIESALIEMAGDPSNKLPTDSSRNDQLVTDLRLWCRDAIEKILIPIKQLQVC

SEQ ID NO: 25784 - DNA, 674 bp, Panicum virgatum
  misc_feature: Ceres CLONE 1865003
  misc_feature: Encodes the peptide sequence at SEQ ID NO. 25785
aaaacccacctcgctcgcctcactccccgcgcgctcccagcgcacctccaccccccacccgcccctttccattctcgtcaccccctccgcgcccgggactccagcggctggcaaagctctgcttcccctttgactctggggctttcacacgcccttacttcattcatgtggctatgcggccctattgctggcttagtggttcaaccgctcgtcggtctgtacagtgacaggtgcaccgcgagatgggggcgacggaggccatttattctgactggatgtctgctcatctgtcttgccgttgtgatcgttggattctcatcagacattggagctgctctgggcgacacaaagaaagagtgcagcctctaccatggtcctcgttggcatgctgcaatcgtctatgttctggggttctggttacttgacttctccaacaataccgtgcaaggtccagctcgtgccctaatggctgatctgtcaggtcgtcatggccctagtgcagctaattcaatcttctgttcttggatgacattgggaaatatcctagggtactcctctggttccacaaacaattggcacaagtggtttcccttcctgaaaacaagagcctgctgtgaagcctgtgcaaacctgaaaggtgcatttctggtggctgtggtgttcctgatcttctg

SEQ ID NO: 25785 - protein, 224 aa, Panicum virgatum
  misc_feature: Ceres CLONE 1865003
  misc_feature: Useful for making plants with modulated heat sensitivity
KTHLARLTPRALPAHLHPPPAPFHSRHPLRARDSSGWQSSASPLTLGLSHALTSFMWLCGPIAGLVVQPLVGLYSDRCTARWGRRRPFILTGCLLICLAVVIVGFSSDIGAALGDTKKECSLYHGPRWHAAIVYVLGFWLLDFSNNTVQGPARALMADLSGRHGPSAANSIFCSWMTLGNILGYSSGSTNNWHKWFPFLKTRACCEACANLKGAFLVAVVFLIF

SEQ ID NO: 25786 - DNA, 1271 bp, Panicum virgatum
  misc_feature: Ceres CLONE 1865026
  misc_feature: Encodes the peptide sequence at SEQ ID NO. 25787
aaccaaacgccaaatggggccaagcatgacgcccactgccacggtgcccctcgcgcctctcctcctccgcctttccgccgcagccgcggccgcagcagctccacgcctcaagaacccggcggcgacagcagcagcaggggcagtccatgtccatggcgtgcggtgggcgggtggcggggccaggagcaggaggaggaggtgccgggcggcggtggtggaggaggccggcgcgcgcgaggacggggtgctgctgcccaaggagggggacgatgccgcggcggcggcggcggggcggtacgactggaaggaggagtggtacccgctgtacctggccaaggaggtgcccgacgacgcggcgctcccgctcaccgtgttcgaccgccagctcgtgctctggcgcgacggcgacggcgtgctccgctgccaccaggaccggtgcccgcacaggttagcgaagctgtcggaaggccagatcgtcgacggcaggctggagtgcctctaccatggctggcagttcgatggcgagggcaagtgcgtcaagataccacagctgccggagggcgccaagatcccccggagcgcgtgcgcgcgcacctacgaggtgcgcgactcgcagggcgtggtgtgggtgtggatgtcggacgcgaacccgcccgacgagcggaagctcccatggttcgagccgtacgcgcgggcggggttcacggacctgtcgacggtgcacgagctcccctacgaccactccatcctgctggagaacctcatggacccggcgcacgtgcccatctcccacgaccgcaccgactggacggccaagcgcgaggacgcgcaggcgctcttcttcgacgtcaccgagcgcaccgcgcgcgggttcgccggctactggggccgcacgcgcacgccgcacctccgcaacctgctccgcttcgaggcaccctgcgtgctcaccaacacgctcgagtacacggacaaggacggcagggaccagtgcttctccgcccaattcctctgccgccccgccggccagggcaagtccatgctcgtcgtccgcttcggctccaccgtcaggtcgcccatcgccaaggtgctcccggcctggtacctgcaccacaacgcgtgcaaggtgttcgagcaggacatgggcttcctgtcgtcgcagaacgaggtgctgctccgggagaagctgcccaccagggagctctacctcaacctccgttcctccgacacctgggtcgccgagtactggaagtggatggactgggcgggccacg

SEQ ID NO: 25787 - protein, 415 aa, Panicum virgatum
  misc_feature: Ceres CLONE 1865026
  misc_feature (301)..(391): Pfam Name: PaO Pfam Description: Pheophorbide a oxygenase
  misc_feature (96)..(198): Pfam Name: Rieske Pfam Description: Rieske [2Fe-2S] domain
  misc_feature: SWISSPROT Homolog: EC 1.13.12.14 Chlorophyllide-a oxygenase
MTPTATVPLAPLLLRLSAAAAAAAAPRLKNPAATAAAGAVHVHGVRWAGGGARSRRRRCRAAVVEEAGAREDGVLLPKEGDDAAAAAAGRYDWKEEWYPLYLAKEVPDDAALPLTVFDRQLVLWRDGDGVLRCHQDRCPHRLAKLSEGQIVDGRLECLYHGWQFDGEGKCVKIPQLPEGAKIPRSACARTYEVRDSQGVVWVWMSDANPPDERKLPWFEPYARAGFTDLSTVHELPYDHSILLENLMDPAHVPISHDRTDWTAKREDAQALFFDVTERTARGFAGYWGRTRTPHLRNLLRFEAPCVLTNTLEYTDKDGRDQCFSAQFLCRPAGQGKSMLVVRFGSTVRSPIAKVLPAWYLHHNACKVFEQDMGFLSSQNEVLLREKLPTRELYLNLRSSDTWVAEYWKWMDWAGH

SEQ ID NO: 25788 - DNA, 562 bp, Panicum virgatum
  misc_feature: Ceres CLONE 1865026-R
tcgagcaggcgccggcgggggccgtcgcggggatctcggcctccttcccggccaagggcggtgtcggcacggtgcacgcgcccaaccccaccaacaggtacttccgccacgtcgtgcactgcaaggggtgcagggcaagcgtcaacaagtacacctcgtggaagaacgccttcgccgtcctcgcggcagcggccgtggccgcctccatcctggcggcgaccaggcagtggaaggccatcttgctggcggcgtcagccgtgctggccgcggcgtcctacgcgtgcgacgcggtgctttctttgatcacaaccaacttcattaggacacataggcgactgtaaggcatatagcaggcatttaggtacaagggaggctttcgccctttgtatatttgttgtatctataatgagcggtgctttggcaatctaagatgcatgtcagcagcagatgatatggggattagatcttccatcttctgtcaaattgtggatagtcatgcaggatcgaggacgttgagtttgtgatttgaacccaaatgtcatgaggtcatacaacacacgtc

SEQ ID NO: 25789 - DNA, 2395 bp, Panicum virgatum
  misc_feature: Ceres CLONE 1865028
  misc_feature: Encodes the peptide sequence at SEQ ID NO. 25790
ccctcggccggcgccgctcgttgacaggaccgctcgccacgacatcgggcgcagcactcgcagctcgccgtcgccgccgcgcggcctcactcccacgcctcgccggccatcccctctccgccctcacgcgcccgcgacctgcgcgcactcgagagatccagcaccccctaaaccctaccggctcagctcgcccccttagcgctggcggcggcaatggaggacgaggagatggagaagaaagtgcagcagtacctgcagcgcaaggggttccgcctcaccgagcttgcgctgcaggaggagcgcaaccgcctctccacctccgccgtctccgacgtcacgcttgccagatctgacaatgatccgggaagataccatgatggatatagtagactaagaacatgggcatatagttctcttgatcaatacaagcatgaattactccgtgtcctttacccagtttttatccattgcttcatggatctagtgacagagggacatatgcaggaagctcggtcatttttccataagtttcgggaagatcatgaagtaatgcattcaagggatcttcagaagctggaagctgtcctctccccttcacatctggaggaaatggaactggcccgatctttaaggcaaaataaatttaaaattaaattatgcgagtattcatacgagttgcttctccagtatctccagaaaacacaagctcttgttgtgcttggggtaatcaatgagcacataacttttgaagtatctcctgggcaaccctcattaatttctgatgatgcggacgttgttgccctgattggaacaagtaaggacttggcaaagcagataaatcagaaggaagtgcattggggggagcttgaagattctgttgaagagcgaatggagaaggcactagcagaatctgataaagttgaagctgaaagcaaggatgccggcacagaagataacaagaaaagaaacgcagaaggtggaaagcaaggtgcttctcttaagaagagcaaaaaggataagcttgtaggcgcaactggaaaaaacatcagaactgaaacaagcatggtttctgtggcacctcgtgtgaaaccagagctaactctgccaacaacgcctgtcgaagttgaacaatcgattcttgaggatctgcgaaaccgtgcacaactgaatagtgtggcattaccgtctgttagcttctacacattcctcaatacacataatggattaaactgctcatcgatatcacatgatgggtctttggttgtgggtgggttttctgattcatcagtgaaggtttgggatatgtcaaagattggtcaaccagcaaaaacatctagttcacagggggataatggatcttcccagggtgaacgcatgtcaaccatagatgaggggaaaagaccttatacactattccaaggtcattctggaccagtttattcagcggcctttagcccgtttggggattttctcttgtcatcatcttcagattcaacaattagactttggagtaccaagctgaatgccaatcttgtctgttacaaaggacacaactacccagtttgggatgtccaattcagcccggtcggacattactttgctagtgcttcacatgacaggactgctagaatctggtcaatggataaaattcagcctttgcggataatggctgggcatctttctgatgttgattgtgtccagtggcatgtaaactgtaactacattgccactggttctagcgacaagactgtaagactatgggatgttcagtcaggcgagtgtatacggatgtttattggtcataggagtatggttttatcactggcaatgtcacccgatggacgatacatggcctctggagacgaagatggaaccatcatgatatgggatctatctactggtcgctgtgtttcaccactactaggacacagctcttgtgtgtggacacttgctttcagctgtgaaggggcactgcttgcatctggatcagccgactgtactgtaaaactatgggatgtcgcttccagcacaaaggccctgaagacagaggacaccaaaggcggtacagctaaccgactgaggttgcttaaagctctccctacaaaatcaactcctgtttatagccttcggttctctcggcggaaccttctatttgcgtccggtgctctctcgctgaacacgttgtaagctgcattgagaagcggacctgcctgtgggtccaatatttccattatagatttgtagagcttacattgtcattggcgattgcatgtagcctctaacttggcccgcaaccattgcggatcctcgtaagcacacgactgcatgagtgatgttgtaaaaatgttatgtattacactgtaaaatcactaacattttctaggttgcggaattg

SEQ ID NO: 25790 - protein, 657 aa, Panicum virgatum
  misc_feature: Ceres CLONE 1865028
  misc_feature (479)..(517): Pfam Name: WD40 Pfam Description: WD domain, G-beta repeat
  misc_feature (563)..(601): Pfam Name: WD40 Pfam Description: WD domain, G-beta repeat
  misc_feature (521)..(559): Pfam Name: WD40 Pfam Description: WD domain, G-beta repeat
  misc_feature (395)..(433): Pfam Name: WD40 Pfam Description: WD domain, G-beta repeat
  misc_feature (437)..(475): Pfam Name: WD40 Pfam Description: WD domain, G-beta repeat
  misc_feature (34)..(179): Pfam Name: TFIID_90kDa Pfam Description: WD40 associated region in TFIID subunit
  misc_feature: SWISSPROT Homolog: EC 2.7.11.7 [Myosin heavy-chain] kinase
MEDEEMEKKVQQYLQRKGFRLTELALQEERNRLSTSAVSDVTLARSDNDPGRYHDGYSRLRTWAYSSLDQYKHELLRVLYPVFIHCFMDLVTEGHMQEARSFFHKFREDHEVMHSRDLQKLEAVLSPSHLEEMELARSLRQNKFKIKLCEYSYELLLQYLQKTQALVVLGVINEHITFEVSPGQPSLISDDADVVALIGTSKDLAKQINQKEVHWGELEDSVEERMEKALAESDKVEAESKDAGTEDNKKRNAEGGKQGASLKKSKKDKLVGATGKNIRTETSMVSVAPRVKPELTLPTTPVEVEQSILEDLRNRAQLNSVALPSVSFYTFLNTHNGLNCSSISHDGSLVVGGFSDSSVKVWDMSKIGQPAKTSSSQGDNGSSQGERMSTIDEGKRPYTLFQGHSGPVYSAAFSPFGDFLLSSSSDSTIRLWSTKLNANLVCYKGHNYPVWDVQFSPVGHYFASASHDRTARIWSMDKIQPLRIMAGHLSDVDCVQWHVNCNYIATGSSDKTVRLWDVQSGECIRMFIGHRSMVLSLAMSPDGRYMASGDEDGTIMIWDLSTGRCVSPLLGHSSCVWTLAFSCEGALLASGSADCTVKLWDVASSTKALKTEDTKGGTANRLRLLKALPTKSTPVYSLRFSRRNLLFASGALSLNTL

SEQ ID NO: 25791 - DNA, 1258 bp, Panicum virgatum
  misc_feature: Ceres CLONE 1865041
  misc_feature: Encodes the peptide sequence at SEQ ID NO. 25792
acgtccctcctcccgcctcgggcccgcccgcccccaggctcgactcgaacacgatgcagccgatgcggcggcggcaacgaggtttcccgctgctctgcctctcagccgccctcctcgctgccgccgctcttctccccggcgctgccgtcgccgagggcgtcactccctccgaggcgcgccggctccgcgacgaggtgaaagatatgttctatcatgcatttgatgggtacatgaagtatgcattcccactcgatgaactacgacccttaagttgccaaggtgaagactcccttggtggttatgcacttactctaattgactctttggataccttggctttactgggtgataaggagaaatttggtgctgctgtggagtgggttggtaagaatgtccgctttgatattaataaaaccgtctctgtttttgaaaccaacatacgtatcattgggggtctgttatcagctcacctgattgccagtgattatgccactggtatgagaatccaatcttatgatgatcagctacttcatttagcggctgacttagctcagaggttgttgcccgcatttgacactcctacaggtattccatttggatctattaatttaaagtatggagttgatgaaaatgaaagcaagataacatcaactgctggtggtggcactttgacactggaatttggcatattgagtcgcttaactaataatactgtttttgagcgagttacaaaaaattcagtccgtggaatatggtcacgcagatcaaaactcaaccttgttggtgcccatataaatgtcttcactggtgaatggacacagaaggatgctggaattggcacaagcattgattctttctatgaatatcttctaaaggcatatttattgtttggagatgaagagtacctgtatatatttcaggaggcttacaaggctgccatgcaccatctccatcatgatccttggtatgtggaggtcaatatgaattctggtgctactgtttggccattattcaatagcctgcaggcattctggccaggacttcaggttttagccggagatgttgatcctgctattcgaacacatgatgccttcttcagcgtttggaaaaagtatggtttcacccctgaaggttttaatcttgctacatcgactgtccagaatggacaacgcagctacccgctacggccagagttgattgaaaagcacatattggttgttcaaggctaccagagattataggtgtgtctttctttaca

SEQ ID NO: 25792 - protein, 395 aa, Panicum virgatum
  misc_feature: Ceres CLONE 1865041
  misc_feature (51)..(395): Pfam Name: Glyco_hydro_47 Pfam Description: Glycosyl hydrolase family 47
  misc_feature: SWISSPROT Homolog: EC 3.2.1.113 Mannosyl-oligosaccharide 1,2-alpha-mannosidase
MQPMRRRQRGFPLLCLSAALLAAAALLPGAAVAEGVTPSEARRLRDEVKDMFYHAFDGYMKYAFPLDELRPLSCQGEDSLGGYALTLIDSLDTLALLGDKEKFGAAVEWVGKNVRFDINKTVSVFETNIRIIGGLLSAHLIASDYATGMRIQSYDDQLLHLAADLAQRLLPAFDTPTGIPFGSINLKYGVDENESKITSTAGGGTLTLEFGILSRLTNNTVFERVTKNSVRGIWSRRSKLNLVGAHINVFTGEWTQKDAGIGTSIDSFYEYLLKAYLLFGDEEYLYIFQEAYKAAMHHLHHDPWYVEVNMNSGATVWPLFNSLQAFWPGLQVLAGDVDPAIRTHDAFFSVWKKYGFTPEGFNLATSTVQNGQRSYPLRPELIEKHILVVQGYQRL

SEQ ID NO: 25793 - DNA, 691 bp, Panicum virgatum
  misc_feature: Ceres CLONE 1865041-R
ccaatcaagtaatattatactgatctctcatccagttgcaagtcaacaggatgaggctttggggaggtggtctggaactggggatcatgcagatattgtggtaacttctgattctgattctataaccctaagccatgataatactgacggctcgctcggagtgaacactgaagaacttaccgaggacaccaagagctcttccaaacagtcggaagatgaagctattgctcagaatttgaagtcgaatgaagatatcagatgaccttaattaagttcacatagggaacagatttttgtcacttactgcggagccttcagggtcaaagctcgcccaatgcagaacaagttagtaagcaagcatattgagcgtggtcgatgcgtcagtacctggccccctaactagttgagatgagctggtgaggtcattgttgcgtccgggacggtgacctgcaacctacggaatcgatatttactttcagatatgttttttctaaagtatgataacctagggtgagcattcacctttttcaaaaaaaaaaacggtgagcattcaccaatttgttctcttttgtgtattggttgcataggttctcttgatcaataacaaatgtaaattttttttgtataatagaaatatatgaacagaaagtgcatacatgatggactttattgaagaacagattattacggc

SEQ ID NO: 25794 - DNA, 662 bp, Panicum virgatum
  misc_feature: Ceres CLONE 1865052
  misc_feature: Encodes the peptide sequence at SEQ ID NO. 25795
gccaaacctgaggtggagatcgcacgcggggcaccccatctctcgtaccgccgtttgttccgctcgcgctcgccaccaccaccacccacatcccaatctctcggccacgagcggcggcggcggcggcgccctgctccttggcggcggaccgcgcggctccccaatggcctccaggatggcgctccgcctcaacgacgttacgctctgcctctccccgcccctcgctgcccgccgccgccgccgcaccggcagcgtcagggtcttcgccgtcgcctccacgccctccaccgtctccaccaaggttgaggttaagaagtcatttgctcctccaagggaggtacatgtccaggttacacattcaatgccaccccagaagattgaaatattcaagtctcttgatgactgggctagagataacatcttgactcatctcaagccagtcgagaagtgttggcagccacaggatttcctccctgacccagcatctgaaggatttcatgatgaagttaaggagctcagagaacgtgccaaggaaatccctgatgattacttagtttgtttggtcggagacatgattactgaggaagctcttccaacataccagactatgcttaacaccctcgatggtgtcagggatgagacaggtgcaagccccaccgcct

SEQ ID NO: 25795 - protein, 162 aa, Panicum virgatum
  misc_feature: Ceres CLONE 1865052
  misc_feature: SWISSPROT Homolog: EC 1.14.19.2 Acyl-[acyl-carrier-protein] desaturase
MALRLNDVTLCLSPPLAARRRRRTGSVRVFAVASTPSTVSTKVEVKKSFAPPREVHVQVTHSMPPQKIEIFKSLDDWARDNILTHLKPVEKCWQPQDFLPDPASEGFHDEVKELRERAKEIPDDYLVCLVGDMITEEALPTYQTMLNTLDGVRDETGASPTA

SEQ ID NO: 25796 - DNA, 708 bp, Panicum virgatum
  misc_feature: Ceres CLONE 1865061
  misc_feature: Encodes the peptide sequence at SEQ ID NO. 25797
atatcacactgattgctgaagatgagttcctccacgtccagcgctctcgtgctagcagcagcagtgctcctagcagcactgaccgtagcacagcatggctccctcgccgcagccgccggccccagggtcatcatcgtcggcgccggcatgtccgggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggagtatatacctactccgttccgttcaaactatacttcactttgattttatttgttgtaaatcaacatttttaactccaacctaataagtaagtcacaaaaaaacatcaactaatcagttagttcttacgaaaaaaaaacatccactgattcggcagttcgcaacacatagctcgagagaccgcctcgcgtcgcctcctgtgaggcggctcgggggtcggggcgacgcactccgccgtcgaggcggcccgtctgctccttggccgccgccgctgctctccggcgagcgttggcggcggtggcgctc

SEQ ID NO: 25797 - protein, 99 aa, Panicum virgatum
  misc_feature: Ceres CLONE 1865061
  misc_feature: SWISSPROT Homolog: EC 1.5.3.11 Polyamine oxidase
MSGISAAKTLSEAGITDLLILEATDRIGGRMHKKNFSGINVEIGANWVEGVNGGKMNPIWPIVNETLKLRNFLTDFSVATNIYKEEYIPTPFRSNYTSL

SEQ ID NO: 25798 - DNA, 1363 bp, Panicum virgatum
  misc_feature: Ceres CLONE 1865073
  misc_feature: Encodes the peptide sequence at SEQ ID NO. 25799
ggagccaccgagccacggcgtgcttttgctctcgcagccgaactcggtcgccgcagcgagccagccagcgacacggccggccggatccctccgccacccgcgccgcggttacatggcctggtgcgccctgcgcagccgcgtcctcccgcttccggcatcagccgccgccgccgccgccgccgccgcgccccacggcttcctcctctccaccgcggccccgcgccacgctcgccaccaccagctacgccgccgcgtcgcccccacggcctacgccgccgccgcggccgccgcagctgaggcgccgctccccatgacgccgcgcttcggccgggccacgcggtttcccgggggcgccgcctccgttgcgcgcgtctacgcggacgccaacgcccagcggcccaaggagtactgggattacgagtcgctcgacatccagtggggggagcaggatggatacgaggtgctgcggaaggtggggaagggaaagtacaacgaggtgtttgaaggtttccagcctgggagcgatgagaggtgcatcattaagatcctcaagcccgtgaagaasaatragatcaagagggaaataaaaatacttcagaacttatatggagggccaaatattgtaaagctgcttgatgttgtcagagatgaggaatcaaagacgcctagtctgatctttgaatatgtcaataatactgacttcaaagtgctctaccctacactatctgattatgatatcagatattatatttttgaattattaaaggtatttgtgtaggcactagattattgtcattcacggggtatcatgcaccgagatgtcaaacctcacaatatcatgattgaccatgaaaaacgccagcttcgtctaatcgattggggtcttgcagagttctaccatcccaagatggaatataatgctagagttgcttcaagatgctacaagggtcctgaacttcttgtggatttgttagattatgattactcattggatttgtggagtcttggttgcatgtttgcagcaatgatattccgagtggacccgttctttagtggccaggataattatgaccagttagtgaaaataaccgaggttcttggcacagaagatttctacgagtatcttgacaaatatggtctccagcttgacccacagctggaaagactcgttggaagacataataggaaaccatgggtgaagtttgtcaacgctaggaacagacacctagttagccccgaggctattgatttgatcgataagctactccggtacgatcaccaggaaaggcctacagcaaaggaaaccatggctcatccatatttcaatacggtaagaagctctgagagcagcaggcacaatagc

SEQ ID NO: 25799 - protein, 221 aa, Panicum virgatum
  misc_feature: Ceres CLONE 1865073
  misc_feature: SWISSPROT Homolog: EC 2.7.11.1 Non-specific serine/threonine protein kinase
  misc_feature: Useful for making plants with modulated flowering time
  misc_feature (151)..(151): Xaa is any aa, unknown, or other
  misc_feature (153)..(153): Xaa is any aa, unknown, or other
MAWCALRSRVLPLPASAAAAAAAAAPHGFLLSTAAPRHARHHQLRRRVAPTAYAAAAAAAAEAPLPMTPRFGRATRFPGGAASVARVYADANAQRPKEYWDYESLDIQWGEQDGYEVLRKVGKGKYNEVFEGFQPGSDERCIIKILKPVKXNXIKREIKILQNLYGGPNIVKLLDVVRDEESKTPSLIFEYVNNTDFKVLYPTLSDYDIRYYIFELLKVFV

SEQ ID NO: 25800 - DNA, 1851 bp, Panicum virgatum
  misc_feature: Ceres CLONE 1865078
  misc_feature: Encodes the peptide sequence at SEQ ID NO. 25801
actttccgcctttctctcttgttcgattccatctccatctctcttagtaattacagttgtagcttagcttcttggtcgtcgcacgtcttctttttagcttcttcttcttcttcttagcttcttcctcctcctcctccttaagctgctgctgctcaacctgccgccggggggatgtcggcgtcggcggaccacccagctggcggaagcagcagcagcttattaaggaggcggaggtccgtcgaggtggacttcttctccgacgtcggcaaggacaaggagaagatgcccgacccgccgcctagcccgccggggggcctcggcctcgccatcaagaaggaggacctcaccattaacctccttgttcccgcggcgacccgacgagaccacgaggacaagaagacgatagcggtgcagcagctgccggccttgcaggcggagcttgggcgcatgaacgaggagaaccaccgcctgcgggggatgctcgcgcaggtcaccaccagctaccaggagctccagatgcatctgctggcgctccagatgcagcagccgacgatcccccagcagcagccgccgccgccgtccaataactcgtcgacggaggtggtgggcagcccgcggcggtcgtcgtccgccaccggcaacaacaaggacctgcggcaggcgccggacagcccggacgccgcggccgcggggtgtctgccggcgcaggggtggcagcaggaggccagcatgaggaagactcgcgtctcggtgcgcgcgcgctcccaagctccaatcatcgccgatggttgccagtggcgcaagtacgggcagaagatggccaagggcaacccctgcccgcgagcctactaccgctgcaccatggccaacgcttgccccgtcaggaagcaggtgcagcgctgcgccgaggaccgctccatcctcatcaccacctacgagggcacgcacaaccacccgctgccgcccgccgccatggccatggcctccaccacctccgccgcggcctccatgctgctctcgggatccatgcccagcgccgacggcaccaacagcttcctggcgcgcgccgtgctgccctgctcctccagcatggccaccatctccgcctcggcgccgttccccaccgtcacgctcgacctcaccacccacggcccgccgccgttccacctgccgcatgcgcagccgccgctctactcggacaaccactcctcctccaccaccaagttctccggcctgcacatgtcctcgtcggatacacaacatgcaccatcagcagcagacgcggcgacctgcaggccaccaccgccgatcgggatcgacgacaccgtcagcgccgcggcggccgccatcacagcggaccccaacttcacggtggcgctggcggcggccatcacgtccatcataggaggcggcggcggcggccatcatcatcaccaccacgggctgcagcaggccggcgccaacaacaacagcaacaacaacaatgtcacgagcagcagcaacgacacggcgaccagcaacaacaccaacagcgaaacccagtgaacacaacacacatttatatatctatatatcatcagattagtagcagctagctcaaattttgatgattttaatttgcattgccttgcattgcagcagcaaaagttgtattcattaattcattacgtcgtgtttaatttcttgctgattatatataaagtactctagagtttagttagcttctgcgtgcatgctgccaaggcaggcatgcatatgcagctaggtgttgatatatacgtacttcatataataaatacaatgcctgctactccttgtatatgtaataataacaggtcgactattctattc

SEQ ID NO: 25801 - protein, 457 aa, Panicum virgatum
  misc_feature: Ceres CLONE 1865078
  misc_feature (203)..(263): Pfam Name: WRKY Pfam Description: WRKY DNA -binding domain
  misc_feature: The sequence is a functional homolog of SEQ ID NO 886 in the 10/666,642 US patent application
  misc_feature: The sequence is a functional homolog of SEQ ID NO 154 in the 10/666,642 US patent application
  misc_feature: The sequence is a functional homolog of SEQ ID NO 236 in the 10/714,887 US patent application
  misc_feature: The sequence is a functional homolog of SEQ ID NO 236 in the 11/435,388 US patent application
  misc_feature: The sequence is a functional homolog of SEQ ID NO 1370 in the 10/666,642 US patent application
  misc_feature: The sequence is a functional homolog of SEQ ID NO 2246 in the 10/374,780 US patent application
  misc_feature: The sequence is a functional homolog of SEQ ID NO 256 in the 10/714,887 US patent application
  misc_feature: The sequence is a functional homolog of SEQ ID NO 256 in the 11/435,388 US patent application
  misc_feature: The sequence is a functional homolog of SEQ ID NO 670 in the 10/225,066 US patent application
  misc_feature: The sequence is a functional homolog of SEQ ID NO 90 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MSASADHPAGGSSSSLLRRRRSVEVDFFSDVGKDKEKMPDPPPSPPGGLGLAIKKEDLTINLLVPAATRRDHEDKKTIAVQQLPALQAELGRMNEENHRLRGMLAQVTTSYQELQMHLLALQMQQPTIPQQQPPPPSNNSSTEVVGSPRRSSSATGNNKDLRQAPDSPDAAAAGCLPAQGWQQEASMRKTRVSVRARSQAPIIADGCQWRKYGQKMAKGNPCPRAYYRCTMANACPVRKQVQRCAEDRSILITTYEGTHNHPLPPAAMAMASTTSAAASMLLSGSMPSADGTNSFLARAVLPCSSSMATISASAPFPTVTLDLTTHGPPPFHLPHAQPPLYSDNHSSSTTKFSGLHMSSSDTQHAPSAADAATCRPPPPIGIDDTVSAAAAAITADPNFTVALAAAITSIIGGGGGGHHHHHHGLQQAGANNNSNNNNVTSSSNDTATSNNTNSETQ

SEQ ID NO: 25802 - DNA, 1787 bp, Panicum virgatum
  misc_feature: Ceres CLONE 1865083
  misc_feature: Encodes the peptide sequence at SEQ ID NO. 25803
tattgttgccaggtgcacaaagcttccaactgggcgaagctcttgaggagatactgttacgaaacatggctcctctgactccaatagtggtagtgcccatagatgtgaaaaagcagccatgggagcaaaagattcctctccataaccgctggcatccagatatccctcctgttgctgatgtaactgaaggagaattgttccgcgttgagatggttgattggactggagggcgggttagggatgacaactctgcagatgatatcaaattccttgatctcacaattactcattatcttagtgggcccctaagaatagttgattctgaagggcttccagcttcacctggtgatcttcttgcagtagagatctgcaaccttggtccacttcctggtgatgagtggggttatactgcaatatttgaaagggagaatggaggtggattcttaactgaccactttcctagcgcaagaaaggccatttggtattttgaaggaatttatgcatattcccctcagataccaggtgttcgttttccaggattaactcatcctggtatagtaggaactgcaccatctgttgaacttcttaatatatggaatgaaagggagaaaaagttggctgagacaagtccagagactcttaaagtgtgtgaagttctacaccagaggccccttgctaatttaccgacccctgagaactgcttacttggaaagattcagaaagagacagctgtatggcacaaagtggcgaatgaagcagccagaactattcctggaagggagaatggtgggaattgtgacataaagaatctaagcagaggttccaaagtttatctaccagtatttgttgaaggagcaaatcttagtactggtgatatgcacttctcccagggcgatggtgaagtgtcattttgtggtgcaattgaaatgagcggattccttgagctcaagtgtgagatcataagaggtgggatgaaagaatacttgaccccagttggtccaacgccactacatgtgaatcctatctttgagataggtcctgtcgagccacgtttctcagagtggttagtatttgagggcatcagtgtggatgagtctgggaagcagcatttccttgacgcatcagttgcctacaaacgtgcagttctgaatgccatcgagtacctttccaaatttgggtactccaaggagcaggtatatctcttactatcatgctgtccatgtgagggtaggatatccggaatagtagattctcctaatgcagtggcaactcttgccattcctacagcaatattcgaccaggatataaggccaaaacacctgagagggagaccaggaccaaaattgataagacttccagatcttctgagctgctcaactgatggacaccttcctgtcatccaagaccaaagtggtagaagtgaaccctagagatgaatatgatctagaaattgatgagtatccttctacttatacatataaataatcatctttattgttccaacctgcaagaattaatcgtctatgtatgtggcctggaatccagaatgtagatctttaatttgtcaggcaatcatcatgtatgaggatagagacacccgagtgctgccatattttctatattgctacaaagttgtgctatgagtaatgtaagtaaattaatttcgctctctcaaagttttcttatttagggtggtgattcacgtcaaagtcactaaaggagagtggtactatgatccgtgtggccagcaaaagtagtaataccatgtcatcccttgaatgaatgat

SEQ ID NO: 25803 - protein, 454 aa, Panicum virgatum
  misc_feature: Ceres CLONE 1865083
  misc_feature (8)..(413): Pfam Name: FmdA_AmdA Pfam Description: Acetamidase/Formamidase family
  misc_feature: SWISSPROT Homolog: EC 3.5.1.49 Formamidase
MAPLTPIVVVPIDVKKQPWEQKIPLHNRWHPDIPPVADVTEGELFRVEMVDWTGGRVRDDNSADDIKFLDLTITHYLSGPLRIVDSEGLPASPGDLLAVEICNLGPLPGDEWGYTAIFERENGGGFLTDHFPSARKAIWYFEGIYAYSPQIPGVRFPGLTHPGIVGTAPSVELLNIWNEREKKLAETSPETLKVCEVLHQRPLANLPTPENCLLGKIQKETAVWHKVANEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPRFSEWLVFEGISVDESGKQHFLDASVAYKRAVLNAIEYLSKFGYSKEQVYLLLSCCPCEGRISGIVDSPNAVATLAIPTAIFDQDIRPKHLRGRPGPKLIRLPDLLSCSTDGHLPVIQDQSGRSEP

SEQ ID NO: 25804 - DNA, 1853 bp, Panicum virgatum
  misc_feature: Ceres CLONE 1865089
  misc_feature: Encodes the peptide sequence at SEQ ID NO. 25805
aaggttcatctgataataggtggtcctgggtagaggtgaagcatctgtctaaatgtctagtccaggcccttgatgctggtctggagcatgccctcttgggttctgtagtaactgtggacaggtatgcggccgctgagggtttctataagctagctatggcctatgcacctgttccagatcttcacattatgtggttgctgcacctgtgtgatgcacaccaggagatgcaatcatgggctgaagcagcacaatgtgcagttgctgtagctggtgtgatcatgcaggcacttgttggaaggaatgatgctgtgtggagcaaggagcatgtttcttcgctgcgtaagatttgccctatagtgagtgctgacgtttgtgcagaagcctctgcagctgaagttgagggatatggtgcatccaaactaacagtggattcagctgtcaagtatcttcaacttgccaacaaactctttgcacaagctgaactctaccatttttgtgcaagcatccaggaactcatcattcctgtgtataaaagcagaaggtcttatggacagctggccaaatgccatacatcactcacaaacatctatgagtcaattcttgaacaggaagccagtcctataccatttattgatgccacatactaccgagttggtttctatggtgagcgttttggcaagctcaataaaaaggagtatgtgtttagagagctgcgggatgtacgtcttggtgacattatggagaagcttagccatatatatgaggctaaaatggatggcaatcacaccttacacatcattccagactcgagacaagtcaatgctgatgaattgcaacctggtgtctgctatttacagatcactgctgttgatcctgtgagggaggatgaggacttgggtagcaggagggaaaggatcttttctttatctactggtactgtacgtgcacgtgtgtttgaccgttttctttttgacacaccattcacaaagaatggaaaaacacaaggtggcttagaagaccaatggaagagacgcacagtgcttcagactgagggttcatttcctgctttggtgaaccgcctgctagttaccaaatctgaatctctagagttctctcctgttgagaatgcgattggaatgatcgaaacaagaacagctgcattgagaaatgaactagaagaaccacggagttctgaaggcgatcaactaccaaggcttcaaagcttgcaaaggatactccaaggaagtgtggctgttcaggtcaacagtggagtgttaagtgtgtgcactgcattcttatccggtgagcctgcgaccaggctccgatcacaagaactgcagcagctcatcgctgcattgcttgaattcatggctgtctgcaagcgcgcaatcagagtgcatttcagattgataggcgaagaagaccaggaattccacacccaactcgtcaatggattccagtcactcactgctgagctgtctcactatatccctgctatactttcagagctatgatagtactgtagcaatctggaaattaggtagcatgtgaatggttgttcattctttcagtcaagatccccaccaaatgtccatatttccattagctttggttgtatagttctgagaactggaaattaactagtctttgcagttctgtaccgtttcgtagtactgagtcccgattttggagtgtaaagctggctaatccttagtgttatgtctacgtcaccgtgtctttcgttgcagtttgcccgctgtactagcaacgagtggacattttgacccccgttgtattttgctggtcttgtggcgtgatatatataatgcttggtgattctgttgtctctttct

SEQ ID NO: 25805 - protein, 503 aa, Panicum virgatum
  misc_feature: Ceres CLONE 1865089
  misc_feature (310)..(496): Pfam Name: Ded_cyto Pfam Description: Dedicator of cytokinesis
GSSDNRWSWVEVKHLSKCLVQALDAGLEHALLGSVVTVDRYAAAEGFYKLAMAYAPVPDLHIMWLLHLCDAHQEMQSWAEAAQCAVAVAGVIMQALVGRNDAVWSKEHVSSLRKICPIVSADVCAEASAAEVEGYGASKLTVDSAVKYLQLANKLFAQAELYHFCASIQELIIPVYKSRRSYGQLAKCHTSLTNIYESILEQEASPIPFIDATYYRVGFYGERFGKLNKKEYVFRELRDVRLGDIMEKLSHIYEAKMDGNHTLHIIPDSRQVNADELQPGVCYLQITAVDPVREDEDLGSRRERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 25806 - DNA, 632 bp, Panicum virgatum
  misc_feature: Ceres CLONE 1865100
  misc_feature: Encodes the peptide sequence at SEQ ID NO. 25807
agatgcgcaaacaccgaatcgccggaccggtcgctgccctgctcgccctcaccctcaccctcaccctctcgctcacccgcagcgcgcaagaggagccgcccatggccgaccgcgggccgctggctggcggcgtcacggacgcgccgcacaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcacgaattcaagcctgtggaagagagtgctagcgcttaaggatccctcgtcttccacatgcaattgctgcctgaaccgctaaacagacttgcagaataaggagctggattggatgtaatagctgtgtcattgtgagctccgttgtgtaatatcgtatgaacaccttgccctttgtgtaatatcatgaatgacagtgccctttgtgtataactaaataactgcgctgagttttcatcaaaaaaagttttcacccccaaccct

SEQ ID NO: 25807 - protein, 135 aa, Panicum virgatum
  misc_feature: Ceres CLONE 1865100
  misc_feature (42)..(130): Pfam Name: Cystatin Pfam Description: Cystatin domain
MRKHRIAGPVAALLALTLTLTLSLTRSAQEEPPMADRGPLAGGVTDAPHNDNDIHLQELARFAVDEHNKKTNALLEFEKLVKAKTQVVAGTMYYLTVEVKDGEAKKLYEAKVWEKPWENFKELHEFKPVEESASA

SEQ ID NO: 25808 - DNA, 572 bp, Panicum virgatum
  misc_feature: Ceres CLONE 1865103
  misc_feature: Encodes the peptide sequence at SEQ ID NO. 25809
aaacccgcctgcctgccagtgccatcccttggcttggcttccctctcctccgcttctcaccaggccagcagccattttatccgccgtcggctggtcccggtccctggttcgcgcgcgaggcggccgcgtggttcacgtgcgcgcggggttgggttgggatcatttgggtgcgttgcgtccggggtcggtggcggcgcgggagatgaagagcggcggcggaggaggaggagacgggggtgggggagggggcaggcaacaatggccgtgcgactactgcggggaggaggcggcggcgctgcactgccgcgcggacacggcgcggctctgcgtggcgtgcgaccgccacgtgcacgccgccaacgcgctctcgcggaagcacgtgcgggcgccgctctgcgcgggctgcgcggcgcgccctgccgccgcgcgcgtcggggccgaggcggcggcgttcctctgcgcggactgcctcgagggccgcggcgacgggggcgtcgcggtcgaggggttctcgggctgcccctcggcggccgagctcgccgcgtcgagggggctcaacctccgcggcgcgg

SEQ ID NO: 25809 - protein, 123 aa, Panicum virgatum
  misc_feature: Ceres CLONE 1865103
  misc_feature (17)..(64): Pfam Name: zf-B_box Pfam Description: B-box zinc finger
  misc_feature: The sequence is a functional homolog of SEQ ID NO 1704 in the 11/479,226 US patent application
  misc_feature: The sequence is a functional homolog of SEQ ID NO 2586 in the 10/374,780 US patent application
  misc_feature: The sequence is a functional homolog of SEQ ID NO 652 in the 11/435,388 US patent application
  misc_feature: The sequence is a functional homolog of SEQ ID NO 72 in the 11/375,241 US patent application
  misc_feature: The sequence is a functional homolog of SEQ ID NO 766 in the 10/225,066 US patent application
  misc_feature: The sequence is a functional homolog of SEQ ID NO 862 in the 10/412,699 US patent application
MKSGGGGGGDGGGGGGRQQWPCDYCGEEAAALHCRADTARLCVACDRHVHAANALSRKHVRAPLCAGCAARPAAARVGAEAAAFLCADCLEGRGDGGVAVEGFSGCPSAAELAASRGLNLRGA

SEQ ID NO: 25810 - DNA, 1145 bp, Panicum virgatum
  misc_feature: Ceres CLONE 1865106
  misc_feature: Encodes the peptide sequence at SEQ ID NO. 25811
actcccagcgcctcccattcccaaccgaacaatgccgcgtccaccggggctccccgcggcggcgctcccgctcctcctcctcctcctcctcgccgcggctccggcgcgggggcagcaggagtacgaggccaacaagcagaacgcctgctacgccaccaacgccagctccgtcctcggctacgtctgcaacgccaccacggcttccgcgcgggcctgcgactcgtacctcgtcttccgcgcctcgccgccgctctactcatccccggtctccatctcctacctcctcaacgcctccgtccccgccacggccgccgcgaccggcggcgtcccggcggtgtccccgctcccggcctccagcctcgtgctcgcccccgtcccctgcgcctgcacgcccggcggctacttccagcacaacgcctcctacaccatccagttcgccggcgagacctacttcatcctcgccaacctcacctaccagggcctcaccacctgccaggcgctcatcgcgcagaacccgctccacgacagccggggcctcgtcgaggggaacaacctcaccgtcccgctccgctgcgcctgcccgtccccggcgcaggccgccaggggcgtccgccacctgctctcctacctcgtcacctggggcgacgacgtcacctccatcgccgccaggttccgcgtcaccgcgcgggaggtgctcgaggccaacagcctcgatgccgaccagatcatattccccttcaccacgctgctcatcccgctcagggccccgcccacgccggacatgctcgcgtccccggcgccgccgccgccgccgccggccccgaccccgccctcgccgtcgggcggatcggggagcgggaagtgggtcggcgtcggggtcggcctgggttgcggcgctctcgcgctggctggaattctcggcctgctcctcttacgggcccggcggcggcggcagcagcggtttggggatggggaaaccggccgtcaggggaaggtggtcatcgacgtgtcctcgtcggcggagtacggcgcccttgcctcggggaagcagaccactaacacggcgacgtcctcgtcgtcgtcggcgacgaggtcgctggtggcgagcgacgttcgcggggccgtggaggccctgacggtgtaca

SEQ ID NO: 25811 - protein, 371 aa, Panicum virgatum
  misc_feature: Ceres CLONE 1865106
  misc_feature (199)..(242): Pfam Name: LysM Pfam Description: LysM domain
MPRPPGLPAAALPLLLLLLLAAAPARGQQEYEANKQNACYATNASSVLGYVCNATTASARACDSYLVFRASPPLYSSPVSISYLLNASVPATAAATGGVPAVSPLPASSLVLAPVPCACTPGGYFQHNASYTIQFAGETYFILANLTYQGLTTCQALIAQNPLHDSRGLVEGNNLTVPLRCACPSPAQAARGVRHLLSYLVTWGDDVTSIAARFRVTAREVLEANSLDADQIIFPFTTLLIPLRAPPTPDMLASPAPPPPPPAPTPPSPSGGSGSGKWVGVGVGLGCGALALAGILGLLLLRARRRRQQRFGDGETGRQGKVVIDVSSSAEYGALASGKQTTNTATSSSSSATRSLVASDVRGAVEALTVY

SEQ ID NO: 25812 - DNA, 654 bp, Panicum virgatum
  misc_feature: Ceres CLONE 1865106-R
  misc_feature: Encodes the peptide sequence at SEQ ID NO. 25813
cgcagctcacgcgccacgtcgtgggcacgcagggctacctcgcgcccgagtacctcgagcacggcctcatcacgcacaagctcgacgtgttcgccttcggggtcatcctcctcgagctgctctccgggaaggaggccgcgttcgcggacgccgagacgggcggggaggcgctgctctgggaggccgcggaggcggcgctggcggcgggcggcggcgagggcgtggaccgggccaaggtgcgcgcgttcgcggacccgcggctgcacggggactacccggtggacctcgcgctcgccgtggcggcgctggcgctgcggtgcgtggcgagggagccccgcgtgcggccggccatggacgaggtgttcgtctcgctctcggccgtgtacaactcgacgctggactgggatccatccgactacggcacctccggatcgtcgatggtcgggaggtagaagagattagcctatatagagcttaaagagcttaaaagattgcatagaattggggacgatttgggatcgagctgtgttattatggtagaaagaatgaggaaatgtatcatcgattcatcaatttgtgttacaattgctctaggggaaatgtaaaaaatcatctaccgaatatatccggaggccccgaattgattactagtac

SEQ ID NO: 25813 - protein, 149 aa, Panicum virgatum
  misc_feature: Ceres CLONE 1865106-R
  misc_feature: SWISSPROT Homolog: EC 2.7.11.1 Non-specific serine/threonine protein kinase
QLTRHVVGTQGYLAPEYLEHGLITHKLDVFAFGVILLELLSGKEAAFADAETGGEALLWEAAEAALAAGGGEGVDRAKVRAFADPRLHGDYPVDLALAVAALALRCVAREPRVRPAMDEVFVSLSAVYNSTLDWDPSDYGTSGSSMVGR

SEQ ID NO: 25814 - DNA, 2092 bp, Panicum virgatum
  misc_feature: Ceres CLONE 1865111
  misc_feature: Encodes the peptide sequence at SEQ ID NO. 25815
acgagtggcagcatggcgcacgaccgtgctgatgctgtgcatcactctcacttactggtagctcgcacctcgcagcggactgacgatctttgtccgctcctgctcgtccgtcactgatgactgatgatctttgtccaccactggccaccgtctcatgctgtcggctcttcgcttaaattcatcagcgtttcaagaatccaaagcttgtgattacagatcaacaaggtttaactaacatggagccggtgatggcaaggattcatctcgtattggtgctgtgcgtggcggccgcggcagcagcgctgatggcttctccgggcgccgccgccggcgagggcgcggcggcaacggcgcaggagctgcggcgaggcttctcggcaacccacgaccagtcctactcgcagttccagccggtgctcgccgaccccaccggcgccttcgcgctcggcttcctccgcgtcaacaccaccttgctggacctcgccgtcctccacctcccgtcggccttcccgctctggcgcgcgatccccgaccacccggcgccctggtccgcgccggcctccctctccttcgacggcggcctcgtcctcaccgaccgcgcggccaacaaggtgctctggtccgccgcctctgcctcggccggggaccgcgtcgtcctcctcagcacgtccaacctccaaatccagagcaccagtgctggtgtggtgtggcagagcttcgacaacccgtcggacactatcgtccagggccagaacttcacctccgcggcggcgctctacaccctcaaccggcgcttcgcgatgcggcttgggagcaactacttagcgctctacatcgagccgccgccgtcgggtggcgtcgccgccgccatgtacttcaagcacacggcgttggaggccaaggcccagatcgtgaccggcggcgggccgacctacgcgcgcgtggagcccgacggcttcctcgccatgtaccaggaggaggggccgcccgccgacgtgctctcgttcgacaccttcaaccgcggcgtccgtgccctccgccgcatgaccctggagcccgacggcaacctccgcgcctactactgggacggcacccggtgggccgccgactacaccgccatcaccgaggtctgcgagctccccaccacctgcggagcctacagcgtctgtgcgccgcccagcggcgggtgcgagtgcctggcgaacgccaccgacggttcgggctgcgccgccgccgccgcagggggcagcctgtgcggcacccctggcggggaggtcggcgggctgtacaggacggtgcggcggcagggcgtggagccggtgaacaaggagctgctggggttggagcacgcggcgtcggcgacggactgcgaggcgcggtgcgagcgcaactgcagctgctggggcgcggtgtacagcaacggcacgggctactgctacctcctcgactacccggcgcagctgctggtggggggcgacgagcgtaagcttggctacttcaaggtcaggagcctggaggaggcggccgggagcgggcggagcggcggcggcggcggcgcgagcggggtcaaggctgcgctgctcactgtcggcgtcgcggcggtggccggcgcggccgcgttcggggcgtacagggtgtgggacaggaggcgacgggctgccgcggacgcgaggcggcagctgggcgccgtcgacggcggactctcgccggggccatacaagaacctggggtccttcagctccgtcgagctcaccaactccttccggaggtagccaggtctgggatgcgaagttgtccaatagaccgtgcggccgccgggatctccccgccgtgaagggacgaggcgcagcgccggccaggcgctcgggtcggcgagaacggcggctatcagagttcagagagctgagaaggcaagcaaaggtggaagggcccaaccgaaatcgatttctcaatattgtatgaaaaagatttccacttcttgtcatgggctgattttctagagctgggcccaatatcaaatgaaggtgtccgtgtaaagcccaaagggcctccaagcattgttagcaagaacaaaaaccttacttgtggagtc

SEQ ID NO: 25815 - protein, 511 aa, Panicum virgatum
  misc_feature: Ceres CLONE 1865111
  misc_feature (89)..(203): Pfam Name: B_lectin Pfam Description: D-mannose binding lectin
MEPVMARIHLVLVLCVAAAAAALMASPGAAAGEGAAATAQELRRGFSATHDQSYSQFQPVLADPTGAFALGFLRVNTTLLDLAVLHLPSAFPLWRAIPDHPAPWSAPASLSFDGGLVLTDRAANKVLWSAASASAGDRVVLLSTSNLQIQSTSAGVVWQSFDNPSDTIVQGQNFTSAAALYTLNRRFAMRLGSNYLALYIEPPPSGGVAAAMYFKHTALEAKAQIVTGGGPTYARVEPDGFLAMYQEEGPPADVLSFDTFNRGVRALRRMTLEPDGNLRAYYWDGTRWAADYTAITEVCELPTTCGAYSVCAPPSGGCECLANATDGSGCAAAAAGGSLCGTPGGEVGGLYRTVRRQGVEPVNKELLGLEHAASATDCEARCERNCSCWGAVYSNGTGYCYLLDYPAQLLVGGDERKLGYFKVRSLEEAAGSGRSGGGGGASGVKAALLTVGVAAVAGAAAFGAYRVWDRRRRAAADARRQLGAVDGGLSPGPYKNLGSFSSVELTNSFRR

SEQ ID NO: 25816 - DNA, 637 bp, Panicum virgatum
  misc_feature: Ceres CLONE 1865115
  misc_feature: Encodes the peptide sequence at SEQ ID NO. 25817
ttcggtgcgggctgcgcgagcggtaccaaatcgaggcaaactctgaatactagatatgacccaaacaggggtcaaggtcggccagtgagacgatgggggatctcgtcttcttgggcgtcggcctccccttccagccaggaggaggcaggaggcaaggctcccataccctcttccatccctccctcctccccgggcgtcatgggcaccacgtacaagtgctgcctcatcttcaagcgccgcttccactcccgggacgcccccccgcccgacgacgtccgcgccctcttctccctccactccggcggcgggccccacatgggcgccgacggcctccgccgctacctcaacgcctcgggccacgaggaccccctggacgacgccgaggtggaccgcctgctccaccagatccgcctacagcagccgggccgcgcccgcctcccgcgcctcgcccgaccgctgcttgccctcgacgacttccaccgctacctcttctcccacgacctcaacccgcccatccgccacccgcaggtgcaccacgacatgtcccgcccgctatcacactacttcatctacacgggccacaactcctacctcaccggcaaccagctcagcagcgactgcagcgacgtccccatca

SEQ ID NO: 25817 - protein, 146 aa, Panicum virgatum
  misc_feature: Ceres CLONE 1865115
  misc_feature (25)..(111): Pfam Name: efhand_like Pfam Description: Phosphoinositide-specific phospholipase C, efhand-like
  misc_feature: SWISSPROT Homolog: EC 3.1.4.11 Phosphoinositide phospholipase C
  misc_feature: Useful for making plants with modulated water use efficiency
MGTTYKCCLIFKRRFHSRDAPPPDDVRALFSLHSGGGPHMGADGLRRYLNASGHEDPLDDAEVDRLLHQIRLQQPGRARLPRLARPLLALDDFHRYLFSHDLNPPIRHPQVHHDMSRPLSHYFIYTGHNSYLTGNQLSSDCSDVPI

SEQ ID NO: 25818 - DNA, 1821 bp, Panicum virgatum
  misc_feature: Ceres CLONE 1865116
  misc_feature: Encodes the peptide sequence at SEQ ID NO. 25819
catcatctttaagatttaccgatttgatccaagtcgcttctttttccccccctgaagttagcttcaacttgtgctctcctctggttcttccagatcactttttccgctaaagacatcgaattctccgagtggaagggcgatattctcgccgtcgcggtcacagagaaggatctgtccaaggattccgactccaaattcgagaatgccgtcttgaagaagctggacagccagctcagcggtctcctgtcggaggcggccgcggaggaagatttcacggggaaagccgggcaatcagtggttctccgcctcgcggggcagggtttcaagagggtgggtctgattggtcttggccagaacgccccttccactgccgccgctagccggggccttggcgaatctgtcgcatcagttgccaagtctgctcaagctagcagcgctgctattgttattgcctcccccagtgggatccaggaggagttcaagctaactgctgcagcagcaattgcttctggaactgtgctcgggttgtatgaggacaacagatacaagtctgaatcaaaaaaggtgcacctgaaacaggttgatattattggacttggttctggtccggaggtggatcagaaacttaagtatgccaccgatctttcttcgggcgtgatatttggtagagagcttgtgaactctcctgccaatgtccttacccctgctgtgcttgcagaggaggcatcgaagatcgcttctacatacagtgatgtgttcactgccacaatattagatgtggagaaatgcaaagagttgaagatgggctcctacttggcagttgctgctgcttcttctaaccctcctcactttatccacttgtgctacaaaccaactaatgggaatgtcaagagaaagctggctattgttgggaagggtctaacttttgacagtggtggctacaacattaagactgggccaggctgcagcatcgagctgatgaaatttgacatgggaggctctgcagctgtgtttggtgcagctaaagcgttgggtcaaatcaaacctcctggcgtagaggttcactttatagttgctgcctgtgaaaatatgattagtggcacaggcatgagacctggtgacattgtgactgcttctaatgggaagacaattgaggtaaataatactgatgcagagggaaggcttacccttgctgacgctttggtctatgcttgcaaccaaggtgttgaaaagattgttgatctggcaacactaactggtgcgtgcgttgttgcacttgggcctagcattgctgggattttcacaccaagcgatgagctagccaaggaggttaccgctgcttctgaggtatcaggcgagaagttttggagactgccactggaagacagctactgggaatcgatgaagtctggtgttgctgatatggtcaacactggcggtaggcagggcggttctattaccgctgctttgttcctgaagcagtttgttgatgagaaagtccagtggatgcacatcgacatggcagggccagtgtggaacgacaagaaacgcgctgccaccggtttcggagtctccaccctggtggagtgggtcctcaagaactcatcctgaacagccacaaactcatatgctttccgttttccaagctgggaccggtgaatggaggtgtaccatgttttttttttccctttgtgctactaccattttatagttgccacttgtaaactgcgagcaaagcggacggcgctcgtggcataccatgtgggtgtgtgtgatactgtgatagaataagcagaagggctggaacgccttgtgtgtcag

SEQ ID NO: 25819 - protein, 269 aa, Panicum virgatum
  misc_feature: Ceres CLONE 1865116
  misc_feature (1)..(262): Pfam Name: Peptidase_M17 Pfam Description: Cytosol aminopeptidase family, catalytic domain
  misc_feature: SWISSPROT Homolog: EC 3.4.11.1 Leucyl aminopeptidase
MGSYLAVAAASSNPPHFIHLCYKPTNGNVKRKLAIVGKGLTFDSGGYNIKTGPGCSIELMKFDMGGSAAVFGAAKALGQIKPPGVEVHFIVAACENMISGTGMRPGDIVTASNGKTIEVNNTDAEGRLTLADALVYACNQGVEKIVDLATLTGACVVALGPSIAGIFTPSDELAKEVTAASEVSGEKFWRLPLEDSYWESMKSGVADMVNTGGRQGGSITAALFLKQFVDEKVQWMHIDMAGPVWNDKKRAATGFGVSTLVEWVLKNSS

SEQ ID NO: 25820 - DNA, 636 bp, Panicum virgatum
  misc_feature: Ceres CLONE 1865129
  misc_feature: Encodes the peptide sequence at SEQ ID NO. 25821
acgaacgccacctcccctctctctctttctctctcctctggctcgtcctccctccgcttcttccccccttgttccattcccaacgaggcagcgactcgcccgcctgcctccctcgcaatcgcggccgcgcggaggcccgagcccgaaccctaaccctagcggcccgggctccgcctccggccgaggggggcgggcgcgatggggcagtgctacgggaaggcgggcgcgtcgtcgcgggccgaccaggacgacatcggcgggatggtcgcgccgccgtccccgctgccggccaacggcgcgccgcagacgccgccgcaccaggcgcaggtggccgcgcccggcacgccgaggcgccgcaagtccggatcgaccacgccggtgcaccagacgcccggggtcgcctggccgagcccctaccccgccggcggggccagcccgctccccgcgggggtgtcgccgtcgccggcgaggtcgacgcccaggaggttcttcaagcggcccttcccgccgccgtcgccggccaagcacataaaggccacgctcgccaagcggctgggcgggggcaagcccaaggaggggaccataccggaggagggcggcgtcgggcccggcgccgccggagcaggcgcggatggg

SEQ ID NO: 25821 - protein, 145 aa, Panicum virgatum
  misc_feature: Ceres CLONE 1865129
  misc_feature: SWISSPROT Homolog: EC 2.7.11.24 Mitogen-activated protein kinase
MGQCYGKAGASSRADQDDIGGMVAPPSPLPANGAPQTPPHQAQVAAPGTPRRRKSGSTTPVHQTPGVAWPSPYPAGGASPLPAGVSPSPARSTPRRFFKRPFPPPSPAKHIKATLAKRLGGGKPKEGTIPEEGGVGPGAAGAGAD

SEQ ID NO: 25822 - DNA, 670 bp, Panicum virgatum
  misc_feature: Ceres CLONE 1865129-R
  misc_feature: Encodes the peptide sequence at SEQ ID NO. 25823
agattgcagtttaagctgcttgaacctaaagatggatatgttccccttgacaactttcggatggttctgacaagatgtttgactgatgctatgagggaatcaagggttcttgagtttttgcatgcgttggaaccacttgcgtacagaaggatggacttcgaagaattctgtgctgcagcaataagcccttaccagcttgaggctttggaaaggtgggaagaaattgcaggaacagcttttcagcactttgaacaagagggcaaccgagttatatcggttgaggagttggcacaggaactaaatctcgcaccgactcattattccattgtgcaagactggatcagaaagtcagatggaaagctaaactttcttgggtttacaaaatttttgcatggtgtcaccatacggggctcaaatacaagacgacactaaatggttggaaattgtattcgattctaatttaaatcctatcattacattacatggccctgattgttgtgaccccttccctcttgtccttcttcttctgatcaatgatcattcttcctcctgtttgttatcttgccggttgttgtcatcatagcttttgtatagtacatgtaaagatccttgtaatgaaggcgaaatcatatggtttgctcaagaaatagtgtcgtgttcctttttggtc

SEQ ID NO: 25823 - protein, 143 aa, Panicum virgatum
  misc_feature: Ceres CLONE 1865129-R
  misc_feature: SWISSPROT Homolog: EC 2.7.11.1 Non-specific serine/threonine protein kinase
RLQFKLLEPKDGYVPLDNFRMVLTRCLTDAMRESRVLEFLHALEPLAYRRMDFEEFCAAAISPYQLEALERWEEIAGTAFQHFEQEGNRVISVEELAQELNLAPTHYSIVQDWIRKSDGKLNFLGFTKFLHGVTIRGSNTRRH

SEQ ID NO: 25824 - DNA, 1894 bp, Panicum virgatum
  misc_feature: Ceres CLONE 1865136
  misc_feature: Encodes the peptide sequence at SEQ ID NO. 25825
tccctctctctcttcctccatccggtacgatccatcccctcccccggtccaccctcgaccgagctccgacgactcggatggactgccctgctctgctccgggacgactcttcctgcgcgtgaccgccggccggtagttgccggaaggagcggcggatccgagtggtgatggtgatggccagcaccggcgtcaacatgccctgcagcgacaggaacgtcgtcccagcagcagcagcttcgtcgacgtcgtccttctcctccgccgcgggatgccggatgcgcagccggcggcgccgcctcgcgcccccgcccgtggcggccacggccgcggggtccagcgagggcgccagcgacgccgccggcccgagccgggagaagcgcgtccggccggcggcctccccggcttcgtcgtcgtcaccgtcagatcgggacagcgacggcgaggaagcggaagacgaagcagacgccgaggcggaggagctgcagccgccgccgctcccgcctgccgtgccgcagcttcccgcggccgcggcgcaggcgtggccggtggcgttcgggtccctgtcggtggcggggcggtcgcgcgacatggaggacaccgtgtcgctccgcccgggcttccacacctgggtcgacggctcgcccatgcacttcttcggcgtcttcgacggccatggaggattccatgtgtcagagctgtgccgggaccggatgcacgagttcctggccgaggagctcgcggcggaggaggccgacttggcgcagcgcctgcgccgccggcagcagcagccggaggccgcggcgggggaagggacgagcgccggctccggcgccggctcctgggcggtgaagcagcagcagctggaggaggagcgcgcgtggcgagcagcgctggagcggacgttccggcgcgtggacgcgatggcgtcgctggcgtgcgcgtgcggccgcatcgtgagcccgccgtgccgctgcccgctgtcggggaactcgggcatcgtcggctccaccgccgtggtggcgctcctggtccgcggccgcctcgtcgtcgccaactgcggcgactcccgcgcggtgctctgccgcggcggctccccgcccgtccagctctccgacgaccacaagccaaaccggccggacgagctggcgcggatccaggcggcgggcggccgggtggtgttcaacaacggccaccgcgtgcgtgggatcctcgccatgtcgcgcgcactaggagacaggatgctgcgtcctgaagtgatcgccgagccggagatcaccgtgacggaccggacgccggaggaccagtgcctgatcttggcgagcgacgggatgtgggacgcggtgcccaacgagatcgcctgctccgtggcgcggcaatgcctgcaggacgggaacccgggcggcggcgcggcagcggcggcaggtggcgagggggcgacggcggcagcaggcccggaaccggaggcccggtgctccaacgccgcctcactcctcgtcaggctcgcgttcggcagagacagctgggataacattagcgtcgtcgtcatcgatctgcagcagagggagtaaatttgcagcagagggagtaactgagtgagttatctaggctccctgaccaaactccctgtgattgagaggaggtgcagtggtctagactgaacttggaatgatctggttggttcttccgattctagattctagttgtcgttttctttatattgggagagaaagaaagtggatggaattaagattgctgtccgcaatgaaaagggaaaaaagaagcaagagcaattgtacatagtatatattttgctatatttttgcatgtacggtaccagtattctcatttaagcctggaggcttcaccgctggagaagagcattctgattagctgc

SEQ ID NO: 25825 - protein, 466 aa, Panicum virgatum
  misc_feature: Ceres CLONE 1865136
  misc_feature (127)..(455): Pfam Name: PP2C Pfam Description: Protein phosphatase 2C
  misc_feature: SWISSPROT Homolog: EC 3.1.3.16 Phosphoprotein phosphatase
MVMASTGVNMPCSDRNVVPAAAASSTSSFSSAAGCRMRSRRRRLAPPPVAATAAGSSEGASDAAGPSREKRVRPAASPASSSSPSDRDSDGEEAEDEADAEAEELQPPPLPPAVPQLPAAAAQAWPVAFGSLSVAGRSRDMEDTVSLRPGFHTWVDGSPMHFFGVFDGHGGFHVSELCRDRMHEFLAEELAAEEADLAQRLRRRQQQPEAAAGEGTSAGSGAGSWAVKQQQLEEERAWRAALERTFRRVDAMASLACACGRIVSPPCRCPLSGNSGIVGSTAVVALLVRGRLVVANCGDSRAVLCRGGSPPVQLSDDHKPNRPDELARIQAAGGRVVFNNGHRVRGILAMSRALGDRMLRPEVIAEPEITVTDRTPEDQCLILASDGMWDAVPNEIACSVARQCLQDGNPGGGAAAAAGGEGATAAAGPEPEARCSNAASLLVRLAFGRDSWDNISVVVIDLQQRE

SEQ ID NO: 25826 - DNA, 1215 bp, Panicum virgatum
  misc_feature: Ceres CLONE 1865138
  misc_feature: Encodes the peptide sequence at SEQ ID NO. 25827
agcgacgacatcgccaccagggggaggtgagagagatccccgagcgagcagagactgctactacaaaagtctcctccggctttgactcccccgactccatttgatggtcgcggggggaccgggagcgggagcggggagccggcggcgacgacgacgatgggcctctgcagctcctccaccgcggcggccgcggacgcgccccggcggcccggcggcgcggcggcggggaggagggagagggagaaggggcgcgggatcgtggcgtgcggcaagcggaccgacttcgggtacgacaaggacttcgaggcgcggttctcgctcggcaggctgctggggcacggccagttcgggtacaccttcgccgccgtcgaccgcgcgtccggcgaccgcgtcgccgtcaagcgcatcgacaagaacaagatggtccttcctgttgctgttgaagacgtaaagcgagaagttaaaatattgaaggccttacaagggcacgaaaatgttgtacatttttacaatgcatttgaagatgacaactttgtgtatatagtcatggaattatgtgagggtggtgaattacttgatcgtatattasccaagaaagatagccgttatagcgagaaagatgctgcagtaattgtccgacagatgctcaaggttgcagctgagtgccacctgcacggtttggttcatcgggacatgaaacctgagaacttcctattcaaatcaacaaaggaggactcacccctcaaggctacagattttggcctttcagatttcataagaccaggaaagcaattccgtgacattgtcggaagtgcctactatgtggcaccagaagtactcaagcgaaagtcagggccggaatctgacgtttggagtataggcgttattacctatattttgctgtgtggaagacggcctttctgggacaaaactgaagatggaatatttaaagaggtattaaaaaacaagccagattttcgccgcaagccttggccaaatattactccagctgcaaaggattttgtacaaaagttactagttaaggatccccgtgcaagactaactgctgcacaggcattatcacatgattgggtaagagaaggaggaaaggcatctgaaatacccttggatatatcagtattacataatatgcgacagtttgtgaaatatagccgtttcaagcaatttgctttaagggcattagcatctacacta

SEQ ID NO: 25827 - protein, 352 aa, Panicum virgatum
  misc_feature: Ceres CLONE 1865138
  misc_feature (53)..(313): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
  misc_feature (145)..(145): Xaa is any aa, unknown, or other
MGLCSSSTAAAADAPRRPGGAAAGRREREKGRGIVACGKRTDFGYDKDFEARFSLGRLLGHGQFGYTFAAVDRASGDRVAVKRIDKNKMVLPVAVEDVKREVKILKALQGHENVVHFYNAFEDDNFVYIVMELCEGGELLDRILXKKDSRYSEKDAAVIVRQMLKVAAECHLHGLVHRDMKPENFLFKSTKEDSPLKATDFGLSDFIRPGKQFRDIVGSAYYVAPEVLKRKSGPESDVWSIGVITYILLCGRRPFWDKTEDGIFKEVLKNKPDFRRKPWPNITPAAKDFVQKLLVKDPRARLTAAQALSHDWVREGGKASEIPLDISVLHNMRQFVKYSRFKQFALRALAST

SEQ ID NO: 25828 - DNA, 644 bp, Panicum virgatum
  misc_feature: Ceres CLONE 1865138-R
  misc_feature: Encodes the peptide sequence at SEQ ID NO. 25829
tgccattgacgttgacaaaaatggaacaattagcctggaggaattgaagcaggctcttgcaaaggatgttccgtggagattaaagggtcctcgtgttttagagattattgaggcgattgatagtaatacagatgggctagttgattttgaagagttcgtggcggcaacactacacgtgcatcagctggtggaacatgatactgaaaagtggaaatcattgtctcaagctgcatttgataaatttgacgtcgatggcgatggctatatcacatctgatgaacttagaatgcatacaggaatgaagggttctattgaccccctcctagaggaggctgacattgacaaagatggcaaaataagcctagacgaattccgcaggctcttgaaaactgcaagcatgagtgcgcgcactgtacaaactccgaggggcgtttgcgtgtcatagtttctcaattttcatagttcacttcactgaacaagggagcaggaaatggtgagatgtttttcggcgacacatgtaattgagaattgttgccggaaaggcttcttgatgtatgtaaggtatacaatcaatgcacatgaaatagggttgacctgtagttgttccttgatgtattactcctatgcaggagtgcacttcacac

SEQ ID NO: 25829 - protein, 147 aa, Panicum virgatum
  misc_feature: Ceres CLONE 1865138-R
  misc_feature (103)..(131): Pfam Name: efhand Pfam Description: EF hand
  misc_feature (73)..(101): Pfam Name: efhand Pfam Description: EF hand
  misc_feature: SWISSPROT Homolog: EC 2.7.11.1 Non-specific serine/threonine protein kinase
AIDVDKNGTISLEELKQALAKDVPWRLKGPRVLEIIEAIDSNTDGLVDFEEFVAATLHVHQLVEHDTEKWKSLSQAAFDKFDVDGDGYITSDELRMHTGMKGSIDPLLEEADIDKDGKISLDEFRRLLKTASMSARTVQTPRGVCVS

SEQ ID NO: 25830 - DNA, 478 bp, Panicum virgatum
  misc_feature: Ceres CLONE 1865152
  misc_feature: Encodes the peptide sequence at SEQ ID NO. 25831
gagtctagcagagccgggcggctactcctcactacccctgccgctccggtaggcacctctcctcgcggggagcacccgtggctgcttcgtcggcctcggtgctcgcccgccgcctcctcctctcccgccgcctcttctcctccccactcccccccttctccgtcgcctcgacacccgactcctcccccacgcttaacgggtccgacgccgactccgaccccaacctcgagcgcaaccgggccccgagggatcacgaccgccagaaggcgcccaacaacccgcgcccggccagcacctcccgccccctccacaaaggcctcgacagcggcatctacaacgcgataatggcggggaaggtcggggaggagccacatgcagaatcggttgctgtacgagaggaccgccacgctcttctcgcttggcaacagtggcatccgcaactaccgccgcccgctggaccgcgaggagccacaccaat

SEQ ID NO: 25831 - protein, 35 aa, Panicum virgatum
  misc_feature: Ceres CLONE 1865152
  misc_feature: Useful for making plants with altered alkaloid content
  misc_feature: Useful for making plants with altered terpenoid content
MQNRLLYERTATLFSLGNSGIRNYRRPLDREEPHQ

SEQ ID NO: 25832 - DNA, 591 bp, Panicum virgatum
  misc_feature: Ceres CLONE 1865183
  misc_feature: Encodes the peptide sequence at SEQ ID NO. 25833
attctcaccaagagttatcatcttcaatgatttcacattcatttggtgttgctgaaattgcattcaattccatagattcatcaatcaatgatactccattcttaaatacaaattcccggcctccacctcctgcacatcaacgaatacgaacctacacaaaggtgcacaagcgtggtgctgttggaagatctataaacatcaatcgatattccggatatgatgaactgaaacatgatgttgctcggatgcttggtatcgaggggcaactcattgaccaaaatagaggtggctggaagctcgtttatgaagatcacgacaaggatgttctattagttggagatgacccatgggaggacttcctgaactgcgtaccgtgcatcctaattctctctccgcaggaagaaatgcaaacgagattggccagtgactttggagacagctttctacccaaccaatcatgcagcacctcagatggggttcacccatggagggttagcagtgaccagaaagctgatactcgccaacttagattcactggtttgcatggccgatagatacatctgatggtgccacgggatggacatttttatc

SEQ ID NO: 25833 - protein, 183 aa, Panicum virgatum
  misc_feature: Ceres CLONE 1865183
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
SHQELSSSMISHSFGVAEIAFNSIDSSINDTPFLNTNSRPPPPAHQRIRTYTKVHKRGAVGRSININRYSGYDELKHDVARMLGIEGQLIDQNRGGWKLVYEDHDKDVLLVGDDPWEDFLNCVPCILILSPQEEMQTRLASDFGDSFLPNQSCSTSDGVHPWRVSSDQKADTRQLRFTGLHGR

SEQ ID NO: 25834 - DNA, 775 bp, Panicum virgatum
  misc_feature: Ceres CLONE 1865205
  misc_feature: Encodes the peptide sequence at SEQ ID NO. 25835
acaacaagctaatcacaagatgtcgaccaccatcggccgcctcgtgcttgcattggcggcgagcgtcctgctggtcaccttggcaggccgctgcagtggcgaagtcgacgccgatcatcaccgccagcgcgagctcgccgacgggtgccagccaagcggcacgctgcggccgaccaagggcggcccctcgtgcggcgagtgctgcaaggccgggcggacctacgcgacgtacgcgtgctcgccgcccgtcacggggagcaccagggccgtcatgacgctcaacgacttcgaggaaggcggtgacggtggcgacccatcggagtgcgacggtaggttccacaagaactcggagcgcgtcgtggcgctctccacggggtggtacgctaagggcatgcgctgcggcaagaacatacggatcagagccaagggcaagtccgtgctcgccaaggtcgtagacgagtgcgactccctccacggctgcgacaagccgcacgcctaccagccgccgtgccgccctaacatcgtcgacgcgtcccaggctgtgtgggatgcgctgggcatcaccggggacgacgtcggcgagtaccccatcacttggtccgacgcgtaagtcgaatggtcgtatgggatagactgcatgcatgctctttgccgcatcagcgtggctggtgttgtgtgcttctagtatgaaataaatcgttcatgcgtgccatgcaagatatggtatgttagattctccatgaataaaaatacaataaacttgcaagcattccag

SEQ ID NO: 25835 - protein, 196 aa, Panicum virgatum
  misc_feature: Ceres CLONE 1865205
  misc_feature (113)..(193): Pfam Name: DPBB_1 Pfam Description: Rare lipoprotein A (RlpA)-like double-psi beta-barrel
MSTTIGRLVLALAASVLLVTLAGRCSGEVDADHHRQRELADGCQPSGTLRPTKGGPSCGECCKAGRTYATYACSPPVTGSTRAVMTLNDFEEGGDGGDPSECDGRFHKNSERVVALSTGWYAKGMRCGKNIRIRAKGKSVLAKVVDECDSLHGCDKPHAYQPPCRPNIVDASQAVWDALGITGDDVGEYPITWSDA

SEQ ID NO: 25836 - DNA, 500 bp, Panicum virgatum
  misc_feature: Ceres CLONE 1865256
  misc_feature: Encodes the peptide sequence at SEQ ID NO. 25837
aaaaccctagccgccggtaccgtcctgattcctgaaccccttctctcctcttctccgctccgctcctcggccatcatccgggctcatcccgcgcgtggattcaagatgtatctccagtactacatcaacgagaagggggacaaggtctacacaaccaagaaggagtcgcctctaggtgtgccgacgcagtctgctcatccggctcgcttctcaccagatgacaagtactctcgccagcggtacctgttgaagaagagatttggactgctgccaacccagaagccagcaccaaagtactgaagtttcaactgtccaaccatatggatgttcaggagaatatcatctgtttcgcagcttgttggttgtaatgtagattagctatctgagaaaaaaaatcaaacactactaggcgctaccatggtatttctcagcacattcagatgctatgtaatgctattgacagatcgtgcttcctaatgttatgttactctttcggtctc

SEQ ID NO: 25837 - protein, 64 aa, Panicum virgatum
  misc_feature: Ceres CLONE 1865256
  misc_feature (3)..(53): Pfam Name: Nop10p Pfam Description: Nucleolar RNA-binding protein, Nop10p family
MYLQYYINEKGDKVYTTKKESPLGVPTQSAHPARFSPDDKYSRQRYLLKKRFGLLPTQKPAPKY

SEQ ID NO: 25838 - DNA, 692 bp, Panicum virgatum
  misc_feature: Ceres CLONE 1865270
  misc_feature: Encodes the peptide sequence at SEQ ID NO. 25839
acaaaaccgacaacgtgggggaagtcgttcagagctcccatcccatctccccgtcgatcgaactactcccgctcctccccaatctgcatagacgagcccgggctagcacgtcatcgtctttccctggtatcccatatccgatggagggaaccgctccgcgacagcgtagctccatgtgatgaattgttactgttatgggaccgagcaggggcggagcctctccactcgactactacatagttatggaagctgactatgatgcatcatatgactcgatcacattgacttatacaacattacctttgatgagcaatcccgataagcgaccgggggataatgatgcctcatctaaattttcggacattaatgacgcatactctgtttaaactgatgctgatcacctattataatatgacctttccggctgttatgagatctttcttgatagtttgcgtgagtacctaacgctatttgatggcatgatacatacctgcatatgtctcttgatatatatctctgctcacaatgggctcgacatttgagagaattgatacccctctgatcaatacgtacggatgtactatctctgatgctcatcatatgtactactgtactgtgatccatactctgcgaactgtcacatacaatggcactttgcgccgttctgccaaaagacatccatgtatacacta

SEQ ID NO: 25839 - protein, 63 aa, Panicum virgatum
  misc_feature: Ceres CLONE 1865270
  misc_feature: Useful for making plants with modulated heat sensitivity
MGPSRGGASPLDYYIVMEADYDASYDSITLTYTTLPLMSNPDKRPGDNDASSKFSDINDAYSV

SEQ ID NO: 25840 - DNA, 634 bp, Panicum virgatum
  misc_feature: Ceres CLONE 1865277
  misc_feature: Encodes the peptide sequence at SEQ ID NO. 25841
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaagaaggagaagaagcacggcgagggccaccacgacggtcacagcagcagcagcgacagcgactgatcgcctcgcggcgcgccgtgcttgccggtgaaaaaggtgcttggagaggactatctgccggaagctgtgtgatgtagtatgtttcacgagtgccatacgtgtgtgtgctaatcaagggagaaatgaaaaaaaaaaccttttatgttgatcaatgtactcctaatgatggctccacggtgctagcttgtaataaaatgttaatgcagaaattggtctgctggcttgtctttgacatgtattcacgggcatcatgcatactagtatttctttgctgtattgttc

SEQ ID NO: 25841 - protein, 91 aa, Panicum virgatum
  misc_feature: Ceres CLONE 1865277
  misc_feature (2)..(91): Pfam Name: Dehydrin Pfam Description: Dehydrin
MSGIIHKIEETLHMGGDHKKEEEHHKKDGEHKEGIVEKIKDKITGEHGDKSGEHKDDKDHKEKKDKKKKKKKEKKHGEGHHDGHSSSSDSD

SEQ ID NO: 25842 - DNA, 420 bp, Panicum virgatum
  misc_feature: Ceres CLONE 1865295
  misc_feature: Encodes the peptide sequence at SEQ ID NO. 25843
aaaccctagccgccgccggaccactcgtcgccctcctctcctccgcgagcgctcgcttcggaagcaagggattcgagatggccaagtcgaagaaccacacggcgcacaaccagtcgtacaaggcgcacaagaacggcatcaagaagcccaagcgccaccgccagacctccaccaaggggatggaccccaagttcctgaggaacctgaggtactcaaggaagaacaacaagaagagtggtgaggctgaagcggaggagtaagatggaagtttatgctcttagaaaagcaaagctgtgtttacccttcctagctcagtttttacctttaggatctggattttctttactctaaggatggaatttgaatggtgttatgtatgatgggaaggaccctcttttgctgctgaagtgttactatgat

SEQ ID NO: 25843 - protein, 60 aa, Panicum virgatum; identical to SEQ ID NO: 13919
  misc_feature: Ceres CLONE 1865295
  misc_feature (3)..(42): Pfam Name: Ribosomal_L29e Pfam Description: Ribosomal L29e protein family

SEQ ID NO: 25844 - DNA, 592 bp, Panicum virgatum
  misc_feature: Ceres CLONE 1865300
  misc_feature: Encodes the peptide sequence at SEQ ID NO. 25845
accacaccacccaggcacccagcgtcatctcatccccgtttgcccgctgcgagaattcctttcacctcacctcactctgagtctgagcgcgcggccgcactcaagcgagcgagcacgggcgaaatggcgcgccacgccgggaagcccctcctcgcgctcctcgtgctgtccggcctcctcctcctcccgctcgtcgcctccgtccccttgccaagaagcctgcgcctggggaacccgcagcagcacccgccggctctgaagcttgcttcttctcaggaggcggcgatggcggcgtggaacctcggcagcaggcaggcggcgaggatggccgtggaggtgaacgactaccaaccgtccggccccaacaaccgccatgacccgcccaagggtcccgggagagcgtgaacagtgggggggggggtggggggctggacccaaataaccctccatcttcttcgccactagtaagaagtgctagcttgcttgctagtagttagctcctgtatgctaaaatggaagcaaaaacaaaatcacctagtagttgcagaagggatccgggggccgatcggtgtctgtctatatgccgcccgtg

SEQ ID NO: 25845 - protein, 93 aa, Panicum virgatum; identical to SEQ ID NO: 18809
  misc_feature: Ceres CLONE 1865300
  misc_feature: Useful for making plants with modulated flowering time

SEQ ID NO: 25846 - DNA, 705 bp, Panicum virgatum
  misc_feature: Ceres CLONE 1865302
  misc_feature: Encodes the peptide sequence at SEQ ID NO. 25847
aagagagttttgtgtcaggtttggaatatttaaccctgcaatagtatatgaccacttgggggagatattctctgctcttgtttttggaagcttggtattctgtatttttctgtacataaagggtcatgtagctccatcttcatctgactctggatcatcagggaatctgataattgacttctactggggtatggaactgtaccctcggattggcaagtactttgacatcaaagtcttcacaaactgtcgttttggcatgatgtcctgggctgttcttgctgtaacctactgcataaagcagtatgaaatgaatggcagagtcgcagattctatgcttgtgaatactgcactgatgttgatctatatcactaaattcttttggtgggaatctggatattggtgtaccatggacattgctcacgacagaggtatacagctctattgtgggcttaagtgcaattgttttctcgctaaatgatatatgattattttatccactagctatcttttcatcgaaaattctgcatgcatgttcaatttgcttcacattgataatttttcttcttaaaaactaatgttcaatttgtttcacattgataatttttcttattaaaaaaagtgaaataagattctatttgaacaacattaacttcatgtgtggaagtgctcacataatgtaattacttgaatatggtcacaaaactg

SEQ ID NO: 25847 - protein, 158 aa, Panicum virgatum
  misc_feature: Ceres CLONE 1865302
  misc_feature: SWISSPROT Homolog: EC 1.3.1.21 7-dehydrocholesterol reductase
REFCVRFGIFNPAIVYDHLGEIFSALVFGSLVFCIFLYIKGHVAPSSSDSGSSGNLIIDFYWGMELYPRIGKYFDIKVFTNCRFGMMSWAVLAVTYCIKQYEMNGRVADSMLVNTALMLIYITKFFWWESGYWCTMDIAHDRGIQLYCGLKCNCFLAK

SEQ ID NO: 25848 - DNA, 651 bp, Panicum virgatum
  misc_feature: Ceres CLONE 1865306
  misc_feature: Encodes the peptide sequence at SEQ ID NO. 25849
ctgaagtaccacacgggacagaccagagcagcacagacgtcgccatggcctcccagctctccgccgccgcgtccatgtccgccgccgtgccgcagttccacggcctgcgtggctacgcctcgccccggtccgtggcggcgctgtcgccggcgagggccggcaggaagcgggcgcagggcatccggtgcgactacaacggctcggccaccaaccagatcatggtgctgtcgacgacgctgatgctggtcgcggggcggttcgggctggcgccgtcggcgaaccggaaggcgacggcggggctgaagctggagtcccgcgattccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccattgtctgccttgtctctctcgccgccggccggtgcccatgtaaccatgcatctcgtttcgtttcaatggacatagcttgttgcttcttttgccccccagagttatcaggttcagtacgttctttacattctttcgatcggtgcgagtttacagattttttttttaacaaaacagttcgaagtttcttc

SEQ ID NO: 25849 - protein, 137 aa, Panicum virgatum
  misc_feature: Ceres CLONE 1865306
  misc_feature (52)..(132): Pfam Name: PSI_PSAK Pfam Description: Photosystem I psaG / psaK
MASQLSAAASMSAAVPQFHGLRGYASPRSVAALSPARAGRKRAQGIRCDYNGSATNQIMVLSTTLMLVAGRFGLAPSANRKATAGLKLESRDSGLQTGDPAGFTLADTLACGAVGHIIGVGIVLGLKNTGALDQIIG

SEQ ID NO: 25850 - DNA, 690 bp, Panicum virgatum
  misc_feature: Ceres CLONE 1865311
  misc_feature: Encodes the peptide sequence at SEQ ID NO. 25851
gtgccctacccgaggatccacttcatgctttcatcctatgcaccagtcatctctgctgagaaggcctaccatgagcagctgtctgttgctgagatcaccaacagcgccttcgagccttcttccatgatggccaagtgtgacccccgccatggcaagtacatggcatgctgcctcatgtaccgtggagatgtggtgcccaaggacgtgaatgctgctgttgcaaccatcaagaccaagcgcaccatccagtttgtggactggtgccctactgggttcaagtgcggcatcaactaccagccacccagcgtggtgcctggtggtgacctcgccaaggtgcagcgtgctgtgtgcatgatctccaactccaccagtgtggttgaggtgttctcccgcattgaccacaagttcgacctcatgtacgccaagcgtgccttcgtgcactggtacgtgggtgagggcatggaggagggcgagttctctgaggcccgtgaggaccttgctgcacttgagaaggactacgaggaggttggcgctgagttcgacgagggtgaggaaggcgatgacggtgacgagtactagacgacgatatgcttcctgctattgtgtcagggccgtgtgccgcagttatcccgtgatctgcccgagtggctcgttcttatcctgttctgtgtgtccgtttgaacaatctgt

SEQ ID NO: 25851 - protein, 192 aa, Panicum virgatum
  misc_feature: Ceres CLONE 1865311
  misc_feature (1)..(134): Pfam Name: Tubulin_C Pfam Description: Tubulin/FtsZ family, C-terminal domain
  misc_feature: Useful for making plants with altered cell wall content and/or composition
VPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEEGDDGDEY

SEQ ID NO: 25852 - DNA, 625 bp, Panicum virgatum
  misc_feature: Ceres CLONE 1865315
  misc_feature: Encodes the peptide sequence at SEQ ID NO. 25853
taagctgaatggatataccccgccaaataaagaggactgtggacagccaggattcaccctagcagagaggcatcgattttgcaacatattgtcccaaggaaagctgatagatgcttatagacacctgcataaagaaaaagatatggacagtggcttctcctggtccggtcatccaattggcaagtaccgaggaaagagaatgaggattgactatttcattgtttcagaacaattgaaggacagaataatttcatgtgaaatgcatggccgtggaattgaattagaaggattctatggaagtgaccactgccctgtttcccttgagctctccaaagcagcaacggaagcgccagaaccccccaggccatccagctaaaatttgtgtgctgctatcttgacctgtcactcgtcatggtagttattagggttgttgagtagactagtattgggcccagagatgaccattgtttagacattttccttcagtaaatctgaatttgcaattcatgctcgtgctgggatatgtttgtatttatgatctagcagactactagtactaatgctcgaacactagagcttaggtaccattggcccattgccatttaagcaatgcagcttcgccatc

SEQ ID NO: 25853 - protein, 124 aa, Panicum virgatum
  misc_feature: Ceres CLONE 1865315
  misc_feature: SWISSPROT Homolog: EC 3.1.11.2 Exodeoxyribonuclease III
KLNGYTPPNKEDCGQPGFTLAERHRFCNILSQGKLIDAYRHLHKEKDMDSGFSWSGHPIGKYRGKRMRIDYFIVSEQLKDRIISCEMHGRGIELEGFYGSDHCPVSLELSKAATEAPEPPRPSS

SEQ ID NO: 25854 - DNA, 704 bp, Panicum virgatum
  misc_feature: Ceres CLONE 1865329
  misc_feature: Encodes the peptide sequence at SEQ ID NO. 25855
cagatcgatcgagcaccccaaacttgcacacaatcaccatcagttctagtagacaagacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgagaagcgccttgggcttcaaccagcatgcactgctgcctgaagggcaaacaatctagttgtacagctaacagttgctaggtttgcgctcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgtgcaagctgctgtaaagaggaggaagatggaggggagtaagaagcacgtttattaatctgctgctgtacaaattaaatttagcactagagtgagagaaagtaagctgttagctgtctaaaagaaaagccgaagccattggccctctggttgtatctgttgatatagtagtggcttcctgttg

SEQ ID NO: 25855 - protein, 87 aa, Panicum virgatum; identical to SEQ ID NO: 18987
  misc_feature: Ceres CLONE 1865329
  misc_feature (12)..(71): Pfam Name: potato_inhibit Pfam Description: Potato inhibitor I family

SEQ ID NO: 25856 - DNA, 738 bp, Panicum virgatum
  misc_feature: Ceres CLONE 1865339
  misc_feature: Encodes the peptide sequence at SEQ ID NO. 25857
acgccagtgaaaaatccgcttgcatcacgagcacactgaaacagagtagaggagcgatctttgctgttgtttcccatggcgaccgcggctgaggaagctgcaccggccgttgccgttgcgccggcgccggagaaggtggctgaggtgaaggaggcggccgctgtggagacgccggagaaggtggaggaggcgccgaaacctgcggagggggaggggaagaaagcagaggatggggaggagaagaaggcagaggcggggaagaaggcgcggaagccgcgcagcaggaagcccaagtccgccgggccgcaccacccgccctacttcgagatgatcaaggaggcgatcctgtcgcaggacggcaaggcgggggcgagcccgtacgcgatcgccaagcacatggaggagaagcaccgggacgttctcccggccaactaccgcaaggtgctggccgtgcagctgcgcaacttcgccgccaagggtcggctcgtcaaggtcaaggcctccttcaagctcgccgcggccgaggagaagaaggccgcctccgccacgaaggcgaagccaacgccggcgccggcggctgcggctcccaagcgcaagaggaccgcggtccccgccgcggccgccaagaagaagccggcggcccccgcggaggcgaagaaggcgcgcgcgaagcgggcgaggaaggcggccccggcgccggcgcagccgatgccgaagccgaagcagcagcagaccagg

SEQ ID NO: 25857 - protein, 220 aa, Panicum virgatum
  misc_feature: Ceres CLONE 1865339
  misc_feature (78)..(148): Pfam Name: Linker_histone Pfam Description: linker histone H1 and H5 family
MATAAEEAAPAVAVAPAPEKVAEVKEAAAVETPEKVEEAPKPAEGEGKKAEDGEEKKAEAGKKARKPRSRKPKSAGPHHPPYFEMIKEAILSQDGKAGASPYAIAKHMEEKHRDVLPANYRKVLAVQLRNFAAKGRLVKVKASFKLAAAEEKKAASATKAKPTPAPAAAAPKRKRTAVPAAAAKKKPAAPAEAKKARAKRARKAAPAPAQPMPKPKQQQT

SEQ ID NO: 25858 - DNA, 721 bp, Panicum virgatum
  misc_feature: Ceres CLONE 1865359
  misc_feature: Encodes the peptide sequence at SEQ ID NO. 25859
tggaagaagacaagctccccgctcctccaacctcgtagccctctcctgatcctcctcttcctgacagcagtagccatggcggccgagccggagcagaacgcggcccccgcggcggcggcgcaggaggcggccgtgcacatcgtgtacgtggaccgccccgagggcgccgacccggaggagttccacctccgcaccctcacccccgtcctcggcagcgagcagaaggccaaggacgcggtgctctaccactacaagcacgccgccagcgggttctccgcgaagctcaccccccagcaagtcgaggagctaaagaagcaaccatgtgttcttcaggttgtgccgagccagacctaccatctccatggacctgaatctggcactcacctgggcacgacgcgcaccatgggccttatgtgaaggcataaccgagaggactctgttctagtacggcagcggcctcactagtgaatgtacaatatataaataagagatgtatcgaatgtacctacttctacacaggttcaggcctgttttgaagtgtgtaatgctgtgttgcgtactacatgtttgcttaatgcaatggcagacgactatattatctagattcaaaagaccttttatgaatctagaagtgcacacaacctatttgccttttgaggagctttggtggatcttctcatgtcagattaaatttcgaaataaatagatcatgaatttgact

SEQ ID NO: 25859 - protein, 113 aa, Panicum virgatum
  misc_feature: Ceres CLONE 1865359
  misc_feature (19)..(96): Pfam Name: Subtilisin_N Pfam Description: Subtilisin N-terminal Region
  misc_feature: SWISSPROT Homolog: EC 3.4.21.25 Cucumisin
MAAEPEQNAAPAAAAQEAAVHIVYVDRPEGADPEEFHLRTLTPVLGSEQKAKDAVLYHYKHAASGFSAKLTPQQVEELKKQPCVLQVVPSQTYHLHGPESGTHLGTTRTMGLM

SEQ ID NO: 25860 - DNA, 599 bp, Panicum virgatum
  misc_feature: Ceres CLONE 1865391
  misc_feature: Encodes the peptide sequence at SEQ ID NO. 25861
gaaccagcagtacaagaagcacaagaaaaaacacttgtagccatcaacttcttcttcttcttcttcaccgtcatcaactcatcatcagctcagaccgtgagtggaatcccttgccttaatttttttacaatttctttgtacacgtatatagctacatgtttttgactgcaaataaagcatcgatcgatccgcagctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaattaaaggtgaataaagcatcgattgtgtgtagccttac

SEQ ID NO: 25861 - protein, 74 aa, Panicum virgatum; identical to SEQ ID NO: 18697
  misc_feature: Ceres CLONE 1865391
  misc_feature (15)..(74): Pfam Name: potato_inhibit Pfam Description: Potato inhibitor I family

SEQ ID NO: 25862 - DNA, 648 bp, Panicum virgatum
  misc_feature: Ceres CLONE 1865398
  misc_feature: Encodes the peptide sequence at SEQ ID NO. 25863
atccgcgtcccccgcgcgatcgatcggccgccgtcgccgccctccccagcgagccagccatggccgagatcgccgagcgggccgccgcgggcgagctgccggcggcgatgtcgggcaggggcaagggcggcaaggggctcgggaagggcggcgcgaagcgtcaccggaaggtgctccgcgacaatatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagaccgtcacagccatggacgtcgtctacgcgctcaagcgccagggccgtaccctctacggcttcggcggctaggttaggggtctgtcgttgtggttcggttccatgggtagccttatcgccttacatgttttccggtagttgctgtagcgagtagtagctggttgcttggtccctttggcgtcggctgtgtcgatgtaagaaccgctggttcgaagcaattggtctggatgcaggatgctgatgtaggaaatctgcagttcactttcaattgttattctacgaatactgtttgtctcgaagt

SEQ ID NO: 25863 - protein, 103 aa, Panicum virgatum; identical to SEQ ID NO: 12044
  misc_feature: Ceres CLONE 1865398
  misc_feature (25)..(94): Pfam Name: Histone Pfam Description: Core histone H2A/H2B/H3/H4

SEQ ID NO: 25864 - DNA, 1024 bp, Panicum virgatum
  misc_feature: Ceres CLONE 1865425
  misc_feature: Encodes the peptide sequence at SEQ ID NO. 25865
actcctcttccgacacgagtacacgtcacgagctaggagtagctgctcgctgcggctcgcctcgcgctccgaccggcttccggcggccatggcgatgagcgacaccggctcgagcttcgcgcaatgggccgagctctaccaccacgaccccaccccgggcctgcccgccgccgccgcgttgagcccgccgacctcgggcgggtccggcgggagcccgaccaaggcggcccgccgccagcagcagcagcagctgggcgtcgacgggccccgggccgggaagccggcgcggaggcggtcccgcgcgtcgcggcgcgcgcccgtgacgctgctcaacacggacacggccaacttccgcgccatggtgcagcagttcacgggcatccccgcgccccccgccggcgcgttcggggccggcccggtcatcagcttcgccggcgactacggcttcccgccgccgccctcgggcgtcatgtccttcgaccacctccaccggagccacccccacgggccggcgccgctcccggaccagctgatccgcacgcagacgcagtacaccggcggcgcgttcggctacagcagcagcagcctcctgcacggcgccggcggcgacctgttcgcctccccccacgagctcgcgtcggcggccgaggaccggatgctcctgcagagcatccggcaggcggcggcccaccacatgccgccgccggcgtccgcagctaacgccagcgctaatggcttcttcgcctgagcaagcaagccgatcaagatgcccgcgtccttgcgacgtgcatggaagacagagaccagatcatggccggagaggcgaagacaaaggattaacataaaaaagaagaagaacaagttcagtcaggatcgaaagtttttttcttggcgtgtgatgtttacttgtttaggttcctcctccgcttgttcaattagttcatgcagctccgtttatcggctgcggaggttgtaaatgtcttgttaattttgtggtcactctcatggagattagttctcatcc

SEQ ID NO: 25865 - protein, 219 aa, Panicum virgatum
  misc_feature: Ceres CLONE 1865425
  misc_feature (74)..(104): Pfam Name: VQ Pfam Description: VQ motif
MAMSDTGSSFAQWAELYHHDPTPGLPAAAALSPPTSGGSGGSPTKAARRQQQQQLGVDGPRAGKPARRRSRASRRAPVTLLNTDTANFRAMVQQFTGIPAPPAGAFGAGPVISFAGDYGFPPPPSGVMSFDHLHRSHPHGPAPLPDQLIRTQTQYTGGAFGYSSSSLLHGAGGDLFASPHELASAAEDRMLLQSIRQAAAHHMPPPASAANASANGFFA

SEQ ID NO: 25866 - DNA, 988 bp, Panicum virgatum
  misc_feature: Ceres CLONE 1865436
  misc_feature: Encodes the peptide sequence at SEQ ID NO. 25867
agacgacgagctcgctgccctccagcagcgagcgctcctcgagctcggcgccgcagacggaggaggccagagaagggatggagagcgacgaggagatcgggcgggtgccggaggtcaggctggagctgggcggcccgtcgacgtccggcagggagaccgccgccgcgggcgccgctgccgggacgtcgtccgaggcccaggcggccagcgccgccgcccgccgccgcgtccgcagcccggccgacaaggagcaccgccgcctcaagaggttgcttcggaaccgggtgtcggcacagcaggcgcgggagaggaagaaggcgtacctgagcgagctggaggtgagggtgaaggacctggagaagcggaactcggagctggaggagaggctctccacgctgcagaacgagaaccagatgctcagacagatcctgaagaacaccactgtcaacagaagagggccgagtggcggtagcagcgccggtggagacagccaatagctgacctctgcatgcaagaccgggaggaaatggtcgcgtttggagtttggagaaggaagcagctagcagcagcagggaactacctcctgactagggatgaaaatgatgggaacggtcagaaccgtattacaatacgaaaaacaaaaatggtcaggtcggaatttttctgtatttatgaaattaacaaaatcagatatggagaaaaataattataaaattaattataaatgataacagtagggaacaatatcataatacggaaaacgatatcggttggtacgaaagtttccatcccactttcacccctactcctgagtcctgacgagagcccattcacctggttgatcaagcttgttgtttaggtgaaaaatcttctgtcatgctgggaccgtgctgcatctgcaggtgttcagcccggctctggaacttctctatatgtatgtaacagcgtccttgtatggccgcctttgccaacatgtagtaattcattc

SEQ ID NO: 25867 - protein, 164 aa, Panicum virgatum
  misc_feature: Ceres CLONE 1865436
  misc_feature (81)..(144): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: Useful for making plants with altered alkaloid content
  misc_feature: Useful for making plants with altered terpenoid content
TTSSLPSSSERSSSSAPQTEEAREGMESDEEIGRVPEVRLELGGPSTSGRETAAAGAAAGTSSEAQAASAAARRRVRSPADKEHRRLKRLLRNRVSAQQARERKKAYLSELEVRVKDLEKRNSELEERLSTLQNENQMLRQILKNTTVNRRGPSGGSSAGGDSQ

SEQ ID NO: 25868 - DNA, 879 bp, Panicum virgatum
  misc_feature: Ceres CLONE 1865446
  misc_feature: Encodes the peptide sequence at SEQ ID NO. 25869
caatctttggccaactgttggtcacgctgccagcaatgcattccactatcgtctttgtatgcataaagtatatccccgtcccatatgtcccgcttgaagagaggttcttgttccgaagggttggccagaaggactaccacatgttccgctgcgtcgcacgctatggttataaagatgttaggaaggaggatcatggcttctttgagcagcttctggtcgagagtcttgagaaatttctgaggagggaagcccaggaaatcgcacttgagacaagcacaatggaggctgagcgtgatgacatatctgttgtatctgaggtgcctcagtctcctgcttgtggaggtgatctgcaaactccactgctttctgatcagagatctgttgatgacaacagaatgggcaccagagatgatagtgctcctgtgcttccctccagttccatgtctgcagaagaagaccccgcgttagagtacgagctggaagctctgagagaagccatggcatctgggttcacatatctcgtagctcacggtgacgtgagggcaaggaaggattcattcttcacgaagaagtttattatcaactatttctacgcgttcttgaggaggaactgcagggctggcactgcgaccctgaaggtcccccacttgaacatcatgcgtgtcggtatgacatacatggtttgatgccacaagactgaaccttaagtctttagttgtttgtatgatatctgtggagactgtatctgtatgagcagctatgtttctgccatcatctcttgtatgtatcctagcactccttgcatttgttgacccttcaaataatgcagtgggggcaaatgccaaatattgggcctggcctccacmtgctasgttgtac

SEQ ID NO: 25869 - protein, 227 aa, Panicum virgatum
  misc_feature: Ceres CLONE 1865446
  misc_feature (1)..(227): Pfam Name: K_trans Pfam Description: K+ potassium transporter
IFGQLLVTLPAMHSTIVFVCIKYIPVPYVPLEERFLFRRVGQKDYHMFRCVARYGYKDVRKEDHGFFEQLLVESLEKFLRREAQEIALETSTMEAERDDISVVSEVPQSPACGGDLQTPLLSDQRSVDDNRMGTRDDSAPVLPSSSMSAEEDPALEYELEALREAMASGFTYLVAHGDVRARKDSFFTKKFIINYFYAFLRRNCRAGTATLKVPHLNIMRVGMTYMV

SEQ ID NO: 25870 - DNA, 723 bp, Panicum virgatum
  misc_feature: Ceres CLONE 1865455
  misc_feature: Encodes the peptide sequence at SEQ ID NO. 25871
aaaaaccctaacccccaaatcggatcccgccgccggagagcggaacccgcccccgggccgccatggagatgggagcgatgagcgacgcggagcggatgttcttcttcgagctcgcctgcaggaacgccgaggccgcgtacgagcagaacccgctcgacgccgacaacctgacgcggtggggaggcgcgctgctggagctgtcgcaggtgcggaccggccctgagagcctcaagagccttgaagatgctgaatccaagctggaggaggcactgaaaattgatcccatcaaggctgatgcactctggtgcttgggaaatgctcagacatctcatggattcttcactccagatacagagaaggcaaatgagtactttgtgaaggcagccgagtgtttccagaaggctattgatgtggaacctgcaaatgatctgtacaggaagtctttggacttgtcagctaaggcacctgaactgcatttggagatccataggcaaatggcttctcaagcggcagcgacacaagcaccctcagcctcaaatccaaggcaatcaaggaagaagaagaaggatactgacttctggtacgatgtttgtggatgggtgatccttggtgttggcatttttgcttgggttggaatggccagagcaaacatcccccctccaccgccgccagccaggtgaactgggtgcgcctcccacagaaccttgcaaatggcctgcttat

SEQ ID NO: 25871 - protein, 205 aa, Panicum virgatum
  misc_feature: Ceres CLONE 1865455
  misc_feature (9)..(202): Pfam Name: TOM20_plant Pfam Description: Plant specific mitochondrial import receptor subunit TOM20
MEMGAMSDAERMFFFELACRNAEAAYEQNPLDADNLTRWGGALLELSQVRTGPESLKSLEDAESKLEEALKIDPIKADALWCLGNAQTSHGFFTPDTEKANEYFVKAAECFQKAIDVEPANDLYRKSLDLSAKAPELHLEIHRQMASQAAATQAPSASNPRQSRKKKKDTDFWYDVCGWVILGVGIFAWVGMARANIPPPPPPAR

SEQ ID NO: 25872 - DNA, 692 bp, Panicum virgatum
  misc_feature: Ceres CLONE 1865471
  misc_feature: Encodes the peptide sequence at SEQ ID NO. 25873
aatcgagcaccctccaatcttcaaggcgtcgcagcaggcaaggcatcgatcgatcaatcaccagcagcgcgtgccgcgtagagagatcgagagagagagagagagagagagagagagagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcctgcgcggcctcggggaggccgccaccgtcgcccagtgccgccgcatgatccagggcgtcgaccgcaacggcgacggcctcgtctccttcgacgagttcaagctcatgatggccgccggcggaggcttcggcaggatggcctcctcctcttcttaggcactcatctgtttgggcaagatcactgctcggctctgctcccacaaattggattcgttcgttgaattgcactgtacatacgtaacagcgagatcgaagagatcatcgccaccaaaccaaagtaattactagtact

SEQ ID NO: 25873 - protein, 184 aa, Panicum virgatum
  misc_feature: Ceres CLONE 1865471
  misc_feature (145)..(173): Pfam Name: efhand Pfam Description: EF hand
  misc_feature (109)..(137): Pfam Name: efhand Pfam Description: EF hand
  misc_feature: SWISSPROT Homolog: EC 2.7.11.1 Non-specific serine/threonine protein kinase
IEHPPIFKASQQARHRSINHQQRVPRREIERERERERERERERSLTGEGRNRHRHRHRHGQGPLLLLPQRQARRRPVLAVLLRDGAISLPEFAALVRSADADADAVEEDLRHAFMVFDADGNGLITPAELARVLRGLGEAATVAQCRRMIQGVDRNGDGLVSFDEFKLMMAAGGGFGRMASSSS

SEQ ID NO: 25874 - DNA, 601 bp, Panicum virgatum
  misc_feature: Ceres CLONE 1865479
  misc_feature: Encodes the peptide sequence at SEQ ID NO. 25875
ctagcgcagcacccgcacacccccgccgcctgcccagccgcaggaagggggaggaggaggaggaggaggaggaagatgccggcgggtcccgggctgcggtcgcggacccgcgatctgttcgcgaggccgttccgcgagaaggggtacctcccgctcccgacctacctccgcacctacaacatcggcgactacgtcgacctccaggtgaaccgcgccgtgcacgagggcatgccgcacaagttctaccacggccgcgccgggcgcgtctgaactgtcacccagcgcgccatcggcgtcgagatcaaccctcacgttaatggacgcatcatcagcaagcggatccatgtccgtgtcgagcatgtgcagccatccggatgcaccgcagagttccgcctgcggaaggcctagagcgaccatctcacggcggatgcctaggcccgtggtgaggtgatcagcacccagaggcagcccttgcgtcctaagcctggcttcatggtcgagggtgctaccattgagacactcactcctattccttatgatgtggtcaatgacctctagggtggttactatagagaacggttgtatcttgatcagttcacgc

SEQ ID NO: 25875 - protein, 64 aa, Panicum virgatum
  misc_feature: Ceres CLONE 1865479
  misc_feature (2)..(64): Pfam Name: Ribosomal_L21e Pfam Description: Ribosomal protein L21e
  misc_feature: Useful for making plants with modulated flowering time
MPAGPGLRSRTRDLFARPFREKGYLPLPTYLRTYNIGDYVDLQVNRAVHEGMPHKFYHGRAGRV

SEQ ID NO: 25876 - DNA, 693 bp, Panicum virgatum
  misc_feature: Ceres CLONE 1865488
  misc_feature: Encodes the peptide sequence at SEQ ID NO. 25877
cgacggcagccaaaactgcacgggatatttcccttgtccgctcggctgggcacgtcgactccaaagcgaagcgaagcgaggaaaaggcagtagaactgagccccgaggagtaggaggatgagcaccatggccgtggcgtcgtcgtcgctgaacccgaacgcgccgcttttcatcccggcggcgtaccggcaggtggaggacttctcgcccgagtggtgggagctcgtcaagaccaccgcctagttccgcgaccactggttccgccagcaccagctccacgaggcggcctacgaagccgccgccttcggcctccccgacgacgccgacgtcgacgtcgccgcgctcctccccgacgactccgtcgacctgctcgacaccgacgacctcttctacgcgcccgaccaccacgtcgccaagcccgccgggtacgacctcgacgtgctcagggcggtcagcctcggctccccgagggccgtcgtcggctcaccgtcgccgcgcgcccagcagcagaggcacgccgacaagccggcgcaccacgtcggcgtcaggggcgccgcgcgccgcgtcatccaccagcctcgctagaagcctttcctcgtcccatggcgacccacgatggctgctgcggctgctgctgtctagtgtaacatcaagtctaagctctgtttctgtttctgtgtatacgtacgacta

SEQ ID NO: 25877 - protein, 41 aa, Panicum virgatum
  misc_feature: Ceres CLONE 1865488
  misc_feature: Useful for making plants with modulated water use efficiency
MSTMAVASSSLNPNAPLFIPAAYRQVEDFSPEWWELVKTTA

SEQ ID NO: 25878 - DNA, 735 bp, Panicum virgatum
  misc_feature: Ceres CLONE 1865489
  misc_feature: Encodes the peptide sequence at SEQ ID NO. 25879
atagccccaccagcaggcagaaggcggccccaccaagcagccccaaattccccccttcccgactccaaatgtcttcctccgagctcgtgctctacaacctggtccccgccccccaaaccctaaaccctccccaaccccacgccgccgccgccgccgccgccgtcgccttctccggcgacctctccatctccaccaccgtcgctccgccgccacaggagcctctccgcgtccggacgcgccgcccggtggggtcctccgccgaccgccacgccaaggtcgccggccgcggccgccgggtccgcatcccggccatggtggcggcgcgcgtcttccagctcacccgcgagctcgggcaccgcaccgacggagagaccatcgagtggctgctccgccaggccgagccctccatcatcgccgccaccggcacgggcgtcactcccgaggaggcgccccccgctcccgtccctgtctcccccgttgcggccaccgcgtccctgatgcccgtaccatactacactgcgctcctcatgcagccaccgccaaccaccgattccgcatctggctctggcaccgccgcacaggagaataataactaggctaggtagaagacggcggttactatggttaggactctaatgttagttattagtttagatttcttatgtgtgtgtgctctgtagccatggcaatggcatcccccattcctcaataataacatattaccttgggggatgc

SEQ ID NO: 25879 - protein, 175 aa, Panicum virgatum
  misc_feature: Ceres CLONE 1865489
  misc_feature (44)..(172): Pfam Name: TCP Pfam Description: TCP family transcription factor
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
MSSSELVLYNLVPAPQTLNPPQPHAAAAAAAVAFSGDLSISTTVAPPPQEPLRVRTRRPVGSSADRHAKVAGRGRRVRIPAMVAARVFQLTRELGHRTDGETIEWLLRQAEPSIIAATGTGVTPEEAPPAPVPVSPVAATASLMPVPYYTALLMQPPPTTDSASGSGTAAQENNN

SEQ ID NO: 25880 - DNA, 709 bp, Panicum virgatum
  misc_feature: Ceres CLONE 1865494
  misc_feature: Encodes the peptide sequence at SEQ ID NO. 25881
atccacatcaccccgtccttggcgtcgttcccctttccgcgcgcgacacggcgagatgaagatatccaaacccgacgacgcctcactccctcgccgctcgcgcgctccttcgcgccacgccccccgcgacggccggccggcgcgatgccaggtcttacaattttatagcgatctttcactttttaaccttgatggtaaagaggtgatgaggaagactatcaaagtgaatgatcccctcaggtatggaggaatcacaatctaccaaacggactggggattttcagcattgcaagtgaagaaaaatggcgaaggacctttcaatttagccatggcccccttgaaactgaatggcgataagaagctttttggaacgttcttgccgcttgaagactcggatccttcgaatccgagtgtcaaaggaatatcgatgcttgctcgagatctgcagtctatcgtgctgtatgatcaagacggcaagtttgtaggggtccgtcggccaagctcaaaactccccattgagatcaatggtaatgaaatactcattgaagatgctattggcagtactggacttgatcttaaaactgatccaggagttcctattgtgtatgctggatttggtgcactcatgctaacaacctgcattagttatctttcacactctcagatctgggcattgcaagatagaagtacagtagttgttggagggaag

SEQ ID NO: 25881 - protein, 235 aa, Panicum virgatum
  misc_feature: Ceres CLONE 1865494
  misc_feature (2)..(235): Pfam Name: ResB Pfam Description: ResB-like family
STSPRPWRRSPFRARHGEMKISKPDDASLPRRSRAPSRHAPRDGRPARCQVLQFYSDLSLFNLDGKEVMRKTIKVNDPLRYGGITIYQTDWGFSALQVKKNGEGPFNLAMAPLKLNGDKKLFGTFLPLEDSDPSNPSVKGISMLARDLQSIVLYDQDGKFVGVRRPSSKLPIEINGNEILIEDAIGSTGLDLKTDPGVPIVYAGFGALMLTTCISYLSHSQIWALQDRSTVVVGG

SEQ ID NO: 25882 - DNA, 617 bp, Panicum virgatum
  misc_feature: Ceres CLONE 1865509
  misc_feature: Encodes the peptide sequence at SEQ ID NO. 25883
gaaggttaacacagctcgccaggaagagtgtcaaggacaccaccggcaagggctggttcgacatgccggcgccaagcatcactcccgagttgaagaaagatctcgacattttgcagctgatgcatgtaatggacccaacaaggcacttcaagagggcaggaaaatccacggcccttcccacgtacttccaagattggtacagttggtgagcctgcatctgagttctactcaggtaggctgacgaagagggagcggaaaacaacgttggttgatgagctgttatccgatcaatctcttatgagctacaggaagcgcaaggtacgggaaatccaggagagtcgcacaccactaggcaacctgaagtggaagaacaacgggaaccaaacccttaagagggccaaggataggcgaaaatgagtttgctgcgtctgactgcttcggtcgtgagaaagaagagagtggagaagggtctccttcaagtcacactatactctctctcgattttacactataaattgtgattcaactgtaatgtggcgaacttcagcatgttgactgttgaatacattttcaggtctaaatatttatatagtagtactgtcagcatcggaattccg

SEQ ID NO: 25883 - protein, 68 aa, Panicum virgatum
  misc_feature: Ceres CLONE 1865509
  misc_feature (8)..(68): Pfam Name: Fcf2 Pfam Description: Fcf2 pre-rRNA processing
RLTQLARKSVKDTTGKGWFDMPAPSITPELKKDLDILQLMHVMDPTRHFKRAGKSTALPTYFQDWYSW

SEQ ID NO: 25884 - DNA, 672 bp, Panicum virgatum
  misc_feature: Ceres CLONE 1865511
  misc_feature: Encodes the peptide sequence at SEQ ID NO. 25885
acccgtagaatcccctcctgacctctgccttcgcagctccggcaagaccgatgttgccgatgaggtccgccgccgccgcgccgtgctcgctggcagcgctgctgctccgccgcctctcttcccactcgtcctcttctgcctattccgtcagccgccgcgcctcctctgccctgtcctctcagccctccgcctcccacctcgccaccagccccccttgccccctttccagcagccgcaggaccaggggattcgcggcctgggcctcggcgccggggcccgccgaatccctcgccactaaggcgctagaggccaagatcaaggagcagctggaggccgacgcggtcagggtcgtcgacaactccggggacggccgccacgtctgcatagatgtggtttccaaggtattcgagggaaaatctgcagtaaataggcagagaatggtctacaaggttatatgggaggagcttcagagcaccgtgcatgccgtggacgaaatgactaccaagacaccagatgaagctgctgcgaacaagtaattcaatactcctgtggaggcagttaagctctccgtcgaagatcaggcccttgccttcaccaagtttctgtttttttttcctgaataatcaataattcgcgatgtgattagtgtgctttcaaaaagaaatatatgcc

SEQ ID NO: 25885 - protein, 161 aa, Panicum virgatum
  misc_feature: Ceres CLONE 1865511
  misc_feature (80)..(157): Pfam Name: BolA Pfam Description: BolA-like protein
MLPMRSAAAAPCSLAALLLRRLSSHSSSSAYSVSRRASSALSSQPSASHLATSPPCPLSSSRRTRGFAAWASAPGPAESLATKALEAKIKEQLEADAVRVVDNSGDGRHVCIDVVSKVFEGKSAVNRQRMVYKVIWEELQSTVHAVDEMTTKTPDEAAANK

SEQ ID NO: 25886 - DNA, 531 bp, Panicum virgatum
  misc_feature: Ceres CLONE 1865526
  misc_feature: Encodes the peptide sequence at SEQ ID NO. 25887
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggacctggacggccgcagcatcaccgtcaacgaggcccagtcccgcggcggcccgcgctccggcggcggcggcggcggcgggtacgggcgccgcgagggcggcggcggctaccgcggcggtggctactgcggccgcggctacgggcgccgccagggaggtcgtcgccacgaccgcggaggaggaggagctcaccgcctcctcgtaaggtacggattgttgc

SEQ ID NO: 25887 - protein, 145 aa, Panicum virgatum
  misc_feature: Ceres CLONE 1865526
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHNAFSPFGEVLESKIILDRETQRSRGFGFVTFSSEQAMRDAIEGMNGKDLDGRSITVNEAQSRGGPRSGGGGGGGYGRREGGGGYRGGGYCGRGYGRRQGGRRHDRGGGGAHRLLVRYGLL

SEQ ID NO: 25888 - DNA, 590 bp, Panicum virgatum
  misc_feature: Ceres CLONE 1865571
  misc_feature: Encodes the peptide sequence at SEQ ID NO. 25889
attcctcctcgccgcctccccaaaacctagcgccggcgccgccaccccgtcgtacggtcgatcctccccgccctccagcagcagcgatggcccgcctctccgccgccgccgccgtgatcgccgccttcgtggccgtggccgcgctggccaccacagcctcggccgccgatgcgccggcccccgccccggcctccggcgcgggcgccctctcggcgcccctctccgtgtgctgcctcgccgcgctcctcgccgccgtcctccgccactgagccggcggcggccgccccgccccgcgccgtccgcgtgcgcgtcttcgtcagatctagtagtacagtggtagcgagagtttcttagtggtagtagcagtgtcgttgtggggagaggcattgtgctttggtggtccgccgggcggatggatccgagggttttctcgtttggggattttgagaggttttcgatcggtggatttgattagcgttgttggtgtgagtcgattcctattatttattgtgtgcgtttgtgtacctagtgctcaccggctctgagagtattattattattatggatgtatggtattgttattcttgtgt

SEQ ID NO: 25889 - protein, 60 aa, Panicum virgatum
  misc_feature: Ceres CLONE 1865571
  misc_feature: Useful for making plants with altered carbohydrate content
MARLSAAAAVIAAFVAVAALATTASAADAPAPAPASGAGALSAPLSVCCLAALLAAVLRH

SEQ ID NO: 25890 - DNA, 821 bp, Panicum virgatum
  misc_feature: Ceres CLONE 1865573
  misc_feature: Encodes the peptide sequence at SEQ ID NO. 25891
ctcaacgctactctagaggataaaaacctttctgagatcccaaatttcagattattgctgaagcagctggttactatggaggtcattcagtggacaagtttgtgggaattctacagaaatgaatatgagaatgagaagcttcttggaggagctttgggtgccaaaactgaagaagatttgaagctgaggatcatagaacataatatcttggttgtctccaagtactattcaaggattagcctcaagaggattgcggaccttctctgcctgagtttgcaggaggcagagaaacatctttcagacatggtgaactcaaaatctctgattgcaaagatcgacaggccaatgggtgtagtgagcttccgtacagctcaagacagcaacggagtactcaactcatgggccacaaacctcgagaagcttcttgaccttgttgagaagagctgccatcaaatacacaaggagaccatgatccacaaggcaatgttgaaagcttagttttggctcgtggctttaggttcagtttgtggcctcccgtcatcaaatttcacaaattacaggacatgaagcgttcccttgtttgctttggcaagaagttttagcctttttatcgaacatttgtgcacaatgaagattgccgaatcagttagtgcattgctttcttaagatttggctaagtcatgttgagtatttacaatcagccaaatattgccaaagcttatgagatcaagcttaagtttttgcctcctcgctgacagtattaggcttgctgttgtatggcatttccaaacttgaacttgggaagtcaatctttttcaagc

SEQ ID NO: 25891 - protein, 165 aa, Panicum virgatum
  misc_feature: Ceres CLONE 1865573
  misc_feature (14)..(123): Pfam Name: PCI Pfam Description: PCI domain
LNATLEDKNLSEIPNFRLLLKQLVTMEVIQWTSLWEFYRNEYENEKLLGGALGAKTEEDLKLRIIEHNILVVSKYYSRISLKRIADLLCLSLQEAEKHLSDMVNSKSLIAKIDRPMGVVSFRTAQDSNGVLNSWATNLEKLLDLVEKSCHQIHKETMIHKAMLKA

SEQ ID NO: 25892 - DNA, 587 bp, Panicum virgatum
  misc_feature: Ceres CLONE 1865575
  misc_feature: Encodes the peptide sequence at SEQ ID NO. 25893
gtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcatcatcaccgtcaacgaggcccagtcccgcggcggcccgcgctccggcggcggcggccgctactggcgccgcgcgggccgcggtggcttccgtggccgtggtgacaacagctgccatcgaatacgcaaggacaccatgatccacagggcaatgttgaaagcttacttttggctcgtggctttaggttcactttgtggcctcccgtcatcaaatttcacaaattacaggacatgacgcgttccattgtttgctttg

SEQ ID NO: 25893 - protein, 154 aa, Panicum virgatum
  misc_feature: Ceres CLONE 1865575
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
MEASDVEYRCFVGGLAWATDDNSLHNAFSTYGEVLESKIILDRETQRSRGFGFVTFSSEQAMRDAIEGMNGKELDGRIITVNEAQSRGGPRSGGGGRYWRRAGRGGFRGRGDNSCHRIRKDTMIHRAMLKAYFWLVALGSLCGLPSSNFTNYRT

SEQ ID NO: 25894 - DNA, 729 bp, Panicum virgatum
  misc_feature: Ceres CLONE 1865578
  misc_feature: Encodes the peptide sequence at SEQ ID NO. 25895
acctcaaacagcgatctctcgaatccgcatcccccaattccccaaccgcacaaacaccgccgcgccgcgagccccaaagcagccgcagcaccaccgatggcgcccaaggcggagaagaagccggcggcgaagaagcccgcggaggaggagcccgcggccgagaaggcggagaaggccccggcggggaagaagcccaaggcggagaagcgcctccccgcgggcaagtccggcgccggcaaggacggcgagggcaagaagggcaagaagaaggctaagaagagcgtcgagacctacaagatctacatcttcaaggtgctcaagcaggtgcacccggacatcggcatctcctccaaggccatgtccatcatgaactccttcatcaacgacatcttcgacaagctcgccgccgaggctgccaagctcgctcgctacaacaagaagcccaccatcacctcccgcgagatccagacgtccgtccgcctcgtcctccccggggagctcgccaagcacgccgtctccgagggcaccaaggccgtcaccaagttcacctcggcctagttaggtttgccgcgtctggtggtgccagtactggttcggttgggtgctgctgctagtcctggctccctcggtttaatttatctggtagcagtagtattgccatcagcactgtcgaatggaaatggaaatggatggttagtgtgcagtacgaattgtgccctgttctgttct

SEQ ID NO: 25895 - protein, 153 aa, Panicum virgatum
  misc_feature: Ceres CLONE 1865578
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAAEKAEKAPAGKKPKAEKRLPAGKSGAGKDGEGKKGKKKAKKSVETYKIYIFKVLKQVHPDIGISSKAMSIMNSFINDIFDKLAAEAAKLARYNKKPTITSREIQTSVRLVLPGELAKHAVSEGTKAVTKFTSA

SEQ ID NO: 25896 - DNA, 684 bp, Panicum virgatum
  misc_feature: Ceres CLONE 1865588
  misc_feature: Encodes the peptide sequence at SEQ ID NO. 25897
ttctcagtagtacactcgctagctagctaagctgctatataaattaaattaaagctagcagcgcgcggcaagtagtactgatcgatcggcatcgccggccggagatcgacatgacgatgatgaagaagcagcagcaagctgtggtgctgctgctgctgctgctgctggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatcactacatgcatgcgtgtatctatacatacatacatatatatgatcgctcgctcgatcgatcgatcttagtcgtctacgtgtggcttgctgctgttcatccagctgctcgctacgtgtgtgtgtacacacacacacacgacggataaataaaagatgcatgggttgcctccgggccgctccctatatagctactttgttgtgtactactagtatcaatcaatcctactttctgatgtcttcact

SEQ ID NO: 25897 - protein, 94 aa, Panicum virgatum
  misc_feature: Ceres CLONE 1865588
  misc_feature (29)..(94): Pfam Name: Tryp_alpha_amyl Pfam Description: Protease inhibitor/seed storage/LTP family
  misc_feature: Useful for making plants with modulated biomass
MTMMKKQQQAVVLLLLLLLAAGGASAASCNAGQLTVCASALTSGGKPSAACCSNLKAQQGCFCQFAKNPAFARYINSPTARKVVASCGVALPRC

SEQ ID NO: 25898 - DNA, 671 bp, Panicum virgatum
  misc_feature: Ceres CLONE 1865616
  misc_feature: Encodes the peptide sequence at SEQ ID NO. 25899
acctcagcaactaggctctcttcccacgaacgcaaccacccccaccctccactacaagcggaagcgagcggcggcggcgatgtcgggcaggggcaagggcggcaaggggctcgggaagggcggcgcgaagcgtcaccggaaggtgctccgcgacaacatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagactgtcacagccatggacgtcgtctacgcgctcaagcgccagggccgcaccctctacggcttcggcggctaggttaggggtctgtcgatgtggttcggttccatggttagccttatcgccttccatgttttccggtagttgctgtagcggagtagtagctgcttgcttggtccctttggcgtcgggtgtgtggatgtaagaaccgctggttcgaagcaattggtctggatgcaggatgctgatgtaggaaatctgcagttcactttcaattgttattctacgaatactgtttgtctcgaagtacactctgcacaatttgtcctggattgggcggtgtaaacctgttcggttc

SEQ ID NO: 25899 - protein, 103 aa, Panicum virgatum; identical to SEQ ID NO: 12044
  misc_feature: Ceres CLONE 1865616
  misc_feature (25)..(94): Pfam Name: Histone Pfam Description: Core histone H2A/H2B/H3/H4

SEQ ID NO: 25900 - DNA, 382 bp, Panicum virgatum
  misc_feature: Ceres CLONE 1865626
  misc_feature: Encodes the peptide sequence at SEQ ID NO. 25901
attcatcctctgctctccgccgataaatcctcctcctctgctccctcctgctctctcctcgccgccaccttactccgaattcgatggacctgcatgcggagctgcggcgcccggcggcgccccacgaggcggcgctgagggccgtgcagaagccgcccgccaagccctggcgcgggggagccggagccgccgccaccgcggccccgcccccgccgcccaaggcgtaccgcgtcgagccccgggagttccgggacctcgtgcacaggctcaccggcgcgccacccgcggccacggccaggggcggcgtggcaccgcgaccgcagcatcagcatcacactggacaccgcggcgcacacgcagcagccggtggacgttcgcgctt

SEQ ID NO: 25901 - protein, 99 aa, Panicum virgatum
  misc_feature: Ceres CLONE 1865626
  misc_feature (41)..(71): Pfam Name: VQ Pfam Description: VQ motif
MDLHAELRRPAAPHEAALRAVQKPPAKPWRGGAGAAATAAPPPPPKAYRVEPREFRDLVHRLTGAPPAATARGGVAPRPQHQHHTGHRGAHAAAGGRSR

SEQ ID NO: 25902 - DNA, 707 bp, Panicum virgatum
  misc_feature: Ceres CLONE 1865644
  misc_feature: Encodes the peptide sequence at SEQ ID NO. 25903
acctcctcttccagccctagccctcctcctccccgccgccacctcgcgctcgtcttcgcccgcccgctccctcccttcctcaatcgcaagagctctcaacgcggcgaccgcatctccaagatggtgctccagaacgacatcgacctgctcaacccgccggcggagctcgagaagctcaagcacaagaagaagcgcctcgtccagtccccaaactccttcttcatggatgtcaagtgccagggctgtttcagcataaccactgtgttcagccactcccagactgtggtggtgtgtcctggttgccagacagtgctctgccaaccgactggtggaaaggccaggctcacggagggctgctctttccgccgcaagggcgactaggctactggtgttggcaacagggaaaaaaagatcgatgtcctgctgagcaactcatgtttaatcttccctggatatgtactcgtggaagatttgtttagttatgcctgttaagctcctgtgatgtaaacctgcactttgtttgagtgaaagctgcttagtgttgtggtcaccactgtgattccccggtcaaatttctcttggccagcgatgctttttatgtagcttgcatgtgtgcttgtgttctgttgatgcacccgcgattgaaggtgtatcaacgttattggacatcttggtaagaaaccaaaatttgaagtcctagttgcccg

SEQ ID NO: 25903 - protein, 86 aa, Panicum virgatum; identical to SEQ ID NO: 9875
  misc_feature: Ceres CLONE 1865644
  misc_feature (30)..(84): Pfam Name: Ribosomal_S27e Pfam Description: Ribosomal protein S27

SEQ ID NO: 25904 - DNA, 742 bp, Panicum virgatum
  misc_feature: Ceres CLONE 1865648
  misc_feature: Encodes the peptide sequence at SEQ ID NO. 25905
agccaaccagccctcagcccctcatcaactagctctattcaagcagtactaccagtacagcttctcctctggcctttcgacaacgcagcaaacctccactgttcaaggtagccagaggatgatgaggcgttgcggcggtctctcttcgccgctcgcggccgtgtccctgctcctcctcctcatctgcttcttccaccgcgcggcggcggctcgccccctgccggctgctgctgctgttcctcttcaggttcaccaagaggatgtagccaaggttgctgcagatggcgagccggtgcttcagaaaggcgccgcgggtagtggcgatgagctctctgctgaggtgatgatgggatcagaggaggaggcggcggaggagccggcgtgcgaggaggggaacgacgactgcatgcagcggcggctgctccgcgacgcgcacctcgactacatctacacccagcacaagggcaagccatgagctagcgaggatccccatcttctctggcgtacgttgggagtgtgcgggggacaaagtcgtacacgctgcaaagttgacactgctgggaatctcatctctagtatatctaccttctgctacctactgcttacaatttctctgccactgatcaaccagtatccggggatccatgtaggattaatatatgtgtgtgactgtcatcacctcgtttgtacatcgtctctcttggccatgtataatacatgcatcgtaaccaccatttttctc

SEQ ID NO: 25905 - protein, 118 aa, Panicum virgatum
  misc_feature: Ceres CLONE 1865648
  misc_feature (18)..(117): Pfam Name: PSK Pfam Description: Phytosulfokine precursor protein (PSK)
MMRRCGGLSSPLAAVSLLLLLICFFHRAAAARPLPAAAAVPLQVHQEDVAKVAADGEPVLQKGAAGSGDELSAEVMMGSEEEAAEEPACEEGNDDCMQRRLLRDAHLDYIYTQHKGKP

SEQ ID NO: 25906 - DNA, 669 bp, Panicum virgatum
  misc_feature: Ceres CLONE 1865649
  misc_feature: Encodes the peptide sequence at SEQ ID NO. 25907
atcgtgacctgattgcggccctacgcgagctttccatcgtcgccgtgccgccaccaccgcccgtggccgtcggagcagggccgcgccacgccgccacctctccgacttgtgaaggttgctgcgtaggcagtaggcacatacacacaggcggcggcggcggcggcggcggcggccatggcgtcgcgcaagcttctcctgagcctcacctccgggaggcggctccggtcccgcactcagcaactcttctgggccgccagcctccctgaagctgccacctctcgctccctcgcggccgccgttgccgcggcgcagcagtcgggcgagtctccagtggctcacctcttctcttcgaggaccatctcgtcgacgcgccccgcgacgcagtccgctggagatgcgcccggttcatctgcggtggaccacaagttgataatgcctgaggacgagtttcataaattagcagatgagacgattcacgatttgcttgaaaaacttgaggaatatggtgactccattcaaatggatggtttcgacattgactacgggaatcaggttttgacattgaggctcggggatttgggaacatatgttgtaaacaagcaaacaccaaacagacaaatctggttatcttcacctgtgagtgggccttctaggtttgattgggatgct

SEQ ID NO: 25907 - protein, 164 aa, Panicum virgatum
  misc_feature: Ceres CLONE 1865649
  misc_feature (87)..(164): Pfam Name: Frataxin_Cyay Pfam Description: Frataxin-like domain
MASRKLLLSLTSGRRLRSRTQQLFWAASLPEAATSRSLAAAVAAAQQSGESPVAHLFSSRTISSTRPATQSAGDAPGSSAVDHKLIMPEDEFHKLADETIHDLLEKLEEYGDSIQMDGFDIDYGNQVLTLRLGDLGTYVVNKQTPNRQIWLSSPVSGPSRFDWD

SEQ ID NO: 25908 - DNA, 487 bp, Panicum virgatum
  misc_feature: Ceres CLONE 1865650
  misc_feature: Encodes the peptide sequence at SEQ ID NO. 25909
tatccatcactcactcgaacgccatgccttccctttccaggggagaagagagcccgccggaatacggctatggcggaggcgacccgctgtgcgatggtggctggtcgtggcggcggccgcgacgctggcgcgcggcgacttgatcccggacctgacggagtgcgcggaccagctggtggggctggcgccgtgcctgtcgttcgtgccggggccggcgcgcgcgccgcctcccgactgctgcggcgggctccggcaggtgctctcgaagagccccatgtgcctctgcctgctcgtcacggacaaggacgaccccaacctgtgcatcaagatcaccgcctccctctccctcgtcctctcctccgcctgcggggccctccccgtcatctcctcccactgcgcccagctcctgtatgttcctccgggatcgaaagacgccgccgtcttcagccccggtggcgacttggggtccgctgctgccccatcctcg

SEQ ID NO: 25909 - protein, 161 aa, Panicum virgatum
  misc_feature: Ceres CLONE 1865650
  misc_feature (54)..(132): Pfam Name: Tryp_alpha_amyl Pfam Description: Protease inhibitor/seed storage/LTP family
IHHSLERHAFPFQGRREPAGIRLWRRRPAVRWWLVVAAAATLARGDLIPDLTECADQLVGLAPCLSFVPGPARAPPPDCCGGLRQVLSKSPMCLCLLVTDKDDPNLCIKITASLSLVLSSACGALPVISSHCAQLLYVPPGSKDAAVFSPGGDLGSAAAPS

SEQ ID NO: 25910 - DNA, 666 bp, Panicum virgatum
  misc_feature: Ceres CLONE 1865697
  misc_feature: Encodes the peptide sequence at SEQ ID NO. 25911
atccgtctccgccagattccaacctcaaaccaaaaaatcccccaattccggcgtgcgagagcgcgaggaaggaggccaaggcggcggcgatgtcggggcgaggcaaggggggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccaggggcgcaccctctacggcttcggcggctaggccgccggcgcgcctccgtcgtgtgctcgcgctccgtctcggcgcggttcctggattggggccgtctgtggttaggggtgatggttcgttgtcaagggattggctgtgttggcttagttgcggtggtggtagtagtagtagtattgctttgctcacattgttgccttgctcaatgtagtctactatctttgtgccgtgaagaaaagcgtactgcctatcttgtatgaggatgcagcaaagaaatgaaagtgcgaaatgccacctg

SEQ ID NO: 25911 - protein, 103 aa, Panicum virgatum; identical to SEQ ID NO: 12044
  misc_feature: Ceres CLONE 1865697
  misc_feature (25)..(94): Pfam Name: Histone Pfam Description: Core histone H2A/H2B/H3/H4

SEQ ID NO: 25912 - DNA, 593 bp, Panicum virgatum
  misc_feature: Ceres CLONE 1865707
  misc_feature: Encodes the peptide sequence at SEQ ID NO. 25913
ctctcgctttgcccccttctccgccccatcgctgctgcgctccgcctccctccccctctcatccgcaggatagggttctcctctagaggcacgcgccatgttggtctatcatgcatctgctcacctgcgacgagctgctctcgtactcgttcccgtacaatgagatcgagaacggcgtgctctgggaggtcgagggcgggtgggtcgtccaaggaggagcggaggtaaacattgctgccaacccttctgccgagggtggcgaggatgagggcctacacgatcaggctgtgaaggttgtggatattgtgcaccccttccgtctacgggaacatgctgccttcgataagaagcattttgtcgaatttattaagcactcttaaaacaacctcacctcaaccttggagccggacaaggctgatcatatcaagaagggcattgagggcgccacctgataccttcttggcaagttgaatgacctacagttctatgttgtccagagcatgcttgacgatggcagtctcatgttctcgtagtacaaagaaggagcaaccgaaacgaccttcctctattttgcgcatggcttgaaggagatc

SEQ ID NO: 25913 - protein, 89 aa, Panicum virgatum
  misc_feature: Ceres CLONE 1865707
  misc_feature (3)..(89): Pfam Name: TCTP Pfam Description: Translationally controlled tumour protein
MHLLTCDELLSYSFPYNEIENGVLWEVEGGWVVQGGAEVNIAANPSAEGGEDEGLHDQAVKVVDIVHPFRLREHAAFDKKHFVEFIKHS

SEQ ID NO: 25914 - DNA, 725 bp, Panicum virgatum
  misc_feature: Ceres CLONE 1865719
  misc_feature: Encodes the peptide sequence at SEQ ID NO. 25915
atcgactcccccgcatttacactgctccgcgggcacagtgaaccagacagccagcgacacgagcgacgagccaccagtctccgagcgacgacggcgagcgccgccaccgcgccctgcagcggccacacctcgagctaagaaacgaagcagccatggcgacgcgtcgcctcccgtcgtccctcccgctgctgcttctccttgcggcgggatccctcgcagcggcggtggcggcggcaagcgcgcttggcgaatcccccgagacggacacggacatggtgccgcgcttcggccggatcctgcagcagctgcctcagcctcagcctatgccgcagccggacccgaacccacagccgcagcccggggtgaacccgccagtgccacagcccctgccgcaaccaaatccaaacccgccgcaaccgctgccgcagccgcaaccgctgccgcagccacagcccgtgccgcagccgaacccgcagcccgggctgaacccaccccagccactgccgcagccgcagccaacagccccacagccgcagcccttgccgcagccggacccgaccctgccgccccagcccttgccggggccgcagccgcagccggacccagccctgcagcagccgcagccagggacgacgacgcagccggctccgaacggccagaatccgcaggcgcagccggaccaggtgctcccgagcggcggggggtccaggatgctggtgaacctg

SEQ ID NO: 25915 - protein, 190 aa, Panicum virgatum
  misc_feature: Ceres CLONE 1865719
  misc_feature: Useful for making plants with altered lignin content
MATRRLPSSLPLLLLLAAGSLAAAVAAASALGESPETDTDMVPRFGRILQQLPQPQPMPQPDPNPQPQPGVNPPVPQPLPQPNPNPPQPLPQPQPLPQPQPVPQPNPQPGLNPPQPLPQPQPTAPQPQPLPQPDPTLPPQPLPGPQPQPDPALQQPQPGTTTQPAPNGQNPQAQPDQVLPSGGGSRMLVN

SEQ ID NO: 25916 - DNA, 580 bp, Panicum virgatum
  misc_feature: Ceres CLONE 1865731
  misc_feature: Encodes the peptide sequence at SEQ ID NO. 25917
acttggcaagacgatggcggaaaaggcggcatggagggcggcacggggaacagacctgaagctagtgaccatgtgccctgcgcttgtaaccgggccaggattgcggaggcggaaccctactccatccattgcctacctcaaaggagcgcacgccatgcttgccgaaggcctgctggccacctcgaacgtggaaggggtagcggaggcgcacgtccgcgtgtacaaggagatggacggcacggccggcgggcggtacatctgctacgaccacgtggtccgacgagccgaggagttcgccgagctgcagcggcagctggggctccgcgcccccgccggcagggctcccgcggcgcccgacgagcgggcggagcggttcgagctctgcaaccggaagctgacggcgcccatgtccgcgcggaggaggtgcacctacgacgcctacttcaccgtgttgtacgagtgaaatggtcgggtcgggggcgggttgtctggatgcgaatagaagaggagagagctcatgctgccgtgttgtacatagttggatgcgtcaataaaattataaaagctttgctaggtaggt

SEQ ID NO: 25917 - protein, 153 aa, Panicum virgatum
  misc_feature: Ceres CLONE 1865731
  misc_feature: SWISSPROT Homolog: EC 1.1.1.219 Dihydrokaempferol 4-reductase
LGKTMAEKAAWRAARGTDLKLVTMCPALVTGPGLRRRNPTPSIAYLKGAHAMLAEGLLATSNVEGVAEAHVRVYKEMDGTAGGRYICYDHVVRRAEEFAELQRQLGLRAPAGRAPAAPDERAERFELCNRKLTAPMSARRRCTYDAYFTVLYE

SEQ ID NO: 25918 - DNA, 677 bp, Panicum virgatum
  misc_feature: Ceres CLONE 1865734
  misc_feature: Encodes the peptide sequence at SEQ ID NO. 25919
acggctgccgcggcgcacctcctgcagtcgccagtccccaccaggcgcggaaccctcgcctccgattcgaggcagcggcggcggaggggatggctgcggaggcgagcgcggcgggcgcggctgaggcgaagccctttgccgtcctcttcgtgtgcctcgggaacatttgccggagtcctgcagctgaggctgttttccggaatatcgtaagcaagcgtgggcttgactccaagtttcaaattgactctgctggtaccataggataccatgagggtaacaaggcagactcaaggatgagatcagcttcaaagaagcgggggattgaggttacctcaatatccagacctatcaaaccctcagatttccgtgacttcgatcttatccttgcaatggacaggcagaactatgaagatatattgaacgcatttgagagatggagacacaaggagcccctccctgatggtgcacccaacaaggttaagctgatgtgctcttactgcaaacgacataccgagtctgaagtcccagatccttattatggaggccctcagggattcgaaaaggtcttggatttattggaagatgcatgcgagtcactgcttgatagcatcatggcagacaatgcaaacatttccgcatgacctcggatatgaacatctgcaggcgatgtaaatctc

SEQ ID NO: 25919 - protein, 212 aa, Panicum virgatum
  misc_feature: Ceres CLONE 1865734
  misc_feature (45)..(202): Pfam Name: LMWPc Pfam Description: Low molecular weight phosphotyrosine protein phosphatase
  misc_feature: SWISSPROT Homolog: EC 3.1.3.48 Protein-tyrosine-phosphatase
GCRGAPPAVASPHQARNPRLRFEAAAAEGMAAEASAAGAAEAKPFAVLFVCLGNICRSPAAEAVFRNIVSKRGLDSKFQIDSAGTIGYHEGNKADSRMRSASKKRGIEVTSISRPIKPSDFRDFDLILAMDRQNYEDILNAFERWRHKEPLPDGAPNKVKLMCSYCKRHTESEVPDPYYGGPQGFEKVLDLLEDACESLLDSIMADNANISA

SEQ ID NO: 25920 - DNA, 578 bp, Panicum virgatum
  misc_feature: Ceres CLONE 1865756
  misc_feature: Encodes the peptide sequence at SEQ ID NO. 25921
agaccacaccacaccacaccgcgtccacatcctcccgcgcttctccgctcagcccgcgcgtttccgctgaggagggatagccgcgcggcgcgtcgaggggtttgtctttgatcgggtagctgaggctgagcgggcggggcaggatgatgcgcgacacggcggccgtggccgtggcggcgccgcggtacaggggcgtgcggaagcggccgtggggccggttcgcggcggagatccgcgacccggcgaagcgcgcgcgcgtctggctcggcaccttcgactccgccgaggccgcggcgcgcgcctacgacgtcgccgcgcggaccctgcgcggcccgctcgccaggaccaacttcccctgcgcctcctcccgcctcccgctgccctcccgccacctaggtctcgtcgcgccgccgcccgccgcgccgacgtgcatctccagctccaccgtcgagtcctccagcggaccccgaggggcgcccacggctgctgcggcggcggcgcctcgaattcggaggcggtcggtgaaatatccgcggccggcagcgcccgacaccgactgccacaacggctgcgcctcg

SEQ ID NO: 25921 - protein, 144 aa, Panicum virgatum
  misc_feature: Ceres CLONE 1865756
  misc_feature (13)..(64): Pfam Name: AP2 Pfam Description: AP2 domain
  misc_feature: Useful for making plants with altered carbohydrate content
  misc_feature: Useful for making plants with modulated cold sensitivity
  misc_feature: Useful for making plants with altered lignin content
  misc_feature: Useful for making plants with altered alkaloid content
  misc_feature: The sequence is a functional homolog of SEQ ID NO 1754 in the 10/374,780 US patent application
  misc_feature: The sequence is a functional homolog of SEQ ID NO 314 in the 10/666,642 US patent application
  misc_feature: The sequence is a functional homolog of SEQ ID NO 503 in the 10/374,780 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
MMRDTAAVAVAAPRYRGVRKRPWGRFAAEIRDPAKRARVWLGTFDSAEAAARAYDVAARTLRGPLARTNFPCASSRLPLPSRHLGLVAPPPAAPTCISSSTVESSSGPRGAPTAAAAAAPRIRRRSVKYPRPAAPDTDCHNGCA

SEQ ID NO: 25922 - DNA, 650 bp, Panicum virgatum
  misc_feature: Ceres CLONE 1865758
  misc_feature: Encodes the peptide sequence at SEQ ID NO. 25923
agtgcccaccccacagacgacgcgcaccaccagcacgccgacgactgaacgaggcgaggcgagaaccggccgcggcggcggcgatgggcggcggcggcgcgcacggcggcaccacctacaagggctacaccatcccgcacaacaagcgctggcacaccgtcgccggcaagggcctctgcgccgtcatgtggttttgggttttctacagggctaagcaggacggtgctgtgctcttgggcttgcgccatccttgggatgggcatgatgatcactctcatggacatggacatggacatgaacatgaggcatcatcgtcatcgtcttcttctcattgagttcactacaacttgcagctgacggtgatgcgatgttccaactaaagtttcagataataaattctgccccgctgcatgggagtcatgttgtttgcgagttgcttagcacaaactgttttcctgacaattgtgcttatgtatttgatttcaagcttcagttgatatgttgtgggaaagaatttggtgtatgtcgcttctcgttgtgaccactacctgtgccccttgctctgctcttgcccataagacccaaacatctttggacacagtctctttttgtattttgtatttattggggcttgatagcaactcagtcgg

SEQ ID NO: 25923 - protein, 83 aa, Panicum virgatum
  misc_feature: Ceres CLONE 1865758
  misc_feature: Useful for making plants with modulated flowering time
MGGGGAHGGTTYKGYTIPHNKRWHTVAGKGLCAVMWFWVFYRAKQDGAVLLGLRHPWDGHDDHSHGHGHGHEHEASSSSSSSH

SEQ ID NO: 25924 - DNA, 898 bp, Panicum virgatum
  misc_feature: Ceres CLONE 1865774
  misc_feature: Encodes the peptide sequence at SEQ ID NO. 25925
catttccgtgatgcacatgagtgtatagctgctctcaaagctgaaaatacgcagctttcgcctcgcgtcttttgtgtccttgccaacgcttatgctcaacaggggttgtgtgaacaaagtgtaaatgtacttcagttaatggaggaagaaggatttgagccaaatcttgttatgctgaatttgttaatcaacgcttttggcactgctggaaggcatttagaggcactggctgtattccagcatatcaaggatagtggtatgagcccagatgttgtgacatacactacacttatgaaaacattcatgagagcaaagaaatttgaaaaggtgtctgaagtttacaaggaaatggaacgtgctggatgcactccagacaggaaagctcgagaaatgttacatgatgcctctgttatattggaacaaagaggatgtatctactgaaattggaacacttgctatcctaaatggcccaggtgtcaatgttcctagtgtcagggtcaccgcccttagtgcttgcaaatgcatggtgaagaaatcatctgaaaggaaacagaaggtggccaatcaggattactggtatgctttaaacttgagtgcaaatgtcaatcagggtttatggtcaaagtaaccctatcaggcataaagaaaggaggaatcagaaagcgaaagagtcatgaataatgagaaggatatagacaactatgggaatgaattgcatcaatattgtggaagttccttatgttgctttcattctgagtcatatcttaggaacttggtgcgacaaataaatgtagaaaaatattaggtgtgctgattattgactttgtgactagattcagctaacatcatgtggtttccagccaactatattttcattaattaaaatacttttcatttc

SEQ ID NO: 25925 - protein, 146 aa, Panicum virgatum
  misc_feature: Ceres CLONE 1865774
  misc_feature (92)..(126): Pfam Name: PPR Pfam Description: PPR repeat
  misc_feature (57)..(91): Pfam Name: PPR Pfam Description: PPR repeat
  misc_feature (22)..(56): Pfam Name: PPR Pfam Description: PPR repeat
HFRDAHECIAALKAENTQLSPRVFCVLANAYAQQGLCEQSVNVLQLMEEEGFEPNLVMLNLLINAFGTAGRHLEALAVFQHIKDSGMSPDVVTYTTLMKTFMRAKKFEKVSEVYKEMERAGCTPDRKAREMLHDASVILEQRGCIY

SEQ ID NO: 25926 - DNA, 744 bp, Panicum virgatum
  misc_feature: Ceres CLONE 1865776
  misc_feature: Encodes the peptide sequence at SEQ ID NO. 25927
acagcaagggcatctactctgcacttcttcgcctgatccagtccaaccggagagagttgaaaccattggactctgcatagaagcttcctgatatttctaaggggcgataaggcagggaatgagtacaaccaaggtgaagagacgtgtggggaagtatgagctcggtcggaccataggtgaaggcacattcgcaaaggtcaggtttgcgaaggacactgagacaggcgaacctgtagctatcaagatcatagagaaggagaaggtcctcaagcacaagatggttgagcagattaagcgggaaatttcaacaatgaagttgatcaagcatcctaatgttgttcgcatatatgaggtgatgggaagtaaaaaaaagatatacattgtgttagaatttgctacaggtggtgagctctttgacataattgctaaccatggtcgaatgagggaagatgaggcaaggaggtatttccaacaattaatcaatgcagttgattattgtcatagcaggggtgtgtaccaccgggatctaaaacctgaaaatttactgctcgattcgtttggaaacctgaaggtctccgactttgggctgagtgctctatctcagcagatcaaggatgatggattgctgcacacaacttgtggaactccgaactatgttgcaccagaggtccttgaagatcaaggctatgacggtgcaatggctgatttgtggtcatgtggagttatcctgtttgttctgctagc

SEQ ID NO: 25927 - protein, 208 aa, Panicum virgatum
  misc_feature: Ceres CLONE 1865776
  misc_feature (13)..(208): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MSTTKVKRRVGKYELGRTIGEGTFAKVRFAKDTETGEPVAIKIIEKEKVLKHKMVEQIKREISTMKLIKHPNVVRIYEVMGSKKKIYIVLEFATGGELFDIIANHGRMREDEARRYFQQLINAVDYCHSRGVYHRDLKPENLLLDSFGNLKVSDFGLSALSQQIKDDGLLHTTCGTPNYVAPEVLEDQGYDGAMADLWSCGVILFVLL

SEQ ID NO: 25928 - DNA, 684 bp, Panicum virgatum
  misc_feature: Ceres CLONE 1865822
  misc_feature: Encodes the peptide sequence at SEQ ID NO. 25929
tagatttggcgaacctggatgggtatccacagttgattggtgagcttgaagagatgttcgagataaaagacctgagtttgaaagagaaatggaaggtggctttcagtaatgatgatggtgatacaatggaagtcggcgatgttccttggcttgagttctgcctgaaggtgaggaagattgtgatccattccactgaagatgagagagatatggatccttgcccggagcaggatgtgaagaccggtttttagaagggggacagggatggaaggtggatttttggagcctttcacggttgatgatgaagcatcgttgtttgtctggggcggaagatggttgtagctgaaacatgatagctagcttgtcttgatgacgcaacagattggttgcctggtgtcagttctttcttcgcaagcattttgaggaagaattgatgtaacataggtttgcagaaaagaaaaggaaaaaggtttgataatgtgtctttagtttggtttaaagaagatgacaatcaattaatgtgtgcctagtagtctacctaaaaagcatagtggaagcctttatcggcgttaaggaataatgaagatgggtgtaaaagacagaccaagatctatgggaatgtaagttttgtaaatatatcagtaggtatgtcaatatatgggaggtggtattggttagcatacc

SEQ ID NO: 25929 - protein, 82 aa, Panicum virgatum
  misc_feature: Ceres CLONE 1865822
  misc_feature: Useful for making plants with modulated biomass
DLANLDGYPQLIGELEEMFEIKDLSLKEKWKVAFSNDDGDTMEVGDVPWLEFCLKVRKIVIHSTEDERDMDPCPEQDVKTGF

SEQ ID NO: 25930 - DNA, 706 bp, Panicum virgatum
  misc_feature: Ceres CLONE 1865831
  misc_feature: Encodes the peptide sequence at SEQ ID NO. 25931
gccttcgccagattcgccgccggacgctgcagctcaagcagctaggctgcagcgccgctcctccgccgtacgtacgttgaggattggttttcttcttcttcttccctgttggaatttttctggtaatcagcatggcactgtcatcagtgtttaggagaataaatgtgaaagatttgacctccaaggtttcagactataccagtgctacagagttatctggtggactaaacatgatatttaggcgctgggccacaaaaaagactgctgggtcaacaaaaaatggtcgtgattccaatccaaagtatttgggtgtaaagaagtttggtggagagaaagtgctaccagagaacatcatcgtccgccaaagagggacccgcttccatcctggaaactatgttggcatgggcaaggaccatacacttttctgcctgaaagaaggccatgtccgctttgagcgcaacaagctctcaggtaggaaatgggttcatgttgatccagttgctggtcatgatcttcaccccatttacgcagatggttttgctactacagcagacactgagcctttgcaataaatgtgcttggggatttggggttgtcattttgtcccaactcattcagctgccattttacagtttcgtgagtaaactttagcaaggcttgaatgtaccttttctttgtaatcataactactcactttgaataagct

SEQ ID NO: 25931 - protein, 146 aa, Panicum virgatum
  misc_feature: Ceres CLONE 1865831
  misc_feature (40)..(121): Pfam Name: Ribosomal_L27 Pfam Description: Ribosomal L27 protein
MALSSVFRRINVKDLTSKVSDYTSATELSGGLNMIFRRWATKKTAGSTKNGRDSNPKYLGVKKFGGEKVLPENIIVRQRGTRFHPGNYVGMGKDHTLFCLKEGHVRFERNKLSGRKWVHVDPVAGHDLHPIYADGFATTADTEPLQ

SEQ ID NO: 25932 - DNA, 783 bp, Panicum virgatum
  misc_feature: Ceres CLONE 1865872
  misc_feature: Encodes the peptide sequence at SEQ ID NO. 25933
agatcccagcttcacgatcccccttcggccgccacccctcaagaccccaaacctcttggcccttccctcctcccgccgccgccgccgccgccgaagccccgctcgaagaaatggtgagagtaagtgtgctcaatgatgcccttaagagcatgtacaatgctgaaaagcgtggcaagcgccaggtcatgatcagaccttcgtcgaagcttatcattaagttcctcatcgtcatgcaaaagcacagatacattggggagtttgagtttgttgatgatcatcgttctggtaagatagtagttgaactcaatggaaggctcaacaaatgtggtgtgatcagcccacgctttgatgttggtgtgaaggaaattgagtcctggacagcgaggctgcttccctcacgtcagtttggctacattgttctcaccacctctgctggcatcatggaccatgaagaggcgaggagaaagaatgtgggagggaaggtccttggcttcttctactaggaaaacctagtatccacattcagattatcccagaaactgttattaagttaaaagaatatagttttgtagctgtctagaagacaaaagcatgcgaagatcacctgttctgcattgccttgttctggattttgttgacccatttagttgctgcttggccccctttttggctcgtgcatcagttggatgtaatctgcttgtgtacctggtatgttagttctgaatcttggtactatgatgagctcacttgagctgagtgcatgttgagcaatttgctgactcg

SEQ ID NO: 25933 - protein, 130 aa, Panicum virgatum
  misc_feature: Ceres CLONE 1865872
  misc_feature (5)..(130): Pfam Name: Ribosomal_S8 Pfam Description: Ribosomal protein S8
MVRVSVLNDALKSMYNAEKRGKRQVMIRPSSKLIIKFLIVMQKHRYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 25934 - DNA, 732 bp, Panicum virgatum
  misc_feature: Ceres CLONE 1865901
  misc_feature: Encodes the peptide sequence at SEQ ID NO. 25935
aaaaccctatcgtctctcgcggcgcagtcaccaccaccgaacccggcggcgcacgcggaggagcccagcgagaggcggaggaagaaggcgatggcgcgcggcgtggcggcgagggcgaagggcggcgcggccggcgggaagaagaagggctccgtcaccttcacgatcgactgcaccaagcccgtggaggacaagatcatggagatcgccccgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaacgtgcgtgactggctccgggtcatcgcctcgaacaaggaccgcagcgtctatgagctacggtacttcaacattgccgagaatgagggtgaggaggaggattaggcgcactaccctatctatgtcttgtgaacttttggacgtgttggaacagtcttgctgtagcctttcaagggatgagttttgatgtttaaattggtgtcctggtgtgttgtaagagtggcgaacttccatgtgatgcttagataatctgtgtcccaaaatgttggttcctgcttgtctgtgaaacatatcatcattgatttatcgttaggttgtcgctatgattgtctatcgaactgctttatcagt

SEQ ID NO: 25935 - protein, 131 aa, Panicum virgatum
  misc_feature: Ceres CLONE 1865901
  misc_feature (17)..(131): Pfam Name: Ribosomal_L22e Pfam Description: Ribosomal L22e protein family
MARGVAARAKGGAAGGKKKGSVTFTIDCTKPVEDKIMEIAPLEKFLQERIKVAGGKAGNLGEGVTVSRDKTKVTVTSEGPFSKRYLKYLTKKYLKKHNVRDWLRVIASNKDRSVYELRYFNIAENEGEEED

SEQ ID NO: 25936 - DNA, 583 bp, Panicum virgatum
  misc_feature: Ceres CLONE 1865905
  misc_feature: Encodes the peptide sequence at SEQ ID NO. 25937
  misc_feature (2)..(2): n is a, c, t, g, unknown, or other
antcccccacagcacaaagcagccaccctttcacgcagcccacacacagcagcgagcaccggcgcagcccagcaggagcagcagaccgagaacaagaagacaacgacaacggccccgaggacgaagaacaacaggaggcaggcgggggaggcgccggccgacgacacggcagcagcggcgcgggcggcgccggcgccggcggccagcacgcgcgggcaggcgggagcggcgccggcgccgcgcaccccgcacgcgacggggaaggcgagcgcgcggccgccggcgagccgcggcggcgcgcgcagccggaacagcgcggcgcggacgatttttgaccggcaggcggcgtgccggtgcctcaagagcctggccagcaccgtcaagtcggtgaacatgggcaccgtcgccaccatccccggcaagtgcggcgtctccgtcccattccccatcagcatgtccacagactgcaacaaggtcaactaaattaatggaatatatgtacataccagctgatcgacgatgacaagcttggtgacgtcgtccttcacaagatagctgctacgaggcagctatatatttaatt

SEQ ID NO: 25937 - protein, 160 aa, Panicum virgatum
  misc_feature: Ceres CLONE 1865905
  misc_feature (70)..(156): Pfam Name: Tryp_alpha_amyl Pfam Description: Protease inhibitor/seed storage/LTP family
  misc_feature (1)..(1): Xaa is any aa, unknown, or other
XPPQHKAATLSRSPHTAASTGAAQQEQQTENKKTTTTAPRTKNNRRQAGEAPADDTAAAARAAPAPAASTRGQAGAAPAPRTPHATGKASARPPASRGGARSRNSAARTIFDRQAACRCLKSLASTVKSVNMGTVATIPGKCGVSVPFPISMSTDCNKVN

SEQ ID NO: 25938 - DNA, 716 bp, Panicum virgatum
  misc_feature: Ceres CLONE 1865916
  misc_feature: Encodes the peptide sequence at SEQ ID NO. 25939
gagccacgatccaccaccgcacactctccagcacccggcggagcaagcggccagcgagagatccagaggcagcagcaatggccaccgtcagcgccgccgcggcgaccaccgtccttgcccgcgccgccctagggctgccgcagctgagggcgaggagcgagagggtgcggtgcggctactcgaggaacgccgctcgcgtcccctctcgccctcgcgccgccgccgcagccgcagctgctgcagcaagaccccaccccgccgtgagcgcgaggggcgccggcgcgtcgctgctggccgcggcgggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagataatatcatgtccgtcctctgctcccgttactaccgatccggatgtaaacatggcggtggtcatcggtgtaatgtcagacttggctatttaatttgtatctaagcttcgcttttgcgttggatcatgaagtgatgatatgttgatccgtggagattacgcgtgtactgcaacttcgcgagagaaaaatcactatagtgttctgcgtaag

SEQ ID NO: 25939 - protein, 142 aa, Panicum virgatum
  misc_feature: Ceres CLONE 1865916
  misc_feature (1)..(142): Pfam Name: PsbW Pfam Description: Photosystem II reaction centre W protein, PsbW
MATVSAAAATTVLARAALGLPQLRARSERVRCGYSRNAARVPSRPRAAAAAAAAAARPHPAVSARGAGASLLAAAGAVTASAGPALALVDERMSTEGTGLSLGLSNNLLGWILLGVFGLIWSLYTVYTSDLDEDEESGGLSL

SEQ ID NO: 25940 - DNA, 592 bp, Panicum virgatum
  misc_feature: Ceres CLONE 1865917
  misc_feature: Encodes the peptide sequence at SEQ ID NO. 25941
atctccagtccgttcccctgctcggcttccggatcctcccatttcccctacagccggcggcaagaaatcgaatcgagcacgagcagccggcggcgatggcgtggcgtggcaccctgtcccggagcgtgaaggaaatccgcgtcctattctgccagtcttccccggccagcgccgccgccagggagttcgtgaagaagaactacggggacatcaagtcgcgcaacccatccctccccttcctcgtgcgcgagtgctccggcgtccagccccagctctgggcgcgatacgaaatgggtgtggagagatgtgtgaacttggatggcctgacggaaccgcagattgataagaagctcgaggaacttgccaaggctggagaatctgccaaagccaagtaatgttggagttcctacaatctctcgccgtaatgttcacgaataagtgaaactttagcagtgagtttcgtgttgtcatgacttcggtgctaagaatgaaatgaagtcttgggtttgtataacttaatgcgagaaagatagactgttattcacatgtttgctacgcattcttcttgagtttatgcatatttcattggttt

SEQ ID NO: 25941 - protein, 99 aa, Panicum virgatum
  misc_feature: Ceres CLONE 1865917
  misc_feature (20)..(93): Pfam Name: L51_S25_CI-B8 Pfam Description: Mitochondrial ribosomal protein L51 / S25 / CI-B8 domain
MAWRGTLSRSVKEIRVLFCQSSPASAAAREFVKKNYGDIKSRNPSLPFLVRECSGVQPQLWARYEMGVERCVNLDGLTEPQIDKKLEELAKAGESAKAK

SEQ ID NO: 25942 - DNA, 744 bp, Panicum virgatum
  misc_feature: Ceres CLONE 1865925
  misc_feature: Encodes the peptide sequence at SEQ ID NO. 25943
tccttgcccccctcatccacccacttccggcgagctctacaccggcggcagcggaggagcgtgggggctgatcctagggggcgaaggagcagcggagcggagacgaagcgatggggcagcagcagctgatctacgcgttcgtggcgcggggcacggtggtgctggccgagtacaccgagttcaccggcaacttcaccaccatcgccgcccagtgcctgcagaagctccccgccagcaacaacaagttcacatacaactgcgacggccacaccttcaactacctcgtcgaggacggattcacgtactgtgtggttgctgttgagtcagttggccgacaaatccccataggtttcctggacagagttaaggaagacttcacgaaaaaatatggtggtggaaaagcagctactgcagcagcaaacagcttgaacagggagtttggatcaaaacttaaggagcacatgcagtactgtgtggaccacccagaggaggtcagcaagcttgccaaggtgaaagcccaagtctcagaagtcaaaggagttatgatggagaatattgagaaggttctggaccgtggggagaagattgagctgcttgttgacaagactgaaaatctgcgttctcaggcacaagatttcaggcagcagggcacccaggtgcggcgaaagatgtggctgcagaacatgaagatcaagctgatcgtcctgggcattatcattgcgctcatccttatcatcatcctgt

SEQ ID NO: 25943 - protein, 211 aa, Panicum virgatum
  misc_feature: Ceres CLONE 1865925
  misc_feature (127)..(211): Pfam Name: Synaptobrevin Pfam Description: Synaptobrevin
MGQQQLIYAFVARGTVVLAEYTEFTGNFTTIAAQCLQKLPASNNKFTYNCDGHTFNYLVEDGFTYCVVAVESVGRQIPIGFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTQVRRKMWLQNMKIKLIVLGIIIALILIIIL

SEQ ID NO: 25944 - DNA, 356 bp, Panicum virgatum
  misc_feature: Ceres CLONE 1865933
  misc_feature: Encodes the peptide sequence at SEQ ID NO. 25945
gaggctatggcagtggcggcggtggtggcggcggcggcggccaaggtggtggctctggctatggctccggctccggctccgggtatggttctggtggtggacacaactaagctcagcttcagagccaactacagagtagctcagcttcggagccaactacagagtatatagctataaatgtgtcatcagtgatgcgtttgtctcactgtttaaagaaaacttcttatttgagtgtgtgtaacactaaaaacttgtttgacagtatatacatgtaatgatgtacctagcttgccgctttatctaattggcaagggctaaggaataaataaaccaatcttttggcttggaattatact

SEQ ID NO: 25945 - protein, 35 aa, Panicum virgatum
  misc_feature: Ceres CLONE 1865933
  misc_feature: Useful for making plants with modulated nitrogen use efficiency
  misc_feature: Useful for making plants with altered alkaloid content
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with modulated flowering time
  misc_feature: Useful for making plants with modulated biomass
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 644 in the 10/666,642 US patent application
  misc_feature: Useful for making plants with modulated phosphate use efficiency
  misc_feature: Useful for making plants with altered cell wall content and/or composition
  misc_feature: The sequence is a functional homolog of SEQ ID NO 2 in US patent 7189892
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Useful for making plants with modulated heat sensitivity
  misc_feature: Useful for making plants with modulated low light sensitivity
  misc_feature: The sequence is a functional homolog of SEQ ID NO 1391 in the 10/374,780 US patent application
  misc_feature: The sequence is a functional homolog of SEQ ID NO 1844 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 791 in the 10/374,780 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 1016 in the 11/435,388 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 1929 in the 10/374,780 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: The sequence is a functional homolog of SEQ ID NO 60 in the 10/675,852 US patent application
  misc_feature: Useful for making plants with altered carbohydrate content
  misc_feature: The sequence is a functional homolog of SEQ ID NO 1091 in the 10/412,699 US patent application
  misc_feature: The sequence is a functional homolog of SEQ ID NO 1279 in the 10/666,642 US patent application
  misc_feature: The sequence is a functional homolog of SEQ ID NO 636 in the 10/374,780 US patent application
  misc_feature: The sequence is a functional homolog of SEQ ID NO 120 in the 10/225,066 US patent application
  misc_feature: The sequence is a functional homolog of SEQ ID NO 218 in the 10/374,780 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1014 in the 11/435,388 US patent application
  misc_feature: The sequence is a functional homolog of SEQ ID NO 1018 in the 11/435,388 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 1755 in the 10/374,780 US patent application
  misc_feature: The sequence is a functional homolog of SEQ ID NO 1412 in the 10/374,780 US patent application
  misc_feature: The sequence is a functional homolog of SEQ ID NO 2318 in the 10/374,780 US patent application
  misc_feature: The sequence is a functional homolog of SEQ ID NO 240 in the 10/225,066 US patent application
  misc_feature: The sequence is a functional homolog of SEQ ID NO 2854 in the 10/374,780 US patent application
  misc_feature: The sequence is a functional homolog of SEQ ID NO 464 in the 10/225,066 US patent application
  misc_feature: The sequence is a functional homolog of SEQ ID NO 468 in the 11/479,226 US patent application
  misc_feature: The sequence is a functional homolog of SEQ ID NO 128 in the 10/374,780 US patent application
  misc_feature: The sequence is a functional homolog of SEQ ID NO 232 in the 10/714,887 US patent application
  misc_feature: The sequence is a functional homolog of SEQ ID NO 232 in the 11/435,388 US patent application
  misc_feature: The sequence is a functional homolog of SEQ ID NO 416 in the 10/412,699 US patent application
  misc_feature: The sequence is a functional homolog of SEQ ID NO 754 in the 10/225,066 US patent application
GYGSGGGGGGGGGQGGGSGYGSGSGSGYGSGGGHN

SEQ ID NO: 25946 - DNA, 744 bp, Panicum virgatum
  misc_feature: Ceres CLONE 1865938
  misc_feature: Encodes the peptide sequence at SEQ ID NO. 25947
acaaaaaaaaactgaaatcttctttcgtttcttgttgcgttggcccgagcagagactgctcctccttaatttgaaggaacaagcaagaaaaggagagaaagatgaccagcgtttggaagaccaaggttctgcccggcctcaacaagatctttgacaaggatggcaagaaggcggcggcggccgagttcctaaagtccttcaacaaggaggagattggcaaggagattgaggacaagaagacagagctggagcccaaggttgtggaggcttatgaagcatctcctcctgaagttaaggctctgttcaaggacaagaaaccagtcaagatcagcaagaagaactcggctgcagctaccaagttgctcgacgagctggctaagattgagttccctggagccaagctggtgagcgacgcggtggccaagtccggcaccacgcccctctccccggcgatcaccttcatcttggacaaggttgcgccgttcatccccaaggaggagcccaaggccgagccggaggccacctctcgggaagtcgccgtcgaggagaagaaggaggaggccgagcccccggccgctgcggcgacggaggaggctgcgccggcaccggcggaggcgtcggaggcggtagaggagaagaaggctgaggaggagaagccgacggaagccgcagccgaggccgcggcggcgccaccagctgaggaggagaagaagtgatcgccacgccagtcgacactgaatgaag

SEQ ID NO: 25947 - protein, 204 aa, Panicum virgatum
  misc_feature: Ceres CLONE 1865938
  misc_feature (2)..(204): Pfam Name: DREPP Pfam Description: DREPP plasma membrane polypeptide
MTSVWKTKVLPGLNKIFDKDGKKAAAAEFLKSFNKEEIGKEIEDKKTELEPKVVEAYEASPPEVKALFKDKKPVKISKKNSAAATKLLDELAKIEFPGAKLVSDAVAKSGTTPLSPAITFILDKVAPFIPKEEPKAEPEATSREVAVEEKKEEAEPPAAAATEEAAPAPAEASEAVEEKKAEEEKPTEAAAEAAAAPPAEEEKK

SEQ ID NO: 25948 - DNA, 687 bp, Panicum virgatum
  misc_feature: Ceres CLONE 1865958
  misc_feature: Encodes the peptide sequence at SEQ ID NO. 25949
ccgccgcccccacccaaactctagcgccgccgccgctgcgatcccagcagccgccaccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccgggcgctcccggttcaaggacatcgacatgaggatccgcgtccgcggcggagggaagacgtcgcagatctacgccatccgccaggccgtcgccaaggcgctcgtcgcttacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaagtcttaccgttaagcagcgatcgtttgacgcgtcacaatctgccagatcactatgggtgttcttggcttcgtgccctatcatcggagcaacttatctggttctatatctagcggctactttgcctccaagtttagacttttaagcctagtgtcggacctttttttgacattgtgatatgaaatgtg

SEQ ID NO: 25949 - protein, 149 aa, Panicum virgatum
  misc_feature: Ceres CLONE 1865958
  misc_feature (17)..(149): Pfam Name: Ribosomal_S9 Pfam Description: Ribosomal protein S9/S16
MAAVLTRPAAGTVQCFGRKKTAVAVAYTKPGRGLIKVNGVPIELIRPEILRLKAFEPIMLAGRSRFKDIDMRIRVRGGGKTSQIYAIRQAVAKALVAYFQKYVDEAAKKEVKDIFGRYDRTLLVADPRRCEPKKFGGRGARARFQKSYR

SEQ ID NO: 25950 - DNA, 554 bp, Panicum virgatum
  misc_feature: Ceres CLONE 1865962
  misc_feature: Encodes the peptide sequence at SEQ ID NO. 25951
gacgcattctggccttgtagtaggagagaggaagcagtacggcgaaaatgtcgaaaacttcaccggcttccgtcctatcgcttccgatcctcttccttctcctgacagtcacttgtaaagcggccaccggtgctccaacttcttgcacacctccgccttgccaaggaaagcagagctggccggagctcgtcgggaaggaccaggacacggcgtacttggtcatacggcgtgacaacccgcaggtgacggatgtcgtctacttgatctcagatgtgcttgcgcatgctctcgacagcaggaaggatgtgctcggggcggccggcgacggcgacttctgctgcaaccgcgtggttgtggtgctcggcactctgtcctccggcggtgaaggggtcatcaagttgccaaaagtcggctagaattagtttgtgcccgtacatggcaatgcaaatggtaactcaacgaattagccaataagatgttgaacgttttcttcccttttcatgtttttctttgcaatactaattctacgggtaatcactcccattgcatctttc

SEQ ID NO: 25951 - protein, 122 aa, Panicum virgatum
  misc_feature: Ceres CLONE 1865962
  misc_feature (41)..(122): Pfam Name: potato_inhibit Pfam Description: Potato inhibitor I family
MSKTSPASVLSLPILFLLLTVTCKAATGAPTSCTPPPCQGKQSWPELVGKDQDTAYLVIRRDNPQVTDVVYLISDVLAHALDSRKDVLGAAGDGDFCCNRVVVVLGTLSSGGEGVIKLPKVG

SEQ ID NO: 25952 - DNA, 529 bp, Panicum virgatum
  misc_feature: Ceres CLONE 1865995
  misc_feature: Encodes the peptide sequence at SEQ ID NO. 25953
aaagtaccacacggtacagaccagagcagcacaaacatcaccatggcctcccagactctccgccgccgtgccgcaattccacggactgcgtggatacgcctcgccccggtccgtggcggcgctgacgccggtgagggccggcaggaagcgggcgcagggcatccggtgcgactacatcggctcggccaccaaccagatcatggtgctgtcgacgacgctgatgctggtcgcagggcggttcgggctggcgccgtcggccaaccggaaggcgacagcaggtctgaaactggagtccccccactccggactgcaaaccaaagaccccgccggattcacgctcgacgacacgctggcctgcggagccgacggtcacatcatcggagtcagaatcgtgctcaggatcaagaacaccggagagctcgcaccagatcatcggctaggaccattgtctgcctagtctctctcgccgacgaccggtgcccatgtaaccatgcatctcgtttcgtttcaatggacatagcttgttgcc

SEQ ID NO: 25953 - protein, 151 aa, Panicum virgatum
  misc_feature: Ceres CLONE 1865995
  misc_feature (60)..(140): Pfam Name: PSI_PSAK Pfam Description: Photosystem I psaG / psaK
KYHTVQTRAAQTSPWPPRLSAAVPQFHGLRGYASPRSVAALTPVRAGRKRAQGIRCDYIGSATNQIMVLSTTLMLVAGRFGLAPSANRKATAGLKLESPHSGLQTKDPAGFTLDDTLACGADGHIIGVRIVLRIKNTGELAPDHRLGPLSA

SEQ ID NO: 25954 - DNA, 722 bp, Panicum virgatum
  misc_feature: Ceres CLONE 1866022
  misc_feature: Encodes the peptide sequence at SEQ ID NO. 25955
gatcaaaaacaaaaccatcgccacccctctctctcacctgctgccaatcaaccaagaagcacgcgcagccacaccaagtcagggagaaggccatggccggcgtgaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagatgaacgacaagaagaggctggccaccagcggcgccaacttcgcgcgcgcctacaccgtcgagttcggcagctgccagttcccctacaacttcaccggctgccaggacctcgccaagcagaagaaagttcccttcatcaccgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcattgtatctgtgccatctcatcatcgtctgaacatgaacctcttgtattggggagtgtgaaaaaaaaaaaaaa

SEQ ID NO: 25955 - protein, 150 aa, Panicum virgatum
  misc_feature: Ceres CLONE 1866022
  misc_feature (9)..(150): Pfam Name: PsaN Pfam Description: Photosystem I reaction centre subunit N (PSAN or PSI-N)
MAGVNSTSVVGLKPAAAVPQAATSSPAAKRVQVAPKDRAAEGRRAALLGLAAVFAVTATTGSAKAGIIDEYLEKSKANKEMNDKKRLATSGANFARAYTVEFGSCQFPYNFTGCQDLAKQKKVPFITDDLEIECEGKEKYKCGSNVFWKW

SEQ ID NO: 25956 - DNA, 725 bp, Panicum virgatum
  misc_feature: Ceres CLONE 1866025
  misc_feature: Encodes the peptide sequence at SEQ ID NO. 25957
ctccactgccgcgaaactgccgatttcactccacacaacccctgctcttcccccgcccgcgcgccgcaggagctccccagatctccatccgctcccaggagctccgtcccctctccaatggcggtcaaggtctacgtcgtgtactattccacgtacggacatgttggtaaactagctgaagagatcaagaaaggtgcctcttctgttgaaggtgttgaggctaaaatatggcaggtccctgaaactctccctgaggaagtgcttggaaagatgggcgcaccccctaagcctgatgtgccagttatcacaccgcaagagcttgctgaggctgatggaatcctcttcgggtttccgacaaggtttggcatgatggcagcacaaatgaaggcgttcttcgacgccactggtggcctgtggagggagcagagtcttgctggcaagcccgctggcatcttcttcagcaccggaacccagggaggtggccaagagactacaccgttgacagcgattacccagctgactcaccacggcatggtgtttgtgccggtgggctacaccttcggcgccaagctgttcggcatggaccaggttcagggtggcagcccctacggcgcgggcacgttcgccgccgacggctcgaggtggccgagcgaggtggagctggagcacgccttccaccaggggaagtacttcgcgggcatcgcgaagaagctcaaggggtctgc

SEQ ID NO: 25957 - protein, 202 aa, Panicum virgatum
  misc_feature: Ceres CLONE 1866025
  misc_feature (7)..(138): Pfam Name: Flavodoxin_1 Pfam Description: Flavodoxin
MAVKVYVVYYSTYGHVGKLAEEIKKGASSVEGVEAKIWQVPETLPEEVLGKMGAPPKPDVPVITPQELAEADGILFGFPTRFGMMAAQMKAFFDATGGLWREQSLAGKPAGIFFSTGTQGGGQETTPLTAITQLTHHGMVFVPVGYTFGAKLFGMDQVQGGSPYGAGTFAADGSRWPSEVELEHAFHQGKYFAGIAKKLKGS

SEQ ID NO: 25958 - DNA, 773 bp, Panicum virgatum
  misc_feature: Ceres CLONE 1866040
  misc_feature: Encodes the peptide sequence at SEQ ID NO. 25959
agcaggccgtgccggtgccacctcgagaacgcaagtcgcgagctttggagccatctcaggagggaggacgaggctacgtccaggaggctcggcagaagatcgccggggacagcgcgcgccatgaagctcgcggagcggggcgacgagccggagtcggagcggcggcgcgggtacaagggcgtgcggcggcggcgctggggcaagtgggtgtcggagatccgggtgcccggcacgcgggagcgcctgtggctcggctcctacgccacgcctgaggccgccgccgtcgcgcacggcaccgccgtctacctcctccgcggcgggaccggcgcgggcgccgccgccgccgccggcgacgtcgcggcgctcaactttcccgagcgcgcggcggccgcgtacggcgcgggccggctgtcgccgcggtccgtgcagcgcgtggcgtcggacgccggcatggccgccgacgcgcagctcgtggcggcgcgggacagcgcgcccgcgcacaggcacgcggatcgtcgcaccggcatcgccagcgcgcaaggcggcggcgcgagcgcgcggccgcgcgatcaggacgctggcgcgtacacgagccaagcgcgtgctaccagtaacagtgcgggggcgagcagggagcagcagcctgtctccggggagattagcgtggatgacatagagattctggtgtaataactagtcaaaataaagatagaactgaaattaactgcgcaatgaataacttttttggcacgtacagtgccattgccgaatcc

SEQ ID NO: 25959 - protein, 189 aa, Panicum virgatum
  misc_feature: Ceres CLONE 1866040
  misc_feature (16)..(67): Pfam Name: AP2 Pfam Description: AP2 domain
  misc_feature: The sequence is a functional homolog of SEQ ID NO 156 in the 11/375,241 US patent application
  misc_feature: The sequence is a functional homolog of SEQ ID NO 2227 in the 10/666,642 US patent application
  misc_feature: The sequence is a functional homolog of SEQ ID NO 90 in the 10/714,887 US patent application
  misc_feature: The sequence is a functional homolog of SEQ ID NO 90 in the 11/435,388 US patent application
  misc_feature: The sequence is a functional homolog of SEQ ID NO 505 in the 10/374,780 US patent application
  misc_feature: The sequence is a functional homolog of SEQ ID NO 703 in the 10/666,642 US patent application
  misc_feature: The sequence is a functional homolog of SEQ ID NO 154 in the 11/375,241 US patent application
  misc_feature: The sequence is a functional homolog of SEQ ID NO 2235 in the 10/666,642 US patent application
  misc_feature: The sequence is a functional homolog of SEQ ID NO 98 in the 10/714,887 US patent application
  misc_feature: The sequence is a functional homolog of SEQ ID NO 98 in the 11/435,388 US patent application
  misc_feature: The sequence is a functional homolog of SEQ ID NO 100 in the 10/714,887 US patent application
  misc_feature: The sequence is a functional homolog of SEQ ID NO 100 in the 11/435,388 US patent application
  misc_feature: The sequence is a functional homolog of SEQ ID NO 162 in the 11/375,241 US patent application
  misc_feature: The sequence is a functional homolog of SEQ ID NO 2237 in the 10/666,642 US patent application
  misc_feature: The sequence is a functional homolog of SEQ ID NO 160 in the 11/375,241 US patent application
  misc_feature: The sequence is a functional homolog of SEQ ID NO 164 in the 11/375,241 US patent application
  misc_feature: The sequence is a functional homolog of SEQ ID NO 2233 in the 10/666,642 US patent application
  misc_feature: The sequence is a functional homolog of SEQ ID NO 96 in the 10/714,887 US patent application
  misc_feature: The sequence is a functional homolog of SEQ ID NO 96 in the 11/435,388 US patent application
  misc_feature: The sequence is a functional homolog of SEQ ID NO 12 in the 10/714,887 US patent application
  misc_feature: The sequence is a functional homolog of SEQ ID NO 12 in the 11/435,388 US patent application
  misc_feature: The sequence is a functional homolog of SEQ ID NO 142 in the 10/225,068 US patent application
  misc_feature: The sequence is a functional homolog of SEQ ID NO 1496 in the 10/666,642 US patent application
  misc_feature: The sequence is a functional homolog of SEQ ID NO 152 in the 11/375,241 US patent application
  misc_feature: The sequence is a functional homolog of SEQ ID NO 408 in the 10/374,780 US patent application
  misc_feature: The sequence is a functional homolog of SEQ ID NO 440 in the 10/225,066 US patent application
  misc_feature: The sequence is a functional homolog of SEQ ID NO 166 in the 11/375,241 US patent application
  misc_feature: The sequence is a functional homolog of SEQ ID NO 2231 in the 10/666,642 US patent application
  misc_feature: The sequence is a functional homolog of SEQ ID NO 94 in the 10/714,887 US patent application
  misc_feature: The sequence is a functional homolog of SEQ ID NO 94 in the 11/435,388 US patent application
  misc_feature: The sequence is a functional homolog of SEQ ID NO 32 in US patent 7238860
  misc_feature: Useful for making plants with altered lignin content
  misc_feature: Useful for making plants with altered terpenoid content
  misc_feature: Useful for making plants with modulated salt sensitivity
  misc_feature: The sequence is a functional homolog of SEQ ID NO 242 in the 11/375,241 US patent application
  misc_feature: The sequence is a functional homolog of SEQ ID NO 1350 in the 10/666,642 US patent application
  misc_feature: The sequence is a functional homolog of SEQ ID NO 202 in the 11/375,241 US patent application
  misc_feature: The sequence is a functional homolog of SEQ ID NO 30 in the 10/412,699 US patent application
  misc_feature: The sequence is a functional homolog of SEQ ID NO 420 in the 11/435,388 US patent application
  misc_feature: The sequence is a functional homolog of SEQ ID NO 468 in the 10/225,066 US patent application
  misc_feature: The sequence is a functional homolog of SEQ ID NO 8 in the 10/374,780 US patent application
MKLAERGDEPESERRRGYKGVRRRRWGKWVSEIRVPGTRERLWLGSYATPEAAAVAHGTAVYLLRGGTGAGAAAAAGDVAALNFPERAAAAYGAGRLSPRSVQRVASDAGMAADAQLVAARDSAPAHRHADRRTGIASAQGGGASARPRDQDAGAYTSQARATSNSAGASREQQPVSGEISVDDIEILV

SEQ ID NO: 25960 - DNA, 599 bp, Panicum virgatum
  misc_feature: Ceres CLONE 1866049
  misc_feature: Encodes the peptide sequence at SEQ ID NO. 25961
ctcagcctcagcctcccgccgccgccgctctcttctccggagaccctcccctcccgagaccagcgagcgcggagacgccggagcgaaccctcgcctgccactatggtgctctagaacgacatcgacctgctgaacccgccgacggagctggagaggctcaagcacaagaagaagcgcctcgtgcagtcccccaactctttcttcatggatgtcaaatgccagggctgcttcagcatcactaccgtgttcagccactcccagacggtggtggtctgccctggctgccagatggtgctctgccagccgacaggcgggaaggccaggctaaccgaggggtgctccttccgccgcaagggcgactaaatctttgtgacgcaaaagctctgctgatggagctgctagttcccaggatgtagtctgaaagttttgcgaatggctgctatgtgaacccatgctctttgaatctcttgctagaagttacgttgagacactggtaccttattatattctacaattgggtaaggaaggtcagactagccgtgtgtcctgatgatattcggcgtcaatgaatcgttattcctggtgctgttggatgaccc

SEQ ID NO: 25961 - protein, 52 aa, Panicum virgatum
  misc_feature: Ceres CLONE 1866049
  misc_feature (1)..(50): Pfam Name: Ribosomal_S27e Pfam Description: Ribosomal protein S27
MDVKCQGCFSITTVFSHSQTVVVCPGCQMVLCQPTGGKARLTEGCSFRRKGD

SEQ ID NO: 25962 - DNA, 759 bp, Panicum virgatum
  misc_feature: Ceres CLONE 1866070
  misc_feature: Encodes the peptide sequence at SEQ ID NO. 25963
cgacacctccagtactcgtctccctgtccggggctcctctctctctgcagagccttcaggatagacatggctgccgccgttgccgccttctccctcctgctgttcctctccgcccagagcgcggctcccgttcttggcttcacgaggggcgacttcctggaggatttcgtcttcggatccgctacctctgcttatcagtatgagggtgctgttgcagaggatgacaggagcccaagcatctgggataccttcactcacgcaggctatgcaaccataaatggtagtctccatgatactgacagggttgattacatgaagaaccacataaggagcacattgactgcactaaggaatggtgccaatgtgaaaggctacttcgcgtggtgcttcgtggacgtcttcgagtaccttacaggattcaagtcgcactacggcctgtaccgcgttgacttcgaggaccaggcgcttccaaggcaagctaggctctctgctcgctggtactcagaattcctcaagaacaaggagatccagatccgtgaagagaatgagctagacgatgcaggatcgcacgctcagcaatgaatcgtgtgtagttcactgcagtgatttatcctttctcaacatactgtggcagccttcggcagaagaaccatattttacttgagtaaaataaaactggcactctggcaggagatttaccagaattgcgttaataaagaagaggtttaccaagggcctggaagactaaaaagaaaaagg

SEQ ID NO: 25963 - protein, 171 aa, Panicum virgatum
  misc_feature: Ceres CLONE 1866070
  misc_feature: SWISSPROT Homolog: EC 3.2.1.85 6-phospho-beta-galactosidase
MAAAVAAFSLLLFLSAQSAAPVLGFTRGDFLEDFVFGSATSAYQYEGAVAEDDRSPSIWDTFTHAGYATINGSLHDTDRVDYMKNHIRSTLTALRNGANVKGYFAWCFVDVFEYLTGFKSHYGLYRVDFEDQALPRQARLSARWYSEFLKNKEIQIREENELDDAGSHAQQ

SEQ ID NO: 25964 - DNA, 705 bp, Panicum virgatum
  misc_feature: Ceres CLONE 1866132
  misc_feature: Encodes the peptide sequence at SEQ ID NO. 25965
tgagctggatgcaatccgaaaggcgtgtgcatcgctggaagcaaattaccagccacaggtgacttttatcgtggtccagaaacggcaccatacaaggttgtttgcacacaaccacaatgatcagaattcagttgacaggagtggaaacatacttcctggtacagttgtggactcgaagatctgccaccctacagagtttgacttcttcctgtgcagccacgctggcatcaagggcacaagccgtcctgctcactaccatgtcctgtgggatgagaacaacttcacagctgatgcattgcagacccttaccaacaacctctgctacacttatgcgaggtgcacgcgctctgtatctattgtcccgccagcgtactacgctcatctggctgcattccgtgcccgattctacatggagcccgacagctcggacagcgggtcactggcaagtggcgcccgaggaggcagggtgccgtccagctcgtcgacgtcccgcagcacacgcgcggccaccggtggagctgtcaggcccctccccgcgctcaaggacagcgttaagagcgtcatgttctactgctgatggagcatgccatgcctctctacaagctaggcatgcagcaggctgctttgatactgctttgaaattcgagttgcttggtgttggccgttggggttgtttattgatcctcagtaataatctgcttgcta

SEQ ID NO: 25965 - protein, 191 aa, Panicum virgatum
  misc_feature: Ceres CLONE 1866132
  misc_feature (1)..(138): Pfam Name: Piwi Pfam Description: Piwi domain
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 102 in the 10/286,264 US patent application
  misc_feature: The sequence is a functional homolog of SEQ ID NO 1579 in the 11/479,226 US patent application
  misc_feature: The sequence is a functional homolog of SEQ ID NO 2084 in the 10/374,780 US patent application
  misc_feature: The sequence is a functional homolog of SEQ ID NO 752 in the 10/412,699 US patent application
  misc_feature: The sequence is a functional homolog of SEQ ID NO 188 in the 10/666,642 US patent application
  misc_feature: Useful for making plants with modulated biomass
ELDAIRKACASLEANYQPQVTFIVVQKRHHTRLFAHNHNDQNSVDRSGNILPGTVVDSKICHPTEFDFFLCSHAGIKGTSRPAHYHVLWDENNFTADALQTLTNNLCYTYARCTRSVSIVPPAYYAHLAAFRARFYMEPDSSDSGSLASGARGGRVPSSSSTSRSTRAATGGAVRPLPALKDSVKSVMFYC

SEQ ID NO: 25966 - DNA, 698 bp, Panicum virgatum
  misc_feature: Ceres CLONE 1866134
  misc_feature: Encodes the peptide sequence at SEQ ID NO. 25967
atcttcacatctatataaagagacgcattccatttggtgggcagataaatctagcgaagcacaagttctgaacaaatactggcgccggccgcggccgaggtccggcacggcatgcagcagcgctgatgagcagccggtgccgtcactgctggacgcgcagctcgagctctggcaccacaccttgggctacatcaaggccatggcgctcaaggccgccctggacctctgcatcgccgacgccatccaccaccacggcggcgccgccacgctggcccagatagccgccagggtcgcgctccggccgtcgaggaccccttgcctgcgtcgcctcatgcgcgtgctcaccgtcaccggcgtcttcagcaccgcccgacagcgtcccgcgggcgacggcggcggggacgatgagcactccgacgacgcctcctacggtctcacgccggcatctcggctcctggtcggctcgccgagcttgagccctttcctggcgctgatgctcgacggcgccttcgtgtccccgttcctcggcctcggtgcgtggctccagcagggggagcacgagcagctgccggtgccggagcagccgtcgtcgtccctcttcgagatggcgcacgggaagaagccgtgggacctggcgagccgcgacccggccttcacctcgctcttcagcgaaggcatgaacaaaaaggagaagagag

SEQ ID NO: 25967 - protein, 232 aa, Panicum virgatum
  misc_feature: Ceres CLONE 1866134
  misc_feature (67)..(115): Pfam Name: Dimerisation Pfam Description: Dimerisation domain
  misc_feature: SWISSPROT Homolog: EC 2.1.1.146 (Iso)eugenol O-methyltransferase
SSHLYKETHSIWWADKSSEAQVLNKYWRRPRPRSGTACSSADEQPVPSLLDAQLELWHHTLGYIKAMALKAALDLCIADAIHHHGGAATLAQIAARVALRPSRTPCLRRLMRVLTVTGVFSTARQRPAGDGGGDDEHSDDASYGLTPASRLLVGSPSLSPFLALMLDGAFVSPFLGLGAWLQQGEHEQLPVPEQPSSSLFEMAHGKKPWDLASRDPAFTSLFSEGMNKKEKR

SEQ ID NO: 25968 - DNA, 672 bp, Panicum virgatum
  misc_feature: Ceres CLONE 1866136
  misc_feature: Encodes the peptide sequence at SEQ ID NO. 25969
cgcgtgctctgcacggggctggtggcaaggatggagacgacgatggccgtggtcgcgagggcggcggcgccgctcgccgggaccggccgcaggccctccggttcggtgcgggagcgggagggcggccggggcgcgtcgcgccgtcccgcgcggcatcgtcgcatccgcggaggttgagcaaacctacattatgataaaacctgatggagttcagcgtggcttggttggggagatcatttctcgctttgagaagaaaggctttttgttgaaggggttgaagctttatcagtgctccaaggacttggctcaggaacattacaaggatttgaaggacaaaccattctttcccagactggttgattacataacttctggccctgttgtttgcatggcctgggagggtgatggtgttgttgcatcagctcgcaaattaatcggagctactaatccccttcaagctgaaccaggaaccataaggggtgatcttgcagttcgaacaggaaggaatgttgtccatggaagtgatagtcctgataacggcaagcgtgaaatatctctgtggttcaaagaaggtgagctctgccagtgggaatcagttcaaataccttggcttgtagagtaatctcaaccaattgctgtgagatctgtgttgaatttgtgcctgtttcactt

SEQ ID NO: 25969 - protein, 143 aa, Panicum virgatum
  misc_feature: Ceres CLONE 1866136
  misc_feature (1)..(130): Pfam Name: NDK Pfam Description: Nucleoside diphosphate kinase
  misc_feature: SWISSPROT Homolog: EC 2.7.4.6 Nucleoside-diphosphate kinase
MIKPDGVQRGLVGEIISRFEKKGFLLKGLKLYQCSKDLAQEHYKDLKDKPFFPRLVDYITSGPVVCMAWEGDGVVASARKLIGATNPLQAEPGTIRGDLAVRTGRNVVHGSDSPDNGKREISLWFKEGELCQWESVQIPWLVE

SEQ ID NO: 25970 - DNA, 1118 bp, Panicum virgatum
  misc_feature: Ceres CLONE 1866141
  misc_feature: Encodes the peptide sequence at SEQ ID NO. 25971
atccagtccaagctcccgtcactttgccagccgttgccaatcggggtgcagggcggcgatgtcggaggacgcggcggggacgaggagccgggtcctggtggtgggcgccaccggccgcctcggcggcagcctcgcgcgggccagcctcgccgctggccaccccaccgtcgcgctcgtccggccccaccacctcgcccgcccggactccccctcgcagcggccgctcgtagccgccggcgccacgctggtcgaggggtcgctggaggattaccagagcctgctcaaggcagtacggcaggtggacgttgtcatctgcgcggtgcccacgaagcaggcgctcgagcagaagcccctgatccgggcgataaaggaagctggatgcgtgaagagatttattccggctgaatttggagctgatcctacaaaggttcaaattggtgacatggcttatgacttctatgagaagaaaattgaaatccgccatttgatagagaccgaaggcattcctcatacctacatatgctgcaacttctttatgcgctatttgcttccttcactggtgcagccaggcctgaatgctcctcctagagacgaaatgaagatatttggtgaaggaaacactaaaggcgtgtttgttaaggagggtgatgttgctcaatttacaatatgtaccctagatgatcccaggacattaaatcagacgctgtacctgagacctccaggaaatatctgctccatgaatgagctggctgacctctgggagatgaaaattaataaatccctgaaaagggtatatataacagaagagcaactcctaaaagaaatacttgatgcaccatttcccttgaagatggatttagtttttatctattcagcatttgttaagggcgaccacacatattttgaaattgacttgttgagtgaaggaactcaactgtatccccatgtaaaatatacaacagtgggcgagtacttagatacactagtttagaacattgatctatctatatagaacattgatctatctatatatatctttcttgtaattcataagcaatccccttttgtttcaaatggaatattgaaataagtggagcgtagaatttgaatatctatcc

SEQ ID NO: 25971 - protein, 310 aa, Panicum virgatum
  misc_feature: Ceres CLONE 1866141
  misc_feature (12)..(301): Pfam Name: NmrA Pfam Description: NmrA-like family
  misc_feature: SWISSPROT Homolog: EC 1.3.1.45 2'-hydroxyisoflavone reductase
MSEDAAGTRSRVLVVGATGRLGGSLARASLAAGHPTVALVRPHHLARPDSPSQRPLVAAGATLVEGSLEDYQSLLKAVRQVDVVICAVPTKQALEQKPLIRAIKEAGCVKRFIPAEFGADPTKVQIGDMAYDFYEKKIEIRHLIETEGIPHTYICCNFFMRYLLPSLVQPGLNAPPRDEMKIFGEGNTKGVFVKEGDVAQFTICTLDDPRTLNQTLYLRPPGNICSMNELADLWEMKINKSLKRVYITEEQLLKEILDAPFPLKMDLVFIYSAFVKGDHTYFEIDLLSEGTQLYPHVKYTTVGEYLDTLV

SEQ ID NO: 25972 - DNA, 520 bp, Panicum virgatum
  misc_feature: Ceres CLONE 1866155
  misc_feature: Encodes the peptide sequence at SEQ ID NO. 25973
tcaaccattaacaagcaatcctaatgtcggagggtttggtcagggggatgcagaaatagtgcttcaggatccattgcgcgtccaaggccttttgttcttcttcgcatctgttattttggcacaagtttttttggttctcaaaaagaaacagtttgaaaaggttcaattgtacgaaatgaatttctagatcctgggatttcttaccatcaagttagaaaaagcctcgatttctggaattccttatttctatctcatgcaaaagaagaggatccaaggcagaggcgagaacaataaaaggaacaagtccttttagttttaggaggaattgcgggtcttcttaatcctctattgggcacaagaaaaaggcttttttgcctttttcttgtgtcgattcttcttttcttgtatcgaagtaagaatcatttttcttcttatttgttttgtcaaagattactatttattctttattcgggtctttcttttggacttcctttgcttaggttcgggcgcagtagtggac

SEQ ID NO: 25973 - protein, 61 aa, Panicum virgatum
  misc_feature: Ceres CLONE 1866155
  misc_feature (1)..(61): Pfam Name: Apocytochr_F_C Pfam Description: Apocytochrome F, C-terminal
QPLTSNPNVGGFGQGDAEIVLQDPLRVQGLLFFFASVILAQVFLVLKKKQFEKVQLYEMNF

SEQ ID NO: 25974 - DNA, 685 bp, Panicum virgatum
  misc_feature: Ceres CLONE 1866157
  misc_feature: Encodes the peptide sequence at SEQ ID NO. 25975
attcccccacagcacaaagcagctagacatccactcagctcacacactgcagctagcatttgcttagcttagcaggagcatcatatcgataataataatacaatgacaatggctttgatgatgaagaacaacaggatgcaggcggtggtggcgttggccgtcgtcatggcagctgcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctgaacagcgcggcgcggacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccacagactgcaacaagtacgtcgtatatatacgtcttgcctgcaaattactgatcttgtatatgtacatgattcgtgccgcgatttattttcttctttaatttggcgcatgcatgcagggtcaactaaattaatggaatatatgtacataccagctgatcgacgatgacaagcttggtgacgtcgtccttcacaagatagctgctacgaggcagctatatatttaat

SEQ ID NO: 25975 - protein, 149 aa, Panicum virgatum
  misc_feature: Ceres CLONE 1866157
  misc_feature (35)..(120): Pfam Name: Tryp_alpha_amyl Pfam Description: Protease inhibitor/seed storage/LTP family
MALMMKNNRMQAVVALAVVMAAAALVASASAAITCGQVGSALAPCIPYATGKASALPSSCCGGVRSLNSAARTSADRQAACRCLKSLASTVKSVNMGTVATIPGKCGVSVPFPISMSTDCNKYVVYIRLACKLLILYMYMIRAAIYFLL

SEQ ID NO: 25976 - DNA, 622 bp, Panicum virgatum
  misc_feature: Ceres CLONE 1866160
  misc_feature: Encodes the peptide sequence at SEQ ID NO. 25977
gtgcccgtctcacattgtcacactgcggagctgccagggtaggaagagaagagagaagggaggcaggatgccccacagccgcttctcggggtcgctccgctcgcccaagatcgacgtcgtcatcgacatggggaaccccttcctcaaccggaccgtccacggcttcctcaagatcggcgcggtcggcgcttgcaaggtggccgccgaggagaccttcgagtgcctccatagaggggatgtttcaaagcacaagcttgagcatgcactaaagaaaatgtgcaaggagggtgcttactggggtactgttgctggagtttatgtgggcatggtgtatggagtggaaagggtccgtggtcgtagtgactggaagaatgcaatgataggaggcgcattatctggtgccctaatctctggtgccagcaacaaccacaaagacaaaatcatcaaggacgccatcactgccggcgcagttgcaacagctgttgagttcatcaactaccttacctagttatgcaactgcatttgcagtgccattgtcgtacaataacaacaagaacttcttcagtgaagccatgtccggttcaataaaccaacatcttcagtcgtggttgccgaaaaaatc

SEQ ID NO: 25977 - protein, 146 aa, Panicum virgatum
  misc_feature: Ceres CLONE 1866160
  misc_feature (18)..(146): Pfam Name: Tim17 Pfam Description: Tim17/Tim22/Tim23 family
MPHSRFSGSLRSPKIDVVIDMGNPFLNRTVHGFLKIGAVGACKVAAEETFECLHRGDVSKHKLEHALKKMCKEGAYWGTVAGVYVGMVYGVERVRGRSDWKNAMIGGALSGALISGASNNHKDKIIKDAITAGAVATAVEFINYLT

SEQ ID NO: 25978 - DNA, 658 bp, Panicum virgatum
  misc_feature: Ceres CLONE 1866161
  misc_feature: Encodes the peptide sequence at SEQ ID NO. 25979
gcgtttcacggggatatcgagctgggccaatggaaccacggcgcttgatgccgctcccgcccaggaggcgagcccggtaggagaacctgctgctcctgctcacgccgaagcaaagggatcgcctgcgccggagcaggacgagctggagcggcttctgcgcgccgtcgcggacgaggaccggacggtgatcatgacgtccgtgaacgaggcgtgggcggcggacgactcgctgctggacctcttcctcgagagcttccgcacgggcgagcgcatctcgcacttcgcgaaccacctcctcgcggtggcgctcgacggcggcgccctcgagcggtgccgcgccgtgcacccgcactgctacctcctccccgcggccaccggccgcaacctctccgacgagaaggtgttcatgagcaaggactacatcgacctggtgtggagcaaggtccggctgcagcagaggatcctcgagctcggatacaacttcctcttcacggacgtgtacattctatggttccgcgagtcgttcccggggaagcacgagcagcacgtgctgaacgacatcaaggtggagctggtggccacgcggggcctgcgcatccagttcctgcacaccgaccacaacgccgggttctgcaacaacacccgcgacttcaacacg

SEQ ID NO: 25979 - protein, 218 aa, Panicum virgatum
  misc_feature: Ceres CLONE 1866161
  misc_feature: Useful for making plants with altered carbohydrate content
RFTGISSWANGTTALDAAPAQEASPVGEPAAPAHAEAKGSPAPEQDELERLLRAVADEDRTVIMTSVNEAWAADDSLLDLFLESFRTGERISHFANHLLAVALDGGALERCRAVHPHCYLLPAATGRNLSDEKVFMSKDYIDLVWSKVRLQQRILELGYNFLFTDVYILWFRESFPGKHEQHVLNDIKVELVATRGLRIQFLHTDHNAGFCNNTRDFN

SEQ ID NO: 25980 - DNA, 597 bp, Panicum virgatum
  misc_feature: Ceres CLONE 1866185
  misc_feature: Encodes the peptide sequence at SEQ ID NO. 25981
aagctcagcacactaacgaacagtagtcgcatcccatccaatccgctgtccaagcacgagcgcaggctagctaggagagatgggtgaccggcaactcgggcaggatgcagacagggaaggtgaagctgaaggacatggcgagcgaggcgaaggagaaggtgaaggaagcgtcggccaagatgcagggcaaggcgggcgaggcgacggcgaccacgcacgacgagaaggagatggccaaggaggaggcccgcgccaagaaggaccaggccagcgccgacaagcaccaggagaaggccgagcaccgcgccgacgccgccgccggacgccacggcacgggcgtgcccctcaccgggacgcacggcgcggccgtcgaccccgcctgcccgtccgccggcaccacgtacccggcgtcgggcaagtacatctaggctaggggatcggtagggatcgcttggtcgtcctacgtttttgtgtagcgactggcgaccgagctgggtggggatcgatcagtccttgaataatggaagtgtatcagaggtagaagtgaagcttcgtttcagttgtactccaatcatgtactgtgtggtactgtttttt

SEQ ID NO: 25981 - protein, 107 aa, Panicum virgatum
  misc_feature: Ceres CLONE 1866185
  misc_feature (1)..(73): Pfam Name: LEA_1 Pfam Description: Late embryogenesis abundant (LEA) group 1
MQTGKVKLKDMASEAKEKVKEASAKMQGKAGEATATTHDEKEMAKEEARAKKDQASADKHQEKAEHRADAAAGRHGTGVPLTGTHGAAVDPACPSAGTTYPASGKYI

SEQ ID NO: 25982 - DNA, 775 bp, Panicum virgatum
  misc_feature: Ceres CLONE 1866225
  misc_feature: Encodes the peptide sequence at SEQ ID NO. 25983
acaccacctagtcggatcgtcgggcacaagctcaagcggcggcggcggcggcggcgaagagcgagcgccgggctcggggccgcatcgggcgggaggacggagtagttcgccccccccctctccctacagcaaagatgccgctgtacgactgcatgctgctggtgaagccgctggtgaccagggaggccatggccgagctggtggcgcgggtggcgcgccgtgcgtaccagcgcaacggggtcgtcaccgacgtcaagtccttcgaaaaggtgcagctcgcatacggcatcaagaagctcgacggccgccactaccagggccagcttatgcaaatgaccatgatggttccaccttccttcactcaagaactccactatctgaacaaggaggacaggctgcttcgctggctggttgtgaagcatagagatgcagtatacggtctggagtacatcaacgaggatgatgggaggaacgagatgaacggtttcagtctcgctcataagaaagttgactacgatatcgaagaatgctctgatgactctgagtcagagttcatgacctcctctgacgaggattctgacaactacaagtatgagggcgaggagaagtagaattgcttgtccagaattctgcagtttctctttattggcagatatcttttctttccaaccatatgttagtcttcctaataccacccgctatagtaggatgaggatttgacagcagaacctatggacttgattgtcacatatttttgcattccagagtatgcctg

SEQ ID NO: 25983 - protein, 158 aa, Panicum virgatum
  misc_feature: Ceres CLONE 1866225
  misc_feature: Useful for making plants with modulated biomass
  misc_feature: Useful for making plants with modulated flowering time
MPLYDCMLLVKPLVTREAMAELVARVARRAYQRNGVVTDVKSFEKVQLAYGIKKLDGRHYQGQLMQMTMMVPPSFTQELHYLNKEDRLLRWLVVKHRDAVYGLEYINEDDGRNEMNGFSLAHKKVDYDIEECSDDSESEFMTSSDEDSDNYKYEGEEK

SEQ ID NO: 25984 - DNA, 747 bp, Panicum virgatum
  misc_feature: Ceres CLONE 1866267
  misc_feature: Encodes the peptide sequence at SEQ ID NO. 25985
gagagagcttcttccgtacatccaccaaagtcccccaaaagacaacagcaagcaagaggaagggacatcgcagaccattagttagttcagccggcgagcaacatccccggtgtcagccatggcgtccattgtaacagcagctaacagccattggggagccctgcacacctgcacagcctcctcaagggcgctcactggttggagccggcgcgcgctcgccgtgccatcagcacaccgcgtgcggtcgccgagagctcgggtcgtcgtccgagccagcgcccagcgcgcgacctggttgcccgggctggacccgcctgctcacctcgacggcacgctaccgggtgacttcggcttcgatcccctggggctcggggaggaaccggctgccttgaagtggtacgtgcaggccgagctcgtgcactgccggttcgccatggcaggggtcgccggcatccttgtaaccgacttgcttcgcgtatcagggatccgggatctaccagtgtggttcgaggcaggtgcagccaaatttgacttcgccaacaccacgtcactcttcttcgttcagcttctcctgatgggattcgctgaaaccaagaggtacatggatttcatcaatccgggatcacaagcagaggaaggaaccttcataggcctagaggctgcactcgtgggctcacagccaggctacccaggaggtccactgtttaatccgttaggactcgcaaagatatagagaatgcacatgaa

SEQ ID NO: 25985 - protein, 204 aa, Panicum virgatum
  misc_feature: Ceres CLONE 1866267
  misc_feature (64)..(204): Pfam Name: Chloroa_b-bind Pfam Description: Chlorophyll A-B binding protein
  misc_feature: Useful for making plants with modulated nitrogen use efficiency
MASIVTAANSHWGALHTCTASSRALTGWSRRALAVPSAHRVRSPRARVVVRASAQRATWLPGLDPPAHLDGTLPGDFGFDPLGLGEEPAALKWYVQAELVHCRFAMAGVAGILVTDLLRVSGIRDLPVWFEAGAAKFDFANTTSLFFVQLLLMGFAETKRYMDFINPGSQAEEGTFIGLEAALVGSQPGYPGGPLFNPLGLAKI

SEQ ID NO: 25986 - DNA, 868 bp, Panicum virgatum
  misc_feature: Ceres CLONE 1866290
  misc_feature: Encodes the peptide sequence at SEQ ID NO. 25987
aataagcttaagccaagtaaggaactgcagcaatcaggtagcaaccgatcggtgtccatggcggccacgagtgctcccaagagcctgctgctctgcttgacagcagtcgcctttcttcaccacctccagtgtcagtacccggctgcagctgcaacatcgctcaggaaaaattggagcagcgacggcggtaacgagaggaccctcaacatcacgctgtaccagcaggagaccatcaacaagaccgcgtacatcgtcgtcgacggcgtggccggcgcgggcgtcagcttgatcactgcgccgttcggcaccatctacgtcttccgcgacgacctcacggtgcgcgccgacagggcctccccggtggccggcgttgcagaggggagctccatcatcaccagcctcgacgggctgcagatcgtgtcgctgagcaaggtcaccatagaccaccgcggctaccggggctccgtgtcggtcctcgggggcacccacagcaccaatccgtccgaatcccccgtggtgggtggcaccggcgacttcgcgtacgcgctgggctacatccggtcgtcgccggtggacctgcagggaagaaagatgacgtacaaggtggagcttcacctgtactggcctccgtacgcccactacgctcctgttgcacacaagcctgtataggtatcactatcagtctatagactatagtatacgtgatatacgcatcatctacgccgttctcaataagcttcctggtcctattgtattttctaagtatatttgtatgagtatacaatttgatagtagcactatacggtggtgtatttttcttctattttttgggatcaaataaaggagcagcgtgagcgtgtttttttcc

SEQ ID NO: 25987 - protein, 203 aa, Panicum virgatum
  misc_feature: Ceres CLONE 1866290
  misc_feature (31)..(187): Pfam Name: Dirigent Pfam Description: Dirigent-like protein
MAATSAPKSLLLCLTAVAFLHHLQCQYPAAAATSLRKNWSSDGGNERTLNITLYQQETINKTAYIVVDGVAGAGVSLITAPFGTIYVFRDDLTVRADRASPVAGVAEGSSIITSLDGLQIVSLSKVTIDHRGYRGSVSVLGGTHSTNPSESPVVGGTGDFAYALGYIRSSPVDLQGRKMTYKVELHLYWPPYAHYAPVAHKPV

SEQ ID NO: 25988 - DNA, 733 bp, Panicum virgatum
  misc_feature: Ceres CLONE 1866311
  misc_feature: Encodes the peptide sequence at SEQ ID NO. 25989
gcgctgcgctccccctcccctcgcacccgcaggctagggttctcctcgagaggcggcgccatgttggtctaccaggatctgctcaccggcgacgagctcctctccgactcgttcccgtacaaggagatcgagaacggcgtgctctgggaggtcgagggcaagtgggtcgtccaaggtgctgttgacgtggacactggtgccaacccttctgctgagggtggcgaggatgagggcgttgacgatcaagcggtaaaggttgtcgacattgtcgacacatttcgtcttcaggaacaacctgcctttgacaagaagcagtttgtcacatttatcaaacgctacatcaagaaccttaccgccaagctggatccggagaaggctgatgaattcaagaagggcattgagggtgccaccaagtatcttcttagcaagctcaaggaccttcagttctttgttggcgagagcatgcatgatgatgggagcttggtgttcgcatactacaaggatggagccaccgacccgaccttcctttactttgcgcacgggttgaaggagattaagtgctaggcgggctttgcgcacgggttgaaggagattaagtgctaggcgggcgtgtgccttcgaccctgtgttgttataatctatgtagtactatccttaattttgttgctgtctgtttgcttgagaatattgttttggaaactactgaactatgtctggaaaggcaaaagataca

SEQ ID NO: 25989 - protein, 167 aa, Panicum virgatum
  misc_feature: Ceres CLONE 1866311
  misc_feature (1)..(164): Pfam Name: TCTP Pfam Description: Translationally controlled tumour protein
MLVYQDLLTGDELLSDSFPYKEIENGVLWEVEGKWVVQGAVDVDTGANPSAEGGEDEGVDDQAVKVVDIVDTFRLQEQPAFDKKQFVTFIKRYIKNLTAKLDPEKADEFKKGIEGATKYLLSKLKDLQFFVGESMHDDGSLVFAYYKDGATDPTFLYFAHGLKEIKC

SEQ ID NO: 25990 - DNA, 744 bp, Panicum virgatum
  misc_feature: Ceres CLONE 1866315
  misc_feature: Encodes the peptide sequence at SEQ ID NO. 25991
agtggagagtggggatccatttggacttggattgatttccccttccgctgacattccgtaagccagcatgccgaagataaagacaagccgtgtttcgtatccggaaggatgggagcttattgaaccaacaatccgtgagttggatgccaaaatgagagaagctgaaaatgatccacatgatgggaagaggaagtgtgaagctctctggccaattttccgtatttctcatcaaaggagccgctacatatatgatctttactacagaaggaaggagatatcacagaagctttatgagttttgcctggaccagggttatgcagaccgtaatctgatagcgaagtggaaaaagccgggttatgagcgcctttgctgccttcggtgcatacagacacgtgaccacaactttgcaacaacttgtgtctgccgagtccccaagcacctcagggaggagcaagtgatcgaatgtgttcattgcgggtgcaggggctgtgccagcggtgactaatcttttcattatgcctttgggctcatgactcatcatctggacctaacacctgagatctcttgtgagcatgggccgataaagagcgacggttgcctatagaggtgattcgcatgaatgtatcggtgcaacttgtaagcctaggatgcctctaaatttcttgatgtttggatgtctcccactgttatgctcagacttgttgactttgtatgtatgtattatgaccatttcacctcatgcag

SEQ ID NO: 25991 - protein, 145 aa, Panicum virgatum; identical to SEQ ID NO: 15514
  misc_feature: Ceres CLONE 1866315
  misc_feature (1)..(143): Pfam Name: G10 Pfam Description: G10 protein

SEQ ID NO: 25992 - DNA, 745 bp, Panicum virgatum
  misc_feature: Ceres CLONE 1866366
  misc_feature: Encodes the peptide sequence at SEQ ID NO. 25993
tagactccatacacccaccctctctacgcgcagctcctcgctgaaccggaacacccgcacacacacgccacttggacaccatggcgccccgggcggcggacaagtcgccggtgccgtcggaggcctgggcatgggcccgcactacaggggcgtgcggaagcgcccgtgggggcggtacgccgcggagatccgcgacccggccaagaagagccgcgtgtggctgggaacgtacgacaccgccgaggaggccgcccgcgcctacgacgctgccgcgcgcgacttccgcggcgccaaggccaagaccaacttcccgttcgcgtcccagtgccccgtcgccgccggcgccggcgccggcagccccagcagcaactgcaccgtggaatcgcgcggaggcggcagcggctgcggcgtccaggcgcccatgcaggccatgccgctgcccccggccctcgatctcgatctcttccaccgggcggcggccgtgaccgcggtctcccccggcggcatgcggtttcccttcaaagggtaccctgtcgcgcgcccgaccccgaacccctacttcttctacgaacaggcggcagcggccgcggccgcggcggccggctaccggatgctcaaggtcgccccgccgccggtcaccgtggccgccgtcgcgcagagcgactccgactcctcgtcggtggttgatcgcaccccttcgccgcccgcggttgccgcaaaaaaggaggtctccttcgatctggat

SEQ ID NO: 25993 - protein, 247 aa, Panicum virgatum
  misc_feature: Ceres CLONE 1866366
  misc_feature (46)..(97): Pfam Name: AP2 Pfam Description: AP2 domain
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
RLHTPTLSTRSSSLNRNTRTHTPLGHHGAPGGGQVAGAVGGLGMGPHYRGVRKRPWGRYAAEIRDPAKKSRVWLGTYDTAEEAARAYDAAARDFRGAKAKTNFPFASQCPVAAGAGAGSPSSNCTVESRGGGSGCGVQAPMQAMPLPPALDLDLFHRAAAVTAVSPGGMRFPFKGYPVARPTPNPYFFYEQAAAAAAAAAGYRMLKVAPPPVTVAAVAQSDSDSSSVVDRTPSPPAVAAKKEVSFDL

SEQ ID NO: 25994 - DNA, 745 bp, Panicum virgatum
  misc_feature: Ceres CLONE 1866377
  misc_feature: Encodes the peptide sequence at SEQ ID NO. 25995
cccactattcgcctttccgcacccgccgctcggtcgccttcgagttccaccagccaccaaacccgccggggagaagtcgagaggagcaagtcgccgagaagaggagagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggctctccaggaggccgccgaggcctacctcgtcgggctattcgaggacaccaacctctgcgccatccacgccaagcgcgtcaccatcatgcccaaggacatccagctagcccgccgcatccgcggcgagcgcgcgtaagccgcagccgccgctgccgtactggtagtggagatgtaggaggtcaagatggaatcggcttgttgatctccgccgcgcttagtggatctggatttagctgtactagttgtcgttctcggtttggttagtgtaaaaacaggtttgcaagtctattttgtgcttcgctgctattttggctctcgcttcgtgatgaagcgacccttgttaagactgttacttgaagtaa

SEQ ID NO: 25995 - protein, 136 aa, Panicum virgatum; identical to SEQ ID NO: 9871
  misc_feature: Ceres CLONE 1866377
  misc_feature (58)..(132): Pfam Name: Histone Pfam Description: Core histone H2A/H2B/H3/H4

SEQ ID NO: 25996 - DNA, 657 bp, Panicum virgatum
  misc_feature: Ceres CLONE 1866378
  misc_feature: Encodes the peptide sequence at SEQ ID NO. 25997
cttctccgccgtcgcctctccactttccccatccttcgccgccgtcgcggtcgcctcgcagtccgaagagccgcccccgactccgatggccagccgctgggtccgacccgaggtgagctttcctcggtcgcttcgtctctctctctctctctctctcatggggcgttgctaccgcgcaggtgtacccgctgttcgcggcgatgggcgtggccgtcggcatctgcggatttcagctcttccggaacatcaccgggaacccggaagtcagggtaaacaagacagggagggcagctggtgtgcttgagaaccatgaggaggggaggcgttacgcaatgcacagcctcagaagctttgtgcatgacaagaccccagaaatcatgccagccatcaacaagttcttcactgagccaaagtgaagcgatttgctcgggtgctgctgctggagtcgctattgtcgagtgtacccatttaaggcattcaatatgtaatgtcatccataaattggaggacagcggatacctcttattaaaagtaccgtgtgagtgattggtgatggcttgctatgtgtatgatggtttatgagtgctgcatcacccctgtttgatgttcatgctcatctgtcatgtggatttgctgtgcctcagtgataaattgcca

SEQ ID NO: 25997 - protein, 71 aa, Panicum virgatum
  misc_feature: Ceres CLONE 1866378
  misc_feature (1)..(71): Pfam Name: B12D Pfam Description: B12D protein
MGVAVGICGFQLFRNITGNPEVRVNKTGRAAGVLENHEEGRRYAMHSLRSFVHDKTPEIMPAINKFFTEPK

SEQ ID NO: 25998 - DNA, 719 bp, Panicum virgatum
  misc_feature: Ceres CLONE 1866383
  misc_feature: Encodes the peptide sequence at SEQ ID NO. 25999
atctgttcctcgtcttgcttggcttcccttctccagttgacttgcttttccatcgcctctccacgactagaggagatgtctgaggtggtggcgatggcggggcaggcgtacatgaggcaactgctggcccacccgctgcgcaccaaggccatcacctccggcgtcctggccggctgcagcgacgccgtcgcccagaagatctccggcgtccccaagctccaactcaggaggctcctcctcatcgcgctatacggatttgcatacgcgggaccgtttggacatttcctccacaagctcatggataggtttttcaagggcaagaaaggaaaagaaacgacagccaagaaggtcttagtagaacagctgaccgcatctccatggaacaacatgatgtttatgatgtattatggtctggtcgttgaagggagaccattcggacaagtgaagagcaaggtgaagaaggactatgcatctgttcagctgacatcttggaagttctggccaattgtaagttggatcaaccatgagtacatgccactccaactccgagttcttttccatagcttcgtcgcatcctgctggcatgcagggcggtgtttttaaacctcaaggcagcaagatccatcgcaaatactcctactaagaaggcataaacaaaggcagctatcgacggaataaatgccatgatctgaactgccgcctgaaagcaaaaccaacat

SEQ ID NO: 25999 - protein, 175 aa, Panicum virgatum
  misc_feature: Ceres CLONE 1866383
  misc_feature (114)..(172): Pfam Name: Mpv17_PMP22 Pfam Description: Mpv17 / PMP22 family
MSEVVAMAGQAYMRQLLAHPLRTKAITSGVLAGCSDAVAQKISGVPKLQLRRLLLIALYGFAYAGPFGHFLHKLMDRFFKGKKGKETTAKKVLVEQLTASPWNNMMFMMYYGLVVEGRPFGQVKSKVKKDYASVQLTSWKFWPIVSWINHEYMPLQLRVLFHSFVASCWHAGRCF

SEQ ID NO: 26000 - DNA, 1107 bp, Panicum virgatum
  misc_feature: Ceres CLONE 1866399
  misc_feature: Encodes the peptide sequence at SEQ ID NO. 26001
tatgaaaaatctagagcatctggaccttagctccaacagaataactgatgacacaattgaacatattgcaaaagttggaacaaacttgaaatatttgagcctcaagggaactgggataacttctcaggccttatgtgttctggcagggacagttccaaacctcacttcactgtctttatctcatacaaaaattgatgactctgctctagcgaatatcagcatgatgcctttgctgagtacgatagatttaagccatacaagtatcaaaggatttactcgtgctgaagtaaatgctgacaaaatgttgtctatgtccgcttttgagcatctcaaatatctggaaagcttaaatctagaggatacaccactatcagctgaagttatacctcccttgggatcgtttgcagcattgaaatatttgtacctgaaaagtgatttcttgtctgatcctgccttgcatgccctctctgctgcctccaatctgatacatcttgggttctgtgggaatattttgtccagctctgggcttttacaatttgtaccccctgccacattacacgtgttagatttaaggggctgttggatcttaacaggtgatgctgtttcaacattctgtaagcggcatcctactattgaagtgaggcatgagctcatgcaggagcttaaggcaagtagtgtcggtatgtcccaacttaaagcttggcaatctcaacaggtgaaagcaaaagtagcaaacagtttcgctggcccaagtaggcttcctgatatccgttttgtagatgaaaggataaaatacgacaaggaggaaatgatggagcttcagaaccttgttaaaccagattcagtaatgcatggcgtgcgacttccaccagaactgcataggctcacatgaaacaaagtttttgttagaccttagtttcttatgcacctgcctaagcatgacattttccttagttcaattatccttgaatgtgacaattttgaaaatagagcatcagcatgatacaacagagttttgctcaaatataaatgtaatatcagtggacaaaatgactgttacctgtctcttggtctctcctacttcaaatatgagtgctattttaattc

SEQ ID NO: 26001 - protein, 296 aa, Panicum virgatum
  misc_feature: Ceres CLONE 1866399
  misc_feature: SWISSPROT Homolog: EC 2.7.11.1 Non-specific serine/threonine protein kinase
MKNLEHLDLSSNRITDDTIEHIAKVGTNLKYLSLKGTGITSQALCVLAGTVPNLTSLSLSHTKIDDSALANISMMPLLSTIDLSHTSIKGFTRAEVNADKMLSMSAFEHLKYLESLNLEDTPLSAEVIPPLGSFAALKYLYLKSDFLSDPALHALSAASNLIHLGFCGNILSSSGLLQFVPPATLHVLDLRGCWILTGDAVSTFCKRHPTIEVRHELMQELKASSVGMSQLKAWQSQQVKAKVANSFAGPSRLPDIRFVDERIKYDKEEMMELQNLVKPDSVMHGVRLPPELHRLT

SEQ ID NO: 26002 - DNA, 754 bp, Panicum virgatum
  misc_feature: Ceres CLONE 1866404
  misc_feature: Encodes the peptide sequence at SEQ ID NO. 26003
attcctcccgccgccgccgaagccccgctcgaagaaatggtgagagtaagtgtgctcaatgatgcccttaagagcatgtacaatgctgaaaagcgtggcaagcgccaggtcatgatcaggccatcatcgaaggtcatcattaagttcctcatcgtcatgcaaaagcatggatacattggggagtttgagtttgttgatgatcatcgttctggtaagatagtagttgaactcaatggaaggctcaacaaatgtggtgtgatcagcccacgctttgatgttggtgtgaaggaaattgagtcctggacagcgaggctgctcccctcacgtcagtttggctacatcgttctaaccacctctgctggcatcatggaccatgaagaggcgaggagaaagaatgtgggagggaaggtccttggcttcttctactaggaaaatctagtatccacatatcagataatcccagtaattgttaagttaaaagaacatagttttgtagctgtctagaagccaaaagcacgcagagatcacctattctgcattgtcttgttctggattttgttgacccatttagtttttgtcactaagttgttgcttggccccctttttagctcgtgcatcagttggatgcaatctgctggtgtacctggtatgttagttctgaatcttggtactatgatgcactcacttgagcggagtgcatgtggagcgatttgctgattcatcctgtatcactgtatttcccaagtcccaactg

SEQ ID NO: 26003 - protein, 130 aa, Panicum virgatum; identical to SEQ ID NO: 12174
  misc_feature: Ceres CLONE 1866404
  misc_feature (5)..(130): Pfam Name: Ribosomal_S8 Pfam Description: Ribosomal protein S8

SEQ ID NO: 26004 - DNA, 714 bp, Panicum virgatum
  misc_feature: Ceres CLONE 1866421
  misc_feature: Encodes the peptide sequence at SEQ ID NO. 26005
aaaggaaacaccacgaaaggaacccgaaagagggggaaaaaaacttcggttttggagctcttggcttgttgcgagcacatgaggatccacccagcagcagcagctcccgccggcggcaaaaaggacctccgccggcttccgcacgtgtacagcaaggggctcgagctgctgctcccggcggacaccgacgtcaaggggttcaaaggccccaaccccttccacttcgtcgccgccggtgcgcgaggcgccggcgtggtgcaggtgcgcaccgggaggatccaccccggggttaccaaggtagtggtgcaggcaggtggcgccggaggcgctaaggaggctggcgccaacaacatgaagctcgtcaccatcctcagcgtctgcctcaccatgtacggcgtcccctccttcaacaaggggaacccgtccacggcgcccacgctcacgctcacggggcgcaaaaaggaggccaacaagctgcaaaccgccaacgggtgggccaagttcaccgaaggcttcttcttcggcggcatctccggcgtgctctgggcatacttcctcctctacgtgctcaacctcccctactacttcaagtagacgtacgggctccatatgcaaatcccctcctctctacacatgtgggtaggtgatgtttgtgtggttcttgattgagcagtgatcgagcacgtgtataaattaatgtattactttctctgg

SEQ ID NO: 26005 - protein, 171 aa, Panicum virgatum
  misc_feature: Ceres CLONE 1866421
  misc_feature (73)..(169): Pfam Name: PsaL Pfam Description: Photosystem I reaction centre subunit XI
MRIHPAAAAPAGGKKDLRRLPHVYSKGLELLLPADTDVKGFKGPNPFHFVAAGARGAGVVQVRTGRIHPGVTKVVVQAGGAGGAKEAGANNMKLVTILSVCLTMYGVPSFNKGNPSTAPTLTLTGRKKEANKLQTANGWAKFTEGFFFGGISGVLWAYFLLYVLNLPYYFK

SEQ ID NO: 26006 - DNA, 752 bp, Panicum virgatum
  misc_feature: Ceres CLONE 1866441
  misc_feature: Encodes the peptide sequence at SEQ ID NO. 26007
agccagcaactcagcagcaatcgactaagacacagtgctactgatctgagaagcttctactgccactagccaacccgccgaggcatctctgcaaggcgaagcaggtcgagggcatggttatggttgtcgcgtcgccggcgtcgggcgagctcggctcgctcttcgcggcgttcgacaaggacgccgacggcaggatctccgcggccgagctgcggctctgcatgcgggcggcgctgggcgaggacgtgacggccgaggacgccgaggcgctggtggcctcggtggacgcggacggcgacggcctgctggacgagggcgagttcgcgcggctggtgcgcgcggaggcggcgggcggcgaggaggaggaggagcggcggcggcgcagggggctcgtggcggcgttcggcatgtacgcggtggagggcgaggggcgcatcacgcccgccagcctgaggcggatgctcagcaggctcggcgcgcgccgggaggtcgacgactgccgcgccatgatccgcaggttcgacctcgacggcgacggggtgctcagcttcgacgaattcgagatcatgatgatgaacgcctgaacaaaatgcgtcacaaggggatccatgcatggcagattgtgattgtggtttctcttgccggctttgtacatttcttttttctgctctttacttttcctttttgcaatgggctctgtacagttcgtagctgcaatggacatacactcggacgaatggaatacatagttt

SEQ ID NO: 26007 - protein, 156 aa, Panicum virgatum
  misc_feature: Ceres CLONE 1866441
  misc_feature (128)..(156): Pfam Name: efhand Pfam Description: EF hand
  misc_feature (12)..(40): Pfam Name: efhand Pfam Description: EF hand
  misc_feature: SWISSPROT Homolog: EC 2.7.11.1 Non-specific serine/threonine protein kinase
MVMVVASPASGELGSLFAAFDKDADGRISAAELRLCMRAALGEDVTAEDAEALVASVDADGDGLLDEGEFARLVRAEAAGGEEEEERRRRRGLVAAFGMYAVEGEGRITPASLRRMLSRLGARREVDDCRAMIRRFDLDGDGVLSFDEFEIMMMNA

SEQ ID NO: 26008 - DNA, 458 bp, Panicum virgatum
  misc_feature: Ceres CLONE 1866447
  misc_feature: Encodes the peptide sequence at SEQ ID NO. 26009
atctgctttggttctccagcaccacaccaccacgctcacgagaagaagcaaggcgtgggccgcgatggacggccgcgccgccgcgatcgatcgccaccagcgtctgctcatcgactcagggcgtgtcctcatgctactcggcaccatcgtcatcacgcaccagctgggcctgagcgaggccgcgcccagcaacgccgggcacctgctcctcgccttcatcctctggctgctcggcgcggcgctcgccatgctgtcggtcgtcgcccggcggttccccaggctcgcggcgaccggcgccgctcttgcgagggcgctgcggaactacttgctcggcggtctctgagccaagcatggcagccccgcaacctacatggctacataccacatgcaatttctttcaaccatcacgtttgaacttcttcacgctcagacctgtttaaaaaataataaaatttctc

SEQ ID NO: 26009 - protein, 92 aa, Panicum virgatum
  misc_feature: Ceres CLONE 1866447
  misc_feature: Useful for making plants with modulated biotic stress sensitivity
MDGRAAAIDRHQRLLIDSGRVLMLLGTIVITHQLGLSEAAPSNAGHLLLAFILWLLGAALAMLSVVARRFPRLAATGAALARALRNYLLGGL

SEQ ID NO: 26010 - DNA, 682 bp, Panicum virgatum
  misc_feature: Ceres CLONE 1866452
  misc_feature: Encodes the peptide sequence at SEQ ID NO. 26011
aagcgaaagctcaagcaatcgaacaacagtcgcctaatccacactcaaatcaagcaccaaacagcctccagatcccccgatagaggtcacccaccgcagcctctgcagcgagatggctcccgagattgccggcaagatgaccgctaaggccgccgccgccgccgccgcggtgaagcccgcgaccagggcgtacgtgacgttcctggcgggtgacggcgactactggaagggcgtggtgggtctggccaagggcctgcgcaaggtcggctcggcgtacccgctggtggtcgccgtgctgcccgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggaggtaatcaactgatccacgaaccgccgcttgacctttctcgtgcttaattcttcgataatgctgtgctcatcactgacatgccgccggccggcgggttcttcttcctgccgcagttcgtggagtacgagcggatggtgtacctggacgcggaggccggcacggtcaagtacgtcaccgcgccgtcggccgcgtgatccccgtgctgcggctggagtgttcatcactcatcagaacata

SEQ ID NO: 26011 - protein, 114 aa, Panicum virgatum
  misc_feature: Ceres CLONE 1866452
  misc_feature: Useful for making plants with altered carbohydrate content
  misc_feature: Useful for making plants with altered cell wall content and/or composition
  misc_feature: Useful for making plants with modulated water use efficiency
MAPEIAGKMTAKAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEVIN

SEQ ID NO: 26012 - DNA, 728 bp, Panicum virgatum
  misc_feature: Ceres CLONE 1866459
  misc_feature: Encodes the peptide sequence at SEQ ID NO. 26013
ggatcagaatccagtcacgcgaattccctgaccggtcatcgtcgtcccatccggctccggcgacctcctgccccttctcctccaccgccgccgccgccgcccgtgggtccacccgagatggggagcacctcctccatgctcacccagtacgacatcgaggaggtccaggaccactgcgaccacgccttctcgcagcaggagatcgtgtccttgtaccagcgcttctgccagctcgaccgcaacggcggcggcttcgtctccgccgacgagttcatgtccgtccccgagttcgcagtcaatcccctctcccagaggctcctgcggatgctggatgggctcaacttcaaggagtttgtggcgtttttatctgcgtttagcccccgcacaagcctgcagcaaaagattgaatttatttttagggtttatgacactgactgcaacgggaaggttgcatttgatgacatcttgagcatcttgcgagatctgacgggctcgtttatgacagagcaacagagacagaaagtcttgactcatgtgttagaagaagctggctacacaaaagattcacatttcactctcccagactttatgaagattcttggcaattctgagctcaagatggaggttgaagttcccattgactaataacttaataattatctgtatagttgtatcgtcatgctgttgctcagtgtgtcttcatttgtgttagattgggttgatggttt

SEQ ID NO: 26013 - protein, 175 aa, Panicum virgatum
  misc_feature: Ceres CLONE 1866459
  misc_feature (95)..(123): Pfam Name: efhand Pfam Description: EF hand
  misc_feature: SWISSPROT Homolog: EC 1.6.3.1 NAD(P)H oxidase
MGSTSSMLTQYDIEEVQDHCDHAFSQQEIVSLYQRFCQLDRNGGGFVSADEFMSVPEFAVNPLSQRLLRMLDGLNFKEFVAFLSAFSPRTSLQQKIEFIFRVYDTDCNGKVAFDDILSILRDLTGSFMTEQQRQKVLTHVLEEAGYTKDSHFTLPDFMKILGNSELKMEVEVPID

SEQ ID NO: 26014 - DNA, 702 bp, Panicum virgatum
  misc_feature: Ceres CLONE 1866493
  misc_feature: Encodes the peptide sequence at SEQ ID NO. 26015
acggcactgcgaagccagaaagaactacacgaggaagaaggttctagcgactcggtagcaacgaagcaagcgccatggggaacaagcggcagctgatctgcctcgccgccgccgccgtcgccgccgcggccatcctcctgacagcgtcggcaaagaagaccggcgacgtcaccgagcttcagatcggcgtcaaggggacactcactgatggatcagtatttgattctagctatgacagaggtgacccatttgaatttactcttggaaatggccaagtgataaaaggttgggaccgaggattactaggtatgtgcgtcggtgaaaagcggaagctaaagatacctgcaaagatgggttatggtgagcgaggctccccaccgaagattccaggtggagcaactctgatcttcgacacggagcttatcgctgtcaatggaaagacatctggtgatgcaaaggcagaaagcaatagcgagctttaacacattgaagagtttcatcttgaacgtgtagcagcttcactaatagtggctcgcgcgagttcacttgatgaaagggttgttgtgttatgatttagatgttacaaatgcaagtctggttaagctctatgatctatgtcagcgactgttcatatactgtggaaacttttttcgcttggttggatgagaattcgatttgcgttgttgccacggtcttcgacac

SEQ ID NO: 26015 - protein, 135 aa, Panicum virgatum
  misc_feature: Ceres CLONE 1866493
  misc_feature (28)..(117): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGNKRQLICLAAAAVAAAAILLTASAKKTGDVTELQIGVKGTLTDGSVFDSSYDRGDPFEFTLGNGQVIKGWDRGLLGMCVGEKRKLKIPAKMGYGERGSPPKIPGGATLIFDTELIAVNGKTSGDAKAESNSEL

SEQ ID NO: 26016 - DNA, 724 bp, Panicum virgatum
  misc_feature: Ceres CLONE 1866504
  misc_feature: Encodes the peptide sequence at SEQ ID NO. 26017
aagcccaaactgcgatagcgaaaacgcgagccctgcgggaaagaacaatggcgacaatgtctctcgctgcgtcgcccctcacctccactccccgcgccgtcggcgcttccgcacctagaacggctttcctcggtctccgctcaggtgccgcccaggcgacgcggttccttggactgacggtgtcgtcgcaaccggtagagcgccgtgccgcggcggcggtggcgatggcgaagagggagcaggagctggaggagatccgagctatgacgacggagcagctggaggaggaggttgtggatctcaagggagagctcttcctgctccgcctcaagcgctccgcgcgccaggagtttaaaaacagcgagttcggccggatgcgcaagaggattgctcgtatgttaactgtgaaaagagagcgggaaattgaacaaggcatcaacaagagattgtctaggaagcttgataggaaatggaagcagagcattgtggttagtccaccaccatctctaagggagaacaaagaagagtagaaaggagcaaaagaggccaatctgcaaaggtcgtttcatgcgagtgtagcaggaaggttcctttgtaatttcaacccttatttcatttttatgtactcagtattaacattgtgctaagtatttctatcgaaacctgaatttcagttgttagtcttttctataaattttgatttatttgaatttatgcttctact

SEQ ID NO: 26017 - protein, 160 aa, Panicum virgatum
  misc_feature: Ceres CLONE 1866504
  misc_feature (67)..(124): Pfam Name: Ribosomal_L29 Pfam Description: Ribosomal L29 protein
MATMSLAASPLTSTPRAVGASAPRTAFLGLRSGAAQATRFLGLTVSSQPVERRAAAAVAMAKREQELEEIRAMTTEQLEEEVVDLKGELFLLRLKRSARQEFKNSEFGRMRKRIARMLTVKREREIEQGINKRLSRKLDRKWKQSIVVSPPPSLRENKEE

SEQ ID NO: 26018 - DNA, 770 bp, Panicum virgatum
  misc_feature: Ceres CLONE 1866525
  misc_feature: Encodes the peptide sequence at SEQ ID NO. 26019
agatccacccatccatcccgagacgagcagaaaatctccccacccaaaaaaaatcccaaaaccctaggcttcggatctcccgatctgcgatggcgaacccccgcgtgttcttcgacatgaccgtcggcggcgccccggccggccgcatcgtcatggagctgtacgccaacgaggtcccccgcaccgccgagaacttccgcgccctctgcactggcgagaagggcgtgggcaagaggggcaagccgctccactacaagggatccaccttccaccgcgtcatccccgacttcatgtgccagggcggcgacttcaccaacggcaacggcaccggcggcgagtccatctacggcgagaagttcgccgacgagaagttcgtccgcaagcacacggcccccggggtgctctccatggcaaacgccgggcccaacaccaacggctcccagttcttcatctgcaccgtgcccaccccgtggctcgacggcaagcacgtcgtcttcggccaggtcgtcgagggcatggacgtcgtcggttcctccttcgttcgtcccttccattcgctcttttccctctgaataagacgatggtgatctgagaggtggtctgagttgagtcgtgtcgtgtcgaatcgtttatcgtggtttaattaggggtttaggtgctggatctgcgaatcagcatgtgggtggatggtgtctctccctaatccatgtttctgctgttatggtattgtctcgaggatgataactggaacttccctttagtgtttcggg

SEQ ID NO: 26019 - protein, 160 aa, Panicum virgatum
  misc_feature: Ceres CLONE 1866525
  misc_feature (5)..(160): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPRTAENFRALCTGEKGVGKRGKPLHYKGSTFHRVIPDFMCQGGDFTNGNGTGGESIYGEKFADEKFVRKHTAPGVLSMANAGPNTNGSQFFICTVPTPWLDGKHVVFGQVVEGMDVVGSSFVRPFHSLFSL

SEQ ID NO: 26020 - DNA, 776 bp, Panicum virgatum
  misc_feature: Ceres CLONE 1866542
  misc_feature: Encodes the peptide sequence at SEQ ID NO. 26021
gttgcatagagcttgatgctcgtgttgaataaaaaaaaaaagcacgcgcaagagggtgcgcccgtccgaggaggcctcgtcgccgcccgtgtacctgacggcgtgcgggtgcggcgcccgtgcagcccgctccgtcgttcctcacgctgccgctgcctgcctcggagccgatcgagctcggaacctctcgcccccgcaccgagggatagagcttgcccgctcggcagggcccgccgccgtccgcttctacgcgcaaccctaggaaggattcatttgggtgagaaagaggaaccgattctgcgcgtcgtcgccgagctttgtccgtagaggagacaagggcgagcagaggcgccgagatgactcgcggcaaccagagggatcgcgaccgcgagcgcgcggcggcgcggaagcccaacgccaaggggccccaggacgggcttaccccggagcagcgccgcgagagggacaagaaagcgctggaggagaaggcggccaagaaggcgcagcaggcggcggccggcgccgccggtacctccactgacaacaagaacaagggcggcggcaagaagtagggcgccgccaacgcgcgaggcgcaacctctgtacgattatcgatgccattagcttgtaccttcgcatctacatagatgcgatgtttgttgggtcataaactcgtcgtctgcaagctttcagttacccgatacatcatgaattgatgatgacaatatctactttccagtttcacatgctagtagactgtttgttacagatggcag

SEQ ID NO: 26021 - protein, 71 aa, Panicum virgatum; identical to SEQ ID NO: 12234
  misc_feature: Ceres CLONE 1866542
  misc_feature (1)..(56): Pfam Name: 4F5 Pfam Description: 4F5 protein family

SEQ ID NO: 26022 - DNA, 747 bp, Panicum virgatum
  misc_feature: Ceres CLONE 1866549
  misc_feature: Encodes the peptide sequence at SEQ ID NO. 26023
cccagccgtcgtcgcttcccgtccgccgcagcccgccgccaggagaggtaaggagggagttctgagaagcccaaaatggctcctaaagctgctcctgcgaagaaggatgccaagacccaggccttgaaggttgccaaggcggtgaagtctggggcagtcaagaagaagaccaagaagatccgcacgtcggtgacatttcaccgccccaagaccctgaagaaggctagggacccgaagtacccaagagtcagcgctcctggaaggaacaaacttgatcagtaccaaatcctcaagtatcccctcaccacagaatcagcaatgaagaagatcgaagataacaacactctggtcttcatcgttgacctcaaggcggacaagaagaagatcaaggctgctgtcaagaagatgtatgacatccaggcaaagaaggtcaacactctgatcaggcccgatggtaagaagaaggcatatgtgaagctgacaccggactacgatgctcttgatgtggccaacaaaatcggcatcatctaagttacaggctactttgttaggcatctgtgtcctagttctatgtgaaacgagagttttgtagctattccttatctagggccacagtggctccattaccatgccttgatgcacacttatgattttggtaccgtccaagtgaccagttgagccaatttgagctttgcacttgcttgtactatcagttactttattagcattacccagtagttttgtgtc

SEQ ID NO: 26023 - protein, 151 aa, Panicum virgatum
  misc_feature: Ceres CLONE 1866549
  misc_feature (69)..(148): Pfam Name: Ribosomal_L23 Pfam Description: Ribosomal protein L23
  misc_feature (10)..(63): Pfam Name: Ribosomal_L23eN Pfam Description: Ribosomal protein L23, N-terminal domain
MAPKAAPAKKDAKTQALKVAKAVKSGAVKKKTKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 26024 - DNA, 699 bp, Panicum virgatum
  misc_feature: Ceres CLONE 1866601
  misc_feature: Encodes the peptide sequence at SEQ ID NO. 26025
gtttatctcctccctctgtttcttgaaccattcacttctctcggactctctcctcccttgctctcccttccctggtggcggcggcgaccgagcggcggcgtcgtttgtcctgtcttcgcccaaccctttgctggcgacgagcgcatccttcagttttaacaatgaagatgatcgctgcctacctgctcgcggttctgggtggaaacacttccccaactgctgatgacgttaagaacattctggaatcagttggggctgaagctgatgaagagaaactggacttcctgctcacagaactcaaagacaaggacataacagaagtgattgcagctggaagggaaaagttcgcctccgtgccttcaggtggtggtgcaattgctgtgggagctccggctgctgcagctggtggtgctgcacctgctgaagaggcaaagaaggaagagaaggttgaagagaaggaggaatcagatgatgatatgggtttcagcttgttcgattaagcactgctgccccgcatatagtttcttctcacgtgtggtctgatacaccggtcggtatccgcaaaataaccatgccgagaactagtatcagtgtgctattttgcttgtgatgatggacatttctagtactcttttttgaacgtgaacatttctagtactgtggtatcatgatatggagtattgagaactactctgtgcc

SEQ ID NO: 26025 - protein, 112 aa, Panicum virgatum
  misc_feature: Ceres CLONE 1866601
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass
MKMIAAYLLAVLGGNTSPTADDVKNILESVGAEADEEKLDFLLTELKDKDITEVIAAGREKFASVPSGGGAIAVGAPAAAAGGAAPAEEAKKEEKVEEKEESDDDMGFSLFD

SEQ ID NO: 26026 - DNA, 986 bp, Panicum virgatum
  misc_feature: Ceres CLONE 1866707
  misc_feature: Encodes the peptide sequence at SEQ ID NO. 26027
aaaaaaaaaaagtctaaaactagcgcccgtagcgtacgccggatcgcggcgggcggcgggcggcaggcgcgcatcgagtaatttatcagggcgggcgcgcggcagcggagcagatctcgccggggccagccatgggtgctgccggcgcgatccggcgggcggcggcgtcggcggccgaccgcgcgtgcgcgggggcgcggggcttccgccgcgcgctggcccggttcgcgccgcggccctcggcgttcgcgcccgccgccgacgcggaggccgccgcggtgcgcgccgtgcgcaacctccgcaccttccgcttccactacgccgtcctgcagtgggcgctcctgctcgcctccctcgcgccgcggcaccgcgcgtccgtggtcttcctcatggcggcgtccaagggcctcctcgtctacgggggcctcctcaaggcgttccccaactcggcgctgctccggaggctcctcgaccgccgcctcgtcgccgcggtgttcctcgcgctcgtgctcgccgacatcgtcgccgcgggcgccgtccccaacctccttgccgcgctcgccgcgggcgtcccgatcgtcgtcctccacgcgtccttccgcgtccgcgacgacctcgaggggcccccscccgaggccgcgggggagaacggcaaagacgacgagacggcggcggtcgtcgagaagaaggaggacggcgacgtcgaggcggggcccacgcgacggtccatggcgacggcaccaagatcacccaaatgaggatttgctagcaactagtaaaaaccatacatttcatagattaattacagggtctcgttgtcttggaatataggaacaattcgtggtcaaaacctgtcttcctgcctgcttcttgattcaatccacactgtgaggaggagcctagtaatttttgggggaaattcaattattagaatgtagtggtaactgtgacagtgaatgttgagtttaagatgactcattgtgatc

SEQ ID NO: 26027 - protein, 208 aa, Panicum virgatum
  misc_feature: Ceres CLONE 1866707
  misc_feature (17)..(184): Pfam Name: PRA1 Pfam Description: PRA1 family protein
MGAAGAIRRAAASAADRACAGARGFRRALARFAPRPSAFAPAADAEAAAVRAVRNLRTFRFHYAVLQWALLLASLAPRHRASVVFLMAASKGLLVYGGLLKAFPNSALLRRLLDRRLVAAVFLALVLADIVAAGAVPNLLAALAAGVPIVVLHASFRVRDDLEGPPPEAAGENGKDDETAAVVEKKEDGDVEAGPTRRSMATAPRSPK

SEQ ID NO: 26028 - DNA, 716 bp, Panicum virgatum
  misc_feature: Ceres CLONE 1866716
  misc_feature: Encodes the peptide sequence at SEQ ID NO. 26029
ccccagcataacatccttctctctctcctcccccataacatccttctcccaactctcaacctagtactcgccctcgcttcgcgcttcttcttgagctcttgcgagccgctgatcatcctgcgctcggcactggaactggaagctgtttgaataacagctccaaggttcaaaggaaccttcgtttgttgtaagatgtatagggcaaagagagctgcactgtcaccaaaggtaaagcgccgtgttgggaagtatgagctcggacgcaccattggggtgggaaccttcgcaaaggtccggtttgcaaagaacactgaaaatggggagcctgttgctatcaaaattcttgacaaggagaaggttcagaggtacagattggttgaacagattaagcgtgaaatttgcactatgaagttagtcaagcatcctaatgttgttcgactgtttgaggtgatgggaagtaaagcaagaattttcattgttatggaatatgttactggcggagagctttttgaaatcattgctactaatggaagtgcgacagcgaggtcgagggcaacagcgcggcggcatgaagcggcctcctaaacttccagaggccggcgctggcctttccctgtacatagcttctctttcggatgaccggtgtccattgcagagtcggcttttgcaagccaagttctttggttcattggttgatggcgagtaagctccgatga

SEQ ID NO: 26029 - protein, 130 aa, Panicum virgatum
  misc_feature: Ceres CLONE 1866716
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MYRAKRAALSPKVKRRVGKYELGRTIGVGTFAKVRFAKNTENGEPVAIKILDKEKVQRYRLVEQIKREICTMKLVKHPNVVRLFEVMGSKARIFIVMEYVTGGELFEIIATNGSATARSRATARRHEAAS

SEQ ID NO: 26030 - DNA, 896 bp, Panicum virgatum
  misc_feature: Ceres CLONE 1866720
  misc_feature: Encodes the peptide sequence at SEQ ID NO. 26031
acgcagacccggccccccagcgccccgcgctgccactcgctgctttcctccaccaccacccctcgccggccgccgcctccctcaccggccgccgcagcgcgccatattctgccctcctgatccgccgctccaaacccgctggggagaggaggcggctccgaggaagatggggtggaaggctgcggagaagctcatcaggcactggaagatcctccgcggtgacaacgtgatgatcatcagaggcaaggacaagggggagactgggctcatcaagcgggtcattcggtcgcagaatcgcgtcatcgtcgtcgagggcaagaatttggttaagaaacacattaaacaaggcgaagggcacacaggaggtattttctccattgaagctccacttcatgtttcaaatgtccaagtagctgatcctgtcactgggaaaccatgtaaggttggacacaagtatttggaagatgggaccaaagtcaggttcgctagagggatgaatgcatctggtgctgtgatcccccggccagaaattctgaaggagagaagaaaaccgagacctacatcacctggaccaaaggatacaccaattgagctcgtgctggagaagacctacgatgagaaagctgggattggtatgcctgatctatagatgccacgttggttgtgctgactttagtatttgtgaccaggtcctagtgaaggtattaggggttggatgattgttgcagctgtaccgtacttccctcataataatcatgtattgaaaatcggaagatccattactggcatgtgtgttgtctttcttttgtccgagtgtttggttacttctgcagaaacacatcattggatgagaaacggcaaacatatgtatcttcttaatgagatatcccgttcag

SEQ ID NO: 26031 - protein, 160 aa, Panicum virgatum
  misc_feature: Ceres CLONE 1866720
  misc_feature (17)..(48): Pfam Name: KOW Pfam Description: KOW motif
MGWKAAEKLIRHWKILRGDNVMIIRGKDKGETGLIKRVIRSQNRVIVVEGKNLVKKHIKQGEGHTGGIFSIEAPLHVSNVQVADPVTGKPCKVGHKYLEDGTKVRFARGMNASGAVIPRPEILKERRKPRPTSPGPKDTPIELVLEKTYDEKAGIGMPDL

SEQ ID NO: 26032 - DNA, 735 bp, Panicum virgatum
  misc_feature: Ceres CLONE 1866773
  misc_feature: Encodes the peptide sequence at SEQ ID NO. 26033
ctgatcttctattccacccctggccgagcacaggtatacaccagaaacgacgacgaagccttgctactctgttcatagcctcgacgtacagttggtgaggcacaccagaaacaccatgggcatcctggaccacttgtccgatgtctgcagcatcacggagacgaaggaggccctcaagctccgaaagaagcgcccgctgcagacggtaaacatcaaggtgaagatggactgcgaggggtgcgagcggcgggtgaagagcgccgtcaagtcgatgcggggcgtgaccagcgtggtggtgaacccgaagcagagcaagtgcaccgtgacggggtatgtggagccggccaaggtgctggagcgggtgaagagcacgggcaaggcggcggagatgtggccctacgtgccatacacgatgaccacctacccctacgtcggcggcgcctacgacaagaaggccccggcgggcttcgtccgcagcgcgccgcaggccattgccgaccccagcgcgcccgaggtcaggtacatgaacatgttcagcgacgagaacgtcaacgcatgcatcgtcatgtgatgatcccgggcgtgagtcgctggctggggatggctgtggccatggccatggatgcgctcgtatgtatgctagcatgttcagacggagggctaaagagaaatatgtttgcctctaatgagtttgtatgtgttaggtgcattaatgtcgaccatgtgtttggttcc

SEQ ID NO: 26033 - protein, 151 aa, Panicum virgatum
  misc_feature: Ceres CLONE 1866773
  misc_feature (32)..(92): Pfam Name: HMA Pfam Description: Heavy-metal-associated domain
  misc_feature: Useful for biocontainment applications
MGILDHLSDVCSITETKEALKLRKKRPLQTVNIKVKMDCEGCERRVKSAVKSMRGVTSVVVNPKQSKCTVTGYVEPAKVLERVKSTGKAAEMWPYVPYTMTTYPYVGGAYDKKAPAGFVRSAPQAIADPSAPEVRYMNMFSDENVNACIVM

SEQ ID NO: 26034 - DNA, 613 bp, Panicum virgatum
  misc_feature: Ceres CLONE 1867064
  misc_feature: Encodes the peptide sequence at SEQ ID NO. 26035
attctcaccatcaccaaaccgaaaaccacaccatggttcatcgtctccgtgccatctccctcaccggcttcaccatcctgctgtccctcgccctcctcttcacctcccagaaagctcaagccagcagcaacttgggccgccgcagcggcaaggagaaacgacgagaggcgtcggaggagcactacgtccccgtgcggagcgtggtgtaccggtcgcgatcggtggcgccggcggcgacggaggcggtggggtacgagccgttcgaagtgtgcgaggggtgcaggtgctgctcgacctccaacacgagcagctgcgtggacacgagctgctgctacgccatcgactgcaacctcccggggaagcccttcggcacctgcgccttcacgccccaaacctgcggctgcggcggcaccaccaactgcacccagccctcctgatccatctattaattcctgattactcatttcgtgttcttctttgactggctctcaaatctcaatttgggtctgagactgggctctggggtttcctcaaccttttgtgttctcaacttctgatagatgactgatctgaaaaacaatatagaggattaattcacggccggattctgttt

SEQ ID NO: 26035 - protein, 134 aa, Panicum virgatum
  misc_feature: Ceres CLONE 1867064
  misc_feature: Useful for biocontainment applications
MVHRLRAISLTGFTILLSLALLFTSQKAQASSNLGRRSGKEKRREASEEHYVPVRSVVYRSRSVAPAATEAVGYEPFEVCEGCRCCSTSNTSSCVDTSCCYAIDCNLPGKPFGTCAFTPQTCGCGGTTNCTQPS

SEQ ID NO: 26036 - DNA, 709 bp, Panicum virgatum
  misc_feature: Ceres CLONE 1867072
  misc_feature: Encodes the peptide sequence at SEQ ID NO. 26037
atcccatcgagacaaaaatatcccccacccacgacgagcgccagcagcagcagcagcagcagcagcagccatggggatagccgtggtcgctcccgtcgcggcggcctcctcctcctacctcggggcgccgccgaggcgcgccgcagcgccggcgcgcgcccacgtctcggccgccgggatgtccgcgagggcgtcttccttcgtcgggaccgggctcgcgggggcggccgcgtcggtggccgcgcggccgaggaggagggccggctcggggggcggcggggcgctcgggtgcaagtgcctgttcgggctcggggtgcctgagctcgcggttatcgccggcgtcgccgcgctcgtcttcgggcccaagcagctccccgagatcggccgcaacatcggcaggaccgtcaagagcttccagcaggcggctaaggagtttgaaactgaactgaagaaagagcctggggaaggcggcgacgagcccccgcctgcaacccccacggcggtaggcgatggggaggagaaaaagggggcttgaggcatcgtctagtagcaaggagcacacatgaggatccatcttgttagcgttctgtatgtacaactgtattctgggtttctggagttagcagcaaatgcctgcccgtttattttggtcaccttgcagtttcaggccacatagcgatattgtttgtagttttgtacccgggaaaga

SEQ ID NO: 26037 - protein, 154 aa, Panicum virgatum
  misc_feature: Ceres CLONE 1867072
  misc_feature (80)..(132): Pfam Name: MttA_Hcf106 Pfam Description: mttA/Hcf106 family
MGIAVVAPVAAASSSYLGAPPRRAAAPARAHVSAAGMSARASSFVGTGLAGAAASVAARPRRRAGSGGGGALGCKCLFGLGVPELAVIAGVAALVFGPKQLPEIGRNIGRTVKSFQQAAKEFETELKKEPGEGGDEPPPATPTAVGDGEEKKGA

SEQ ID NO: 26038 - DNA, 700 bp, Panicum virgatum
  misc_feature: Ceres CLONE 1867075
  misc_feature: Encodes the peptide sequence at SEQ ID NO. 26039
gcagcaccggcccaaccgaacggctgggaaccagcggctggtcttgaatcgtgcccctaccgcactcccatccgcacggccgccgccctcccatccgcacggccgccgctagggttgggggcagctgcgtcgccgccgtcggggccgccccgatccgccgccgctcgcctcgccgacccctgccccaccgcatccgcgtccggcccgccgccttcgctcctgtgtccgtgtgcgactcgcccaaaccctcctctccccatttctttcttgcctcccacgccgccgccgtacccatcccgccatggccgatccgcggctgttcccgtcgggatccgacgatcgccgcgatgactccggccgccgcctctacaacccgtaccaggacctcaacatcccctacaagcagctctacgacctgcccacctccccggagttcctcttccaggaggaggccatcgtgcagcgccgctcctggggcgagaacctcacctactacaccggtatcggctacctgggcggcgccgtggccggggccgcgctggggctccgcgacgccgcgcggggcgcggagcccggcgagcccgccaagatccgggccaaccgtgtcctcaactcctgcgggagctcgggccgccgcctcggcaacacgctcggggtcattggcctcatgtacgccgggatcgagagcgccatggtcgct

SEQ ID NO: 26039 - protein, 132 aa, Panicum virgatum
  misc_feature: Ceres CLONE 1867075
  misc_feature (51)..(132): Pfam Name: Tim17 Pfam Description: Tim17/Tim22/Tim23 family
MADPRLFPSGSDDRRDDSGRRLYNPYQDLNIPYKQLYDLPTSPEFLFQEEAIVQRRSWGENLTYYTGIGYLGGAVAGAALGLRDAARGAEPGEPAKIRANRVLNSCGSSGRRLGNTLGVIGLMYAGIESAMV

SEQ ID NO: 26040 - DNA, 752 bp, Panicum virgatum
  misc_feature: Ceres CLONE 1867081
  misc_feature: Encodes the peptide sequence at SEQ ID NO. 26041
aaaagcaacctgcttaggagggctcatcccatttgtccccaaccacttggaaatttctggggggttggtcgtagtggaagcagcgagaaaaataacagtcgcgaaaatatctttggttttggtgtggtgcagggcatcagcaagggcgtggtggtggagagcctcctgtcgtccttggtcaagacggggaaggcgccggacttggtgctgtgcatcggcgacgaccggtcggacgaggacatgttcgagagcatcgtgtgcccgtccaacgccagcgtgaggctcccggccaccagcgaggtgttcgcctgcaccgtgggcaagaagccgagcatggccaggtactacctggacgacacggtggacgtgatcaagatgctggagggcctggccaacgcgccgtcgcagcggcccaggccggcggtgcagctccgggtctcgttcgagggctcgctgtgagagacgaaacaacggaagggggattttactgcacaggaaggagtgacgaataaccgaccaatggtgacgaccaagatgattcagacgcgtgctttaggattagctgcagttacaggatcaacaggttttctttctttggtttctttttttcattcttttacatttctacccctcttcggccgtgcctgtacatgccccgtatgataatatgcaagaatgtatcgaccaccttgtacatgtagttgacgatgacgatgaaatcagaaaaaaagaaacaacaaaaggattctttc

SEQ ID NO: 26041 - protein, 152 aa, Panicum virgatum
  misc_feature: Ceres CLONE 1867081
  misc_feature: SWISSPROT Homolog: EC 3.1.3.12 Trehalose-phosphatase
  misc_feature: Useful for making plants with altered carbohydrate content
KSNLLRRAHPICPQPLGNFWGVGRSGSSEKNNSRENIFGFGVVQGISKGVVVESLLSSLVKTGKAPDLVLCIGDDRSDEDMFESIVCPSNASVRLPATSEVFACTVGKKPSMARYYLDDTVDVIKMLEGLANAPSQRPRPAVQLRVSFEGSL

SEQ ID NO: 26042 - DNA, 727 bp, Panicum virgatum
  misc_feature: Ceres CLONE 1867102
  misc_feature: Encodes the peptide sequence at SEQ ID NO. 26043
acgcagacgcaggcaacccaaagccgcgacgcatctcttccttctccatcggccgagcgagcggcatccgtgtctgtgctgtgcacctcgaaagttgagggaaatctcggtcggctccgctcccgccccacgccatggaggaagcaaaggttgtggagtccaaggacggaacaatctcagttgcttctgcatttgctggccatcaggaagctgtacaagacagagaccataagtttttatcaaaggcagtcgaagaagcataccgaggagttgattgtggagatggtggcccgtttggtgcagttgttgtccgcaatgatgaagtagtagtcagttgccataacatggttttgaagcacaccgacccaaccgcacatgctgaagtaactgcaataagagaggcttgcaaaaagcttgggaaaattgagctgtcggattgtgaaatttatgcatcctgtgaaccatgcccaatgtgttttggtgctgttcatctttcccggattaagaggctggtgtatggagccaaggctgaagctgatattgccattgggttcgatgatttcattgctgatgctcttagaggaactgggtactaccagaaggccaacatggagataaagaaggcagatggaaatggagccctgattgcggaacaagtctttgagaagactaaagagaagttccagatgtactgataaattcttggttgattttacattccaatagg

SEQ ID NO: 26043 - protein, 186 aa, Panicum virgatum
  misc_feature: Ceres CLONE 1867102
  misc_feature (28)..(130): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
MEEAKVVESKDGTISVASAFAGHQEAVQDRDHKFLSKAVEEAYRGVDCGDGGPFGAVVVRNDEVVVSCHNMVLKHTDPTAHAEVTAIREACKKLGKIELSDCEIYASCEPCPMCFGAVHLSRIKRLVYGAKAEADIAIGFDDFIADALRGTGYYQKANMEIKKADGNGALIAEQVFEKTKEKFQMY

SEQ ID NO: 26044 - DNA, 721 bp, Panicum virgatum
  misc_feature: Ceres CLONE 1867104
  misc_feature: Encodes the peptide sequence at SEQ ID NO. 26045
gtgcagagcaggactactactgctagcttcctagatagctagtaccagaagccagagctccacccagccaagaggggcggcggcaggcagccatggccatggcaaccgtgcccccaaacgcgaggtgcctgttcccgggcaaggagcaccggaacgcgatcacggtgccggagttcaagctctggctgaagcagttcgacaccgacggcgacgggcgcatcagccggaaggagctccgggaggccatccgccgccgcggcgcgtggttctccggcctgcgggcgcgcttcgccgtccgccgcgccgaccggaaccgcaacggcttcgtggacgactccgagatcgagggcctcatccagttcgccgagagggagctcggcttcaggatcaccacggacgcggccgccggcgccgacggcccgcctctcggccgcgtctcgccgccggccgacaggtccatcacgtacacggaacaaggatctttctgcacacatgggattttttgctctatatgagtatagcttaggtctctctgaataatttgtgtggaagcaggaggaagcacctactctgcagtagcagcttgtttgggtagtgtaccggccgcgtggtgatcgaggtgatgatgctatatcatgtactgtatatttgatttgtaataatccatccatcccatgtgtgttattatggattcagcttctcgatctatttagtataatac

SEQ ID NO: 26045 - protein, 140 aa, Panicum virgatum
  misc_feature: Ceres CLONE 1867104
  misc_feature (27)..(55): Pfam Name: efhand Pfam Description: EF hand
MAMATVPPNARCLFPGKEHRNAITVPEFKLWLKQFDTDGDGRISRKELREAIRRRGAWFSGLRARFAVRRADRNRNGFVDDSEIEGLIQFAERELGFRITTDAAAGADGPPLGRVSPPADRSITYTEQGSFCTHGIFCSI

SEQ ID NO: 26046 - DNA, 828 bp, Panicum virgatum
  misc_feature: Ceres CLONE 1867111
  misc_feature: Encodes the peptide sequence at SEQ ID NO. 26047
aagaggataaggcgggtctgccttgcccctaccagaggaaccaaaacccaagccgaagtccggaacggagagaaaaagagaagagagccgcgatgacgtctgccgccgccgccagcagcactggcgggctccacctcgtactccccgcggcccacaggcggccgcctccgcttcctagtcttgcaaccagctccgctagaggacgaggaggaggaaagctccgagcggccgcagaagcggcgccaggagacgtcgtcgtcgccaccgccgccgccgccggcggcgcgctgctgggccggcccctggaggacgtgtacaaggtgcgcgtggagcgcggcgcggcggcgcgggcgcgcgcggaggcgctgcgcgtgatggagacgtggtcgtcgtggcgcacgggcgggcggtgccggatgccgtgggactggcaggtggaccagctcgtgtacatcgtgtccggcgaggtcaaggtcatccccgccggcgccgtccacggcgacgactacatgcacttcgtcgccggggacctcgtccggtacccgcgctggttcgaggccgacctctacttcgacggcccctacgaggagcgctaccgcttcctcgcctacggagacgacaactagcccattatcatcagcttatcctgtactcgtatcacctcttgtttcagctttactagtagtctagtttttaggcttattgttaggtttaggtaccctatcggttggagaaacatatgcagttaactgatcctatgcattcgtatatgtgtcattgtgtgacagaagagaatatgagtatgaatcaaacagaaaaattaaacct

SEQ ID NO: 26047 - protein, 177 aa, Panicum virgatum
  misc_feature: Ceres CLONE 1867111
  misc_feature (90)..(168): Pfam Name: Cupin_3 Pfam Description: Protein of unknown function (DUF861)
MTSAAAASSTGGLHLVLPAAHRRPPPLPSLATSSARGRGGGKLRAAAEAAPGDVVVATAAAAGGALLGRPLEDVYKVRVERGAAARARAEALRVMETWSSWRTGGRCRMPWDWQVDQLVYIVSGEVKVIPAGAVHGDDYMHFVAGDLVRYPRWFEADLYFDGPYEERYRFLAYGDDN

SEQ ID NO: 26048 - DNA, 733 bp, Panicum virgatum
  misc_feature: Ceres CLONE 1867120
  misc_feature: Encodes the peptide sequence at SEQ ID NO. 26049
ctaggccgcaccccttcttcgtttcctccccgcgccgccgcctccgctcgccgccgccgccaccatgggccgaagacctgcgaggtgctatcgccagatcaagaacaagccttatcccaagtcaaggtattgtcgtggtgttcctgaccccaagatcaggatctatgatgttggaatgaagaagaagggagttgatgagttcccctactatgtgcaccttgtctcttgggaaaaggagaatgtctctagtgaggctcttgaggctgcccgtatcgcgtgcaacaaatacatgaccaagtctgcaggaaaggatgccttccacctcagggtccgggttcaccccttccatgtgctccgtatcaacaagatgctttcgtgtgctggggctgataggctccagactggaatgaggggtgccttcggcaagccccagggtacctgtgctcgggtggacattggccaggttctcctttctgtgcgctgcaaggacaacaatgctgcccatgccagtgaggctctgcgtcgcgccaagttcaagttccctggtcgccaaaagatcattgagagcagaaagtggggcttcaccaagttcagccgtgctgattacctgaagtacaagagtgagggtagaatcgtgcctgatggtgtcaacgctaagctgcttggtaaccatggccggcttgagaagcgtgctcctgggaaggctttccttgaggccgtcgcttaagttgcc

SEQ ID NO: 26049 - protein, 220 aa, Panicum virgatum
  misc_feature: Ceres CLONE 1867120
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYYVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLEAVA

SEQ ID NO: 26050 - DNA, 684 bp, Panicum virgatum
  misc_feature: Ceres CLONE 1867140
  misc_feature: Encodes the peptide sequence at SEQ ID NO. 26051
gggtccagctccgcaccagcaccggccgcctcagcttctcctcctcccccagcgcagcagccaggcggcgattcgcggcggtgagggcgtcggcggaggcgatggcgacggagaagctgggcatcagggtggagcgcaacccgcccgagtcccgcctctccgagctcggcgtccgccagtggcccaagtgggggtgcgagaagagcaagttcccgtggacctactcggccaaggagacgtgctacctgctgcaggggaaggtgaaggtgtacccggagggccacggggaggacttcgtggagatcgccgcgggggacctagtcgtcttccccaagggcatgagctgcacctgggacgtcgccgaggccgtcgacaagcactacaacttcgagtagcctccgccgctgccgcccatgccgaactagcctggtatggcacgcagtagcagtaatttggtgaccgcctagtgggaatgtttgaactgctcctgcttttccattcctgcctgcctgtagacgttctgtgctctgaaccagtgatgctccagtccagtgttaaacatcatgataaagctctggattagcaaactacgatacttgtgtttcgttttgtgcttcacttcttcctcactagctgtttgatgaatggaggcagcgaaatgcgcttatttatattgacatacag

SEQ ID NO: 26051 - protein, 130 aa, Panicum virgatum
  misc_feature: Ceres CLONE 1867140
  misc_feature (52)..(127): Pfam Name: Cupin_3 Pfam Description: Protein of unknown function (DUF861)
  misc_feature: Useful for making plants with modulated cold sensitivity
VQLRTSTGRLSFSSSPSAAARRRFAAVRASAEAMATEKLGIRVERNPPESRLSELGVRQWPKWGCEKSKFPWTYSAKETCYLLQGKVKVYPEGHGEDFVEIAAGDLVVFPKGMSCTWDVAEAVDKHYNFE

SEQ ID NO: 26052 - DNA, 604 bp, Panicum virgatum
  misc_feature: Ceres CLONE 1867141
  misc_feature: Encodes the peptide sequence at SEQ ID NO. 26053
accatccgatcctccgaatcctactactaccaccaccagctgacctcgatcgctcgctctagctagccatcatgaagccggcggcgcatcatctggtgctgctcgcggcggtcctggtcctggtgctgtgcgcgggggtcggcgacgcggcgacgtgcgacgcgacgcagctggcaccgtgcgcgggcgccatcatcgggaacgcgccgcccaccgcggcgtgctgcagcaggatgaaggagcagcagccgtgcctgtgcacgtacgcccgcgaccccaacctgcagcgctacgtcaactcgcccaacggcaagaaggccctggccgcctgcagggtgcccgtgccctcctgctgatcaattaacttcaataattcgcgtcggcaggcaccgcgcgcggtgtatgcgtcttggtcgatctccgtggtgttgcgctggtctcagctccctgtatctgccgagctcttcgggctcgcgtgtatgaataaaggatgtaataattacgtgcgttatatgtgtgttcgtgggctcgttgtttttctcgttaagatcagcaaatgacgcctggtggcaaaattagtgccaacaaacaaattaaatgttgg

SEQ ID NO: 26053 - protein, 94 aa, Panicum virgatum
  misc_feature: Ceres CLONE 1867141
  misc_feature (29)..(94): Pfam Name: Tryp_alpha_amyl Pfam Description: Protease inhibitor/seed storage/LTP family
  misc_feature: Useful for making plants with modulated biomass
MKPAAHHLVLLAAVLVLVLCAGVGDAATCDATQLAPCAGAIIGNAPPTAACCSRMKEQQPCLCTYARDPNLQRYVNSPNGKKALAACRVPVPSC

SEQ ID NO: 26054 - DNA, 711 bp, Panicum virgatum
  misc_feature: Ceres CLONE 1867152
  misc_feature: Encodes the peptide sequence at SEQ ID NO. 26055
cacatggctcccgctacggcaaccgccgcgttcactagcctcctccccgccggcgcctcgcggctcccctcggccgccgctgccgctggagcggcggcctccttcgtgcggctcccgcggcacccgacgggctgggctggggcctccgtcgcggcgccgaggacggcgcgcaggcgggcgcccggggtcgcctacgcgaccgccgccacggataagagcatctacgactacaccgtcaaggacattgatggaaaagatgttcctcttaaaaaattcaagaataaggtgttgctgattgttaacgttgcttctcaatgtgggttgacaacagcaaactacactgaattatctcatatctatgagaagtacaagactcaagaagaagacccagacttcgtaccagacgacgccgagtagggttatcgttctacacccaaccttgtctgtggaaccggccctgtcgagatgcctctgctgtcgcagtactctgagcctgtggttgaccccatgtggtttgcggtctggtgttatgtcgtagcttggttaatctttattatcatctgtatcgagtgtccttcaaggtttgtacggttttgaaccatctgatgtaataaatgtggcatcagcctcctgagactggtgctttgtatcacatttaagtcttctcttatgaggggacgtttcaggcaattcctggatatctggccgagg

SEQ ID NO: 26055 - protein, 137 aa, Panicum virgatum
  misc_feature: Ceres CLONE 1867152
  misc_feature (73)..(135): Pfam Name: GSHPx Pfam Description: Glutathione peroxidase
  misc_feature: SWISSPROT Homolog: EC 1.11.1.12 Phospholipid-hydroperoxide glutathione peroxidase
MAPATATAAFTSLLPAGASRLPSAAAAAGAAASFVRLPRHPTGWAGASVAAPRTARRRAPGVAYATAATDKSIYDYTVKDIDGKDVPLKKFKNKVLLIVNVASQCGLTTANYTELSHIYEKYKTQEEDPDFVPDDAE

SEQ ID NO: 26056 - DNA, 600 bp, Panicum virgatum
  misc_feature: Ceres CLONE 1867172
  misc_feature: Encodes the peptide sequence at SEQ ID NO. 26057
agcacagcacaggagcatggccgtagccggacgcgcccgcgcctgcgcctccgccgcgctgcgcgccctcgccgcgccgaggccgcggccgcccgcgcgggccatccacgaggggcccgacaccatcgaggagctcctggaccggcacctcgtcaagaagcccgcggcggtcctcgacgacgacgcggcggaggccgaggcccggcggcggctgacgagctcccggcgggaggcgctgggcctgtaccgggacatcctccgtgcgacgcggctcttcgcgtggcccgacgaccgcggggtgccgtggcgggaggtgctgcgcgccaacgccaggcgcgagttcgaggaggcccgcggggagcgcgacccggaggtggtggcgcgcctcctcatcggcggccgtgacgccgtgcagcaggcgctggaccgcctcgctgaggcgtcccgccgcgcgatcgaggccgaggaggccaagcgccgcggcggagcgtagattcagaacgggattttcccaaatccaagcgtcctgtactttttttttgtttaatcttctgtaaaaggctaatgtatgtttcaaaggaaatggttcagaggattgat

SEQ ID NO: 26057 - protein, 158 aa, Panicum virgatum
  misc_feature: Ceres CLONE 1867172
  misc_feature (68)..(137): Pfam Name: Complex1_LYR Pfam Description: Complex 1 protein (LYR family)
MAVAGRARACASAALRALAAPRPRPPARAIHEGPDTIEELLDRHLVKKPAAVLDDDAAEAEARRRLTSSRREALGLYRDILRATRLFAWPDDRGVPWREVLRANARREFEEARGERDPEVVARLLIGGRDAVQQALDRLAEASRRAIEAEEAKRRGGA

SEQ ID NO: 26058 - DNA, 576 bp, Panicum virgatum
  misc_feature: Ceres CLONE 1867193
  misc_feature: Encodes the peptide sequence at SEQ ID NO. 26059
gcagggaggaggacaaggctgcaggcgccttctcctacatctcctttggtggtggtaggcatggttgcctcggcgagccctttgcctatctgcagatcaaggcgatctggacacacctgctgagaaactttgagttcgagctggtctcaccattcccggagaatgactggaacgcgatggttgtcggcatcaagggcgaggtgatggttaagtacaagaggaggaagctcgtcgtcaacaactaagaccatggttctcttaggaagtctgcttcttgtcagttgacattgtcgcttgcctgtcggcatttgttcggtgtattttcttctgttgtgcacgccagcctttttagtagtgtttccattgtttaggactctgtatttgcttccctgtggttaagttggatccgcaactttagcctgtgagccgcccgagcaaaatcttgaacttcggcatctgagcatgcggcttccatgctgaatttccacagataatcattctggtagatggatccaagcataaaactgtgcaaataatcccgtgtaatgaataaatatgtgatcctgtcgttcaggc

SEQ ID NO: 26059 - protein, 80 aa, Panicum virgatum
  misc_feature: Ceres CLONE 1867193
  misc_feature: SWISSPROT Homolog: EC 1.14.13.70 Sterol 14-demethylase
REEDKAAGAFSYISFGGGRHGCLGEPFAYLQIKAIWTHLLRNFEFELVSPFPENDWNAMVVGIKGEVMVKYKRRKLVVNN

SEQ ID NO: 26060 - DNA, 576 bp, Panicum virgatum
  misc_feature: Ceres CLONE 1867194
  misc_feature: Encodes the peptide sequence at SEQ ID NO. 26061
gaaaaaaaaaaccactcccccagatccacgccgccacccctacgcccgacgcggagaccggcctccgcgcgcccctacgcctgacgcgagagggccgaagggcggcacggcgatgacgcggcggtgctcgcactgcagccacaacgggcacaactcacagacgtgccccaactgcgggggagatcttcggggtgcgcctcaccgatggctcggccaagagcgccagcatgggaacctctccctcctctccgccagatccacaagcagcggcgcctccccccgcagacgggctcgacctcaccgacggctggggggggggggggcggaaccactggctcccctgcctcgagttcggctccgccgccttccccttccgcgagaacgccgcttcccccgggtactacgactgccggtactggaccatgaggaagctgcgcatgttcagatgctccgacaccacccaggtgtacgcccagctctaggagtgcaacaaagcccaccccgaccactacatgcgcgtcctcggattcgacaacgttaggaatgtggctagcttcatcttcttcccctaccagc

SEQ ID NO: 26061 - protein, 84 aa, Panicum virgatum
  misc_feature: Ceres CLONE 1867194
  misc_feature: SWISSPROT Homolog: EC 4.1.1.39 Ribulose-bisphosphate carboxylase
MGTSPSSPPDPQAAAPPPADGLDLTDGWGGGGRNHWLPCLEFGSAAFPFRENAASPGYYDCRYWTMRKLRMFRCSDTTQVYAQL

SEQ ID NO: 26062 - DNA, 712 bp, Panicum virgatum
  misc_feature: Ceres CLONE 1867261
  misc_feature: Encodes the peptide sequence at SEQ ID NO. 26063
gaagttcaaacacactctactccaagctcggctagctgagcagaggctcggacatgaccaagaagctcacctccgccatggccgggaagcaggattttcgcgaggcgcaattcgatgatcaggggaggcacaggcaccagcaggcttcggttcgcggaggcggcaagagcgcggcggcggggttcgggggcaggttgatctcccacgagcaggaggacgccatcatcgtcgcggcgctgcggcacgtggtgtccgggtacagcacgccgccgccggaggtcgtcacggtggcaggcggcgaggcgtgcggggtctgcggcatcgacgggtgcctcgggtgcgacttcttcggggcgcccgcggaggcggtgagctcttctggcgcggggcggacggcgccggcggcaggaggggggcagcagcagcagcagaggccgcggcagcggaggaagcggaacaggtaccgcggcgtgcggcagcggccgtggggcaagtgggcggcggagatccgcgacccgcggcgcgcggcgcgcgtgtggctgggcacgttcgacaccgcggaggcggccgccagggcctacgactccgccgcgctcgagttccgcggcccgcgcgccaggctcaacttcccgggccgcggcgacgccgcctgtgcctccgccgccgcggcggagacgacgacgacgccggggggagtcggacggggcggggg

SEQ ID NO: 26063 - protein, 211 aa, Panicum virgatum
  misc_feature: Ceres CLONE 1867261
  misc_feature (127)..(178): Pfam Name: AP2 Pfam Description: AP2 domain
  misc_feature: Useful for making plants with modulated biomass
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MAGKQDFREAQFDDQGRHRHQQASVRGGGKSAAAGFGGRLISHEQEDAIIVAALRHVVSGYSTPPPEVVTVAGGEACGVCGIDGCLGCDFFGAPAEAVSSSGAGRTAPAAGGGQQQQQRPRQRRKRNRYRGVRQRPWGKWAAEIRDPRRAARVWLGTFDTAEAAARAYDSAALEFRGPRARLNFPGRGDAACASAAAAETTTTPGGVGRGG

SEQ ID NO: 26064 - DNA, 713 bp, Panicum virgatum
  misc_feature: Ceres CLONE 1867265
  misc_feature: Encodes the peptide sequence at SEQ ID NO. 26065
cacggcggacttcacgacacacacgcaccagagacgagatccagagcaagacgtacatggaggtgaaggggaccggcacggcgaaccagtgcccgaccatcgacggcggcgtcgagtccttcccgttcaagcccggcaagtaccagatgaagaagttctgcctggagccgacgtccttcaccgtcaaggccgagggcatcgccaagaacgcgccgcccgagtaccagaagaccaagctcatgacccgcctcccctacaccctcgacgagatcgagggcccgctcgaggtcggctccgacggcaccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcctccttcctcgaccccaagggccgtggtggctccaccggatacgacaacgccgtggcgctccccgccggaggcagaggagacgaggaggagctcgtgaaggggaacatcaagaacgccgcatcgtcgacgggcaacatcacattgagcgtgaccaagagcaatccggagaccggcgaggtcatcggcgtcttcgagagcgtgcagccgtcggacaccgatctcggggccaaggcgcccaaggatgtg

SEQ ID NO: 26065 - protein, 236 aa, Panicum virgatum
  misc_feature: Ceres CLONE 1867265
  misc_feature (12)..(236): Pfam Name: MSP Pfam Description: Manganese-stabilising protein / photosystem II polypeptide
RRTSRHTRTRDEIQSKTYMEVKGTGTANQCPTIDGGVESFPFKPGKYQMKKFCLEPTSFTVKAEGIAKNAPPEYQKTKLMTRLPYTLDEIEGPLEVGSDGTLKFEEKDGIDYAAVTVQLPGGERVPFLFTVKQLVATGKPESFGGPFLVPSYRGSSFLDPKGRGGSTGYDNAVALPAGGRGDEEELVKGNIKNAASSTGNITLSVTKSNPETGEVIGVFESVQPSDTDLGAKAPKD

SEQ ID NO: 26066 - DNA, 709 bp, Panicum virgatum
  misc_feature: Ceres CLONE 1867275
  misc_feature: Encodes the peptide sequence at SEQ ID NO. 26067
aaagccaacagcgtagctccgccggcttcctccacgcttgagctccgccgccgccgcctccctccgtctccgtccctccgccaggaccggcgagatgaagctcgtcaggtaaagtccccgttctctctcgcctcttgcccggatggctccacctttgccctttccttcgctcctccgttcggtacgaacctcgcctaattcggtgctggatttggggtttcgctgcaggttcttgatgaagctgaacaacgagacggtcaccatcgagctcaagaatggcacggtggtccatggcaccatcacaggtgttgacataagcatgaatactcatctgaagacagtgaagcttacattgaaagggaagaatcctgtgacccttgaccacctcagtgtgcgagggaacaacattcgctattatattcttcctgacagcttaaacctggaaactttgctggtggaggaaacccctagagtcaagcctaagaagccaactacaggaaagcctctgggacgtggtcgaggccgtggtcgtggacgtggtcggggccggggtccgcgctgagctccgttgtacccttgctggcagctgtctggcatggcaagtttcccatacaatgtgaaagaatgttgcattgttacccttccgatgaacgcggacctaatatctcaatctcagtagttcttgttgtggaatccctgtctatttgac

SEQ ID NO: 26067 - protein, 139 aa, Panicum virgatum
  misc_feature: Ceres CLONE 1867275
  misc_feature (29)..(94): Pfam Name: LSM Pfam Description: LSM domain
MAPPLPFPSLLRSVRTSPNSVLDLGFRCRFLMKLNNETVTIELKNGTVVHGTITGVDISMNTHLKTVKLTLKGKNPVTLDHLSVRGNNIRYYILPDSLNLETLLVEETPRVKPKKPTTGKPLGRGRGRGRGRGRGRGPR

SEQ ID NO: 26068 - DNA, 681 bp, Panicum virgatum
  misc_feature: Ceres CLONE 1867304
  misc_feature: Encodes the peptide sequence at SEQ ID NO. 26069
cggcctcatctagcttgccgtctctctgcctcgtctccaacggggagggaaaaaaaatcagcggggattcagatgaggctctatctccggcaagcggcggccgcggccacggccaccagctcccccctggcggccaccatccgcaaggtaacctccccgcctcaagcgttctccctcttggctccactgacctgcccttgattttctcaatacagagttctccaagctccctcacccatggccggctcggcttcagccacgcccacacgtcgctgcagacgacgccgacgccgacgccgaaccaccgcggaaaccgaccagggtgggcggtgcgcgtgcttcccctgacggaggagaacgtggagagggtgctggacgaggtgcggccgagcctgatggcggacggcggcaacgtggcgctgcacgagatcgacggcctcgtcgtcgtgctcaagctgcagggcgcctgcggctcctgccccagctccaccatgacgctcaagatgggcatcgagacgcgcctccgcgacaagatccccgacatcctcgaggtcgagcagatcgtcgacaccgagaccggcctcgagctcaccactgacaacgtcgagaaggtacttgatgagatcaggccatacctctccggcaccggaggtggaagcctcgagctggtccagatcgatg

SEQ ID NO: 26069 - protein, 226 aa, Panicum virgatum
  misc_feature: Ceres CLONE 1867304
  misc_feature (120)..(187): Pfam Name: NifU Pfam Description: NifU-like domain
ASSSLPSLCLVSNGEGKKISGDSDEALSPASGGRGHGHQLPPGGHHPQGNLPASSVLPLGSTDLPLIFSIQSSPSSLTHGRLGFSHAHTSLQTTPTPTPNHRGNRPGWAVRVLPLTEENVERVLDEVRPSLMADGGNVALHEIDGLVVVLKLQGACGSCPSSTMTLKMGIETRLRDKIPDILEVEQIVDTETGLELTTDNVEKVLDEIRPYLSGTGGGSLELVQID

SEQ ID NO: 26070 - DNA, 783 bp, Panicum virgatum
  misc_feature: Ceres CLONE 1867356
  misc_feature: Encodes the peptide sequence at SEQ ID NO. 26071
aaagcccaacccacgccccactcgtccagtcctccccgaagccggcggcggcggcggcggcggcggcggcggacgaagcagcggcaggccatggcgtcgtcgtcgaccccggcggccgtccgcaagatgcacaaggatctcgaggtccaggctaacgccctcagcaagatccaaaaagacatcgcgaagaaccaccaggtccgcaagcagtacaccatccaggtcggcgagaacgagctcgtcctcaaggagttggagctgctgaatgatggggcgaacgtgtacaagctcattggaccggtgctcgtcaagcaggaccttgcggaggccaaggccaacgtcaagaagcgcatcgagtacatctcggcagagctgaagcggatggatcgggcgctgaaggatttggaagacaagcagaacagcaagaaggaatcgatattcaagttgcaacagaggatgcaggctgtacaagctaaggcttagacacctgcttgctgaatgcaactagtccaaggccttcctgcaaccacccatcccaatagcatccgctttttttttgtgtggaattaggtgtccagtgttctggtctctgaaaagaaagattgattgcgcctgtattcaggatgtccagtgtttatgtgagattcaatcgttcttgacgtctctgtagcaaagaatgttatctggatgctctgatgtaaaagtcggtcactagggttgaaggtgtatggtaaggcttgtagtggttttctttggttgagcttattggtacacaattgcatc

SEQ ID NO: 26071 - protein, 130 aa, Panicum virgatum
  misc_feature: Ceres CLONE 1867356
  misc_feature (18)..(123): Pfam Name: Prefoldin_2 Pfam Description: Prefoldin subunit
MASSSTPAAVRKMHKDLEVQANALSKIQKDIAKNHQVRKQYTIQVGENELVLKELELLNDGANVYKLIGPVLVKQDLAEAKANVKKRIEYISAELKRMDRALKDLEDKQNSKKESIFKLQQRMQAVQAKA

SEQ ID NO: 26072 - DNA, 632 bp, Panicum virgatum
  misc_feature: Ceres CLONE 1867361
  misc_feature: Encodes the peptide sequence at SEQ ID NO. 26073
attcctcctcgccgcctccccaaaacctagcgccggcgccgccaccccgtcgtacggtcgatcctccccgccctccagcagcagcgatggcccgcctctccgccgccgccgccgtgatcgccgccttcgtggccgtggccgtggccgcgctggccaccacggcctcggccgccgatgcgccggcccccgccccggcctccggcgcgggcgccctctcggcgcccctttccgtgtgctgcctcgccgcgctcctcgccgccgtcctccgccactgagccggcggcggccctccccgcgccgtccgcgtgcgtgtcttcgtcagatctagtagtacagtggtagcgagtgagagtttcttagtggtagtagcagtgctgttagcggtggtggcagtgtcgtggtggggagaggcattgtgctttggtggtccgccgggcggatggatccgagggttttttcgtttggggatttcctgaggttttcgatcggtggatttgattagcgtggttggtgtgagtcgattcctattatttattgtgtgcgtttgtgtacctagtgctcaccggctctgagagtattattattattatggatttatttatggtattgttattcttgtgtattctctttgt

SEQ ID NO: 26073 - protein, 62 aa, Panicum virgatum
  misc_feature: Ceres CLONE 1867361
  misc_feature: Useful for making plants with altered carbohydrate content
MARLSAAAAVIAAFVAVAVAALATTASAADAPAPAPASGAGALSAPLSVCCLAALLAAVLRH

SEQ ID NO: 26074 - DNA, 729 bp, Panicum virgatum
  misc_feature: Ceres CLONE 1867369
  misc_feature: Encodes the peptide sequence at SEQ ID NO. 26075
ccccgccgccgccgccaagcgcccccgcgagctagctccggcgaagccgaccccgcgcgccgcaggcaggcaggcagcatcaagcatggcggacacgaaggcggcgcccgcggtgacgctccgcacgcgcaagttcatgaccaaccgcctgctctcccggaagcagttcgtgctcgaggtcctccacccgggccgcgccaacgtctccaaggcggacctcaaggacaagctcgccaagctgtacgaggtcagggaccccaactgcatcttcgtcttcaagttccgcacccacttcggaggcggcaagtccacggggttcggcctcatctacgacaacgtcgaggcggccaagaagttcgagcccaaatacaggctcatcaggaacggtctcgctaccaaggtggagaagtcgcgcaagcagatgaaggagaggaagaacagggcgaagaagatccgtggtgtgaagaagacaaaggccggcgacgcgaagaagaaataagcaagatgtcactgtgctctagcagccctgagtccgggtgcccgcctgttcaccatcagaaatttttgtacgcccatctcgttgccgctgcgaaaatcgaaaatgcttcatccaccgctagatgtagaattttgagcagtttcgtcgtctcctgtcacatttgatttgaggctctccctcgtatttgacaatgatttgacatgagtttatgctgagtacgagattgtgct

SEQ ID NO: 26075 - protein, 137 aa, Panicum virgatum
  misc_feature: Ceres CLONE 1867369
  misc_feature (28)..(111): Pfam Name: Ribosomal_S24e Pfam Description: Ribosomal protein S24e
MADTKAAPAVTLRTRKFMTNRLLSRKQFVLEVLHPGRANVSKADLKDKLAKLYEVRDPNCIFVFKFRTHFGGGKSTGFGLIYDNVEAAKKFEPKYRLIRNGLATKVEKSRKQMKERKNRAKKIRGVKKTKAGDAKKK

SEQ ID NO: 26076 - DNA, 701 bp, Panicum virgatum
  misc_feature: Ceres CLONE 1867375
  misc_feature: Encodes the peptide sequence at SEQ ID NO. 26077
accatctggcattacctctaccagcagctgattgcccatctcaacaaacctcaaggatttcaccagcgctgctagcgatgacgaggtcagcaccggcggcggcctccgtcccggcgccgacgaagaagcagcagcacgcggcgctgcggggcagccagctgaagcagctccgcgagatcttccggcggttcgacatggacggcgacggcagcctgacgcagctggagctggcggcgctgctgaggtcgctgggcctgcgccccacgggggaggaggtgcgcgcgctgctggcggggatggacgccgacggcaacgacgccgtggagttcgacgagctggcggccgccatcgcgcccctgctcaccacgcagacgcacctcgtcgaccaggcccagctgctggaggtgttccgcgccttcgaccgcgacggcaacggcttcatctccgccgccgagctcgcgcgctccatggcgcgcctcggccagccgctcaccttcgaggagctcacgcggatgatgcgcgacgccgacgcagacggcgacggggtcatcagcttccaggagttcgccgccgtcatggccaagtccgcgctcgacttccttggcgtcgcctgatctttctgtcctttccaaccgcgcacgccgtcgcccgcccgcccgccattgattagtagctctccccctccctccattcttaatagg

SEQ ID NO: 26077 - protein, 178 aa, Panicum virgatum
  misc_feature: Ceres CLONE 1867375
  misc_feature (142)..(170): Pfam Name: efhand Pfam Description: EF hand
  misc_feature (106)..(134): Pfam Name: efhand Pfam Description: EF hand
  misc_feature (30)..(58): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
MTRSAPAAASVPAPTKKQQHAALRGSQLKQLREIFRRFDMDGDGSLTQLELAALLRSLGLRPTGEEVRALLAGMDADGNDAVEFDELAAAIAPLLTTQTHLVDQAQLLEVFRAFDRDGNGFISAAELARSMARLGQPLTFEELTRMMRDADADGDGVISFQEFAAVMAKSALDFLGVA

SEQ ID NO: 26078 - DNA, 898 bp, Panicum virgatum
  misc_feature: Ceres CLONE 1867427
  misc_feature: Encodes the peptide sequence at SEQ ID NO. 26079
gtctcttccgcacgcacccggcctcggcgaatccaacgcgacgagcagcagggcgcaggccgagcacgccgccgccggctccctccctaccgccacctcccccctcttttctccgccggatcctccaaccgccgttcccacctcggtgtagcggtggtgcggcaggagtcgattggagtggagatccctccggtcgtggattgatttcgtcctttgttcttctcggcgcaacaggtgacggcgcgggtttttgttcaaaattcctgccgcatggacaacgtcgagtccgcccctgactccccggtgcaggcgccgccgtcctccgcctcgtctctccctaaggagcaatcgcaggtggagttggagctgaggcttctccaggctctcgagttctatcctccgtccaaactcaaaggcgttcatcgtcactttgttctctatggcctcatggaatatttgagaaaaagccttgatcgtcaattctcttctgatgaggttttgcaactattggatcgtttctttaacctagaaatgctgaaaccagaggacgatgaaaaggacaacttcagtcaagggggagaattttccttgccagagagctttctcaacaaggaagaataacagcaagtagctcataacatgcttcacaatgtcatcgaaggtgctttgagtgtcctctggaaaagaaatcagggagctggttcttagtgactcccacttcctagtagttgtcgtctaggccatccgttggtagtaggcatgggcactgaaggaacactcaacacattgctcagttgtgttcgtgtttactgacttgtacagattttgttactcttggatatccaatcaatgggttgcgcggttgcttccactaagctaagcattagccttgccttct

SEQ ID NO: 26079 - protein, 116 aa, Panicum virgatum
  misc_feature: Ceres CLONE 1867427
  misc_feature (30)..(114): Pfam Name: CT20 Pfam Description: CT20 family
MDNVESAPDSPVQAPPSSASSLPKEQSQVELELRLLQALEFYPPSKLKGVHRHFVLYGLMEYLRKSLDRQFSSDEVLQLLDRFFNLEMLKPEDDEKDNFSQGGEFSLPESFLNKEE

SEQ ID NO: 26080 - DNA, 750 bp, Panicum virgatum
  misc_feature: Ceres CLONE 1867457
  misc_feature: Encodes the peptide sequence at SEQ ID NO. 26081
atccggttcaaagccgaggaatcaaagtctactcgccactcgcctacctctccagccaaacccacgcctccgctcgccccgctcgcttccgccatggcggccttcccctccgcctccccgtcgccggcgatctccgcctcgacctggcgcatggcgtccctccgtgcggccctccccacgctccgcccgtctccggcgggcaggctccggtcgtccttctcgcccgcggcggcgtcggtcggctgcctcgggtcattctccggcctcgcgcccgtctcgaatcttctatcccttggtgccgagaactcaagctttgagcatcggttgttcagtgttgatgctcgtggaaggatagttgcaatgcggcacgggagacgcgttccaaaacttaacaggcctccagatcagaggaaagcacttctgcgtggtcttacaacacagttgctgaagcatggaaggataaagactacaaagccgagggcaaaggcaatgagaaagtatgttgagaagatgatcacgttggcaaaggatggatctcttcacaagaggaggcaggctctggcattcatttatgagaagcatatcgtccatgcattgtttgctgaggttgcagacaggtatggagacagagagggtggttacacaagggtcatcccaacatttccaagacggggagacaatgcacctatggcgtacattgaacttgtctaggatcttccatcagttgcagtgatttcatgggtgatttgc

SEQ ID NO: 26081 - protein, 205 aa, Panicum virgatum
  misc_feature: Ceres CLONE 1867457
  misc_feature (109)..(205): Pfam Name: Ribosomal_L17 Pfam Description: Ribosomal protein L17
MAAFPSASPSPAISASTWRMASLRAALPTLRPSPAGRLRSSFSPAAASVGCLGSFSGLAPVSNLLSLGAENSSFEHRLFSVDARGRIVAMRHGRRVPKLNRPPDQRKALLRGLTTQLLKHGRIKTTKPRAKAMRKYVEKMITLAKDGSLHKRRQALAFIYEKHIVHALFAEVADRYGDREGGYTRVIPTFPRRGDNAPMAYIELV

SEQ ID NO: 26082 - DNA, 610 bp, Panicum virgatum
  misc_feature: Ceres CLONE 1867477
  misc_feature: Encodes the peptide sequence at SEQ ID NO. 26083
atccctctcctcatcccttgcgctgcgcatatatcagccgggggccttgggacctcccgcccccgcatccatccatccgtcccctcgaagcaatcgactggaattggaaagaagcgagggacgagagcagcagcgcccgccgtcggcatgggtctgcaggaggaatttgaggagcacgcggagaaggccaagaccttgcctgactccactacagatgagaacaagctgatcctctacgggctctacaagcaagcaaccgttggtgatgtcaacactgggcgtcctgccttctacgacctgaaaggcaaagctaaatgggatgcttggaaggccgttgaagggaagtccaaggaggaagcgatgactgattacatcaccaaggtgaagcagctgctggaggaggctgctgctgcatccacttcctaggctgcgtgcatcaataagtaataaacattgttatctgtcagatggctccaggtttcatctatacatgtaattgttcgtcgtcatggatgttcagtgtcgtttaaggctgcaaaactcatgtgaaaacaaatggatgctgtctcagctcatcaccatatggatctttaaactctgttatttctgc

SEQ ID NO: 26083 - protein, 92 aa, Panicum virgatum
  misc_feature: Ceres CLONE 1867477
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEHAEKAKTLPDSTTDENKLILYGLYKQATVGDVNTGRPAFYDLKGKAKWDAWKAVEGKSKEEAMTDYITKVKQLLEEAAAASTS

SEQ ID NO: 26084 - DNA, 252 bp, Panicum virgatum
  misc_feature: Ceres CLONE 1867498
  misc_feature: Encodes the peptide sequence at SEQ ID NO. 26085
atcccatctcctctcgatctctgtagagtgactgagtgcccataaagttctccgtttgcttgtgttccatcctctgattctcagcgaggtatgtacctgctgctggagagccactgggcgtgtagctgttccagctgttcgtgcggctcctgttgcggagggtgttttatactgccagacatgactgaaccggtcaccaccaccaccagccacacagtaataataggattagctcctcccaacaaggggctc

SEQ ID NO: 26085 - protein, 53 aa, Panicum virgatum
  misc_feature: Ceres CLONE 1867498
  misc_feature (10)..(52): Pfam Name: Metallothio_2 Pfam Description: Metallothionein
MYLLLESHWACSCSSCSCGSCCGGCFILPDMTEPVTTTTSHTVIIGLAPPNKG

SEQ ID NO: 26086 - DNA, 691 bp, Panicum virgatum
  misc_feature: Ceres CLONE 1867510
  misc_feature: Encodes the peptide sequence at SEQ ID NO. 26087
atctcttctctctttccttcgcgtgggtatgtgcttcaaggaggagatccggccgccgagaaactactgcgacgccagcagcacggagtggctgtgcttccccggcaaatcctaccacggccgcgggcccatccagctctcctggtgcatacgtttctctctggaagctccgatctgatccgtcggcgacgaaggaggtgacgagatttgcatttgctttggggtcgcatgatgccaggaacttaactactggccggcgggcaaggcacagggcttcgacggcctgcgcgagccggaggtgtggtggccggcaacccggacgtggctcggccccggcagcagttctgcgaggccccttgcaggcgagcgagtggactcatggctgcgccgccgccggccataaatctttaatttttttcgttttcggatatgtagttgaatgctaaatcttttcatgttgtataatttttcttgtaatcttgggtctcctgttgtaatctaaatgactcttttccggctcctcatcccttttctttctgctctcagctttgttcccaccgcaatctacttatcttttttctctgttcttgattattgaagagcagaggagaaagacgaaggtggtagaaagagaaacgagaggagagagaagaatgaggagctagakaagtaatttaattttttttgcgtc

SEQ ID NO: 26087 - protein, 58 aa, Panicum virgatum
  misc_feature: Ceres CLONE 1867510
  misc_feature: SWISSPROT Homolog: EC 3.2.1.14 Chitinase
  misc_feature: Useful for biocontainment applications
  misc_feature: Useful for making plants with modulated biomass
SLLSFLRVGMCFKEEIRPPRNYCDASSTEWLCFPGKSYHGRGPIQLSWCIRFSLEAPI

SEQ ID NO: 26088 - DNA, 741 bp, Panicum virgatum
  misc_feature: Ceres CLONE 1867511
  misc_feature: Encodes the peptide sequence at SEQ ID NO. 26089
gataagcagcagctcgagtccaaccaaacaacaaccggaagaaaagagaaggcaagaagagactcacccgtcgctacgaacaccaattcttgcagagaggaggcatgagaacccaagtgttcttcctcacattcgccttgctcgctgtgctcgggcaatcgagcaacaggcaccaccaccaccaccaccactcccatgttcagagcaaaggtactggatcttctcttcttgcacaaaagatgctccttttctcgacatgttgatccaagaattgcttgacccttttcctttcatgggtttccaagtaacaatcaaagaattcgtgattcgtttggtttttcttgtgagtatatgcatcagtttggctcacccggttggaatctgtgtctggtttcagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgcccgcgcccactgaccggccggctgagcggacgacaacgagtcgacgactcgttctgattgctactgttgacccaccaactgtcccacccca

SEQ ID NO: 26089 - protein, 103 aa, Panicum virgatum
  misc_feature: Ceres CLONE 1867511
  misc_feature (39)..(65): Pfam Name: Bowman-Birk_leg Pfam Description: Bowman-Birk serine protease inhibitor family
MHQFGSPGWNLCLVSGHGGGGGGGELASRGKAAARAWPCCDNCGGCTKSNPAQCRCLDAAPRGCHPACRDCVKSSLSADPPVYQCMDRVPNFCSRRCSAARAH

SEQ ID NO: 26090 - DNA, 661 bp, Panicum virgatum
  misc_feature: Ceres CLONE 1867535
  misc_feature: Encodes the peptide sequence at SEQ ID NO. 26091
attcatttctcgcatttgcagcccccacaaacccccgagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatctgcaacgtcgacagcgaccgcgacggccgcgtcgacttcggcgagttcaagaacatgatgcaggggatcaccgtgtggggcgcctagctgcagcgtccctgcgttgccaaccttctacagtgtgttgacatgtatgtatgatgtatctactatgtaggcagcgccttttcttctacccggcgcttcttcttcttggtcgcgctgtggattcttcttgttcttggcttcgctctgtttgggatcctagccttcagaaatttggggcaacagcgaaggcccacaggccacgggcattgtttcctgttcttgatttatttaatagcattattacatgtaagaacgttgaccttgaccagcttccctctccttcactttcttggtgcttcccctcacctatgcctctccctatcactatcagcgcgtctacatattcagttgcgtcatttcaaaatgttcttttcagaaaacaaagcagtttcgtcgttag

SEQ ID NO: 26091 - protein, 86 aa, Panicum virgatum
  misc_feature: Ceres CLONE 1867535
  misc_feature (15)..(43): Pfam Name: efhand Pfam Description: EF hand
  misc_feature (53)..(81): Pfam Name: efhand Pfam Description: EF hand
  misc_feature: SWISSPROT Homolog: EC 2.7.11.1 Non-specific serine/threonine protein kinase
IHFSHLQPPQTPEGDMKEAFRVFDEDGDGYISAAELQAVLKKLGLPEARNLATVQEMICNVDSDRDGRVDFGEFKNMMQGITVWGA

SEQ ID NO: 26092 - DNA, 423 bp, Panicum virgatum
  misc_feature: Ceres CLONE 1867546
  misc_feature: Encodes the peptide sequence at SEQ ID NO. 26093
gtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcgtcctcgatcgtgagacccagaggtcccgcggcttctgcttcgtcaccttctcgagcaagcgagcgatgcgcgacgccctcgaggggatgaacggcgaggagctggacgggcgccccgtcgccgtccacgaggcccaggcccgccgccgcccgcgctcccggggctgcggcggctccggccgccacacgggtcgtgggggctacc

SEQ ID NO: 26093 - protein, 107 aa, Panicum virgatum
  misc_feature: Ceres CLONE 1867546
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MEASDVEYRCFVGGLAWATDDNSLHNAFSTYGEVLESKIVLDRETQRSRGFCFVTFSSKRAMRDALEGMNGEELDGRPVAVHEAQARRRPRSRGCGGSGRHTGRGGY

SEQ ID NO: 26094 - DNA, 682 bp, Panicum virgatum
  misc_feature: Ceres CLONE 1867631
  misc_feature: Encodes the peptide sequence at SEQ ID NO. 26095
gcttctccgcgcactccatctccctccccgccgccgctcgcagccgcatcggccatgggggcgtacaagtacgtgtcggagctatggaggaggaagcagtccgatgtgatgcgcttcgtgcagcgcgtccgctgctgggagtacaggcagcagccggcgatcgtccgcctcaccaggcccacccgccccgacaaggcccgccgcctcggcttcaaggccaagcagggctatgttgtttaccgtgtccgtgtcaggcgtggtggtaggaagaggcccgtgcccaagggtattgtctatggcaagccaaagcaccagggtatcacccaactcaagttccagaggaacaagaggtctgttgctgaggagagggctgggcgtaagcttggtggactgagggttctcaactcctactgggtgaacgaggatagtacgtacaagtactttgaggtcatcctcgttgatgttgcccacactgccatccgcaacgaccccaggatcaactggctgtgcaaggatgtgcacaagcaccgcgagctccgtggcctcacctctgctggcaagaagtaccgtggtctgcgcggcaagggccacacccaccacaagaacaggccctccaggagagccacctggaagcgcaaccagaccctctccctccgccgctaccgttgagctctgtgcctgg

SEQ ID NO: 26095 - protein, 204 aa, Panicum virgatum; identical to SEQ ID NO: 12677
  misc_feature: Ceres CLONE 1867631
  misc_feature (2)..(193): Pfam Name: Ribosomal_L15e Pfam Description: Ribosomal L15

SEQ ID NO: 26096 - DNA, 608 bp, Panicum virgatum
  misc_feature: Ceres CLONE 1867636
  misc_feature: Encodes the peptide sequence at SEQ ID NO. 26097
atctcctgtgttatcagtccctgttcggcttcctagagttccagctggtgttggtcgagcagagacgaaggccatgagctaccagccttcagcgtacccgccaccgggcacggcgtaccctccgccgggccagcaggcatacccgccgccggcctatggcgcgccgcctcccatggccgggtacccgccgccggcctatggcgcgccgcctcccatggccgggtacccgccgccgcccccaccgccacaggagtccaagggcaacgacggcttcttgaaaggatgcttggcggccatctgctgctgctgcctgctcgacatgtgcttctgacctcacatcagggaagagaacgtccagactgatccttcatgcaggcgaatagagctgtttctgagtcatgatgcgtctttgtttacatcaatgtatctgttttgcccttgttatgaatttatgatcatggtgttggtgtacccgcaaactagtagatctttggacttcactagctgatctataggtttttcctttttccttttggagttccttgtgtgtgctctgaaaaagcatctccgatcaatctgtacttggtttggtgcttgattattgccgt

SEQ ID NO: 26097 - protein, 85 aa, Panicum virgatum
  misc_feature: Ceres CLONE 1867636
  misc_feature: Useful for making plants with altered carbohydrate content
  misc_feature: Useful for making plants with altered cell wall content and/or composition
MSYQPSAYPPPGTAYPPPGQQAYPPPAYGAPPPMAGYPPPAYGAPPPMAGYPPPPPPPQESKGNDGFLKGCLAAICCCCLLDMCF

SEQ ID NO: 26098 - DNA, 705 bp, Panicum virgatum
  misc_feature: Ceres CLONE 1867637
  misc_feature: Encodes the peptide sequence at SEQ ID NO. 26099
acgatccgcgatcggcgagctgcctttttttttcttgacattgtgctgaaagcaaggagaggtgtataatcccggccttctcaggaaagcaaaagatggaagcaccatcgatcaccgtgaagtccgtcgccgatgggccgcagctcaaggaaatcatgaagaatgctgctgaggatggtggcaacaagttgctggtgctggagttcatggcgccgtggtcggagccgtgcaagtacatgagcaaggtgctagatggaaaccccgccgggagaggacttgcatacgatttgcgaggctatgctgacttttacgcgcttgacatcaccaaattcaggcaatttgcacagcgcatgacagtggaggccctgccgacgtttctgctactcacgaagggctacacggtgctggcccgcgtcgtaggcgttgacaaggaagagctcaggagcagcatcatgcaggaacacagagacaaagcagctgctggggccggccaggaaaaggtgaaccccgaacaagatatagatgagcccctgagcttgttctcaagtccgtatgccttcttgagggccaggctaagatcattcttcaattagatcttgatctctgcgtcatgagtgtagctagctagtacatcataaataaatctaaaataaatattgtgtaaattctaatactacagtatgcatgatatctgtgtgtgagcat

SEQ ID NO: 26099 - protein, 165 aa, Panicum virgatum
  misc_feature: Ceres CLONE 1867637
  misc_feature (5)..(122): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MEAPSITVKSVADGPQLKEIMKNAAEDGGNKLLVLEFMAPWSEPCKYMSKVLDGNPAGRGLAYDLRGYADFYALDITKFRQFAQRMTVEALPTFLLLTKGYTVLARVVGVDKEELRSSIMQEHRDKAAAGAGQEKVNPEQDIDEPLSLFSSPYAFLRARLRSFFN

SEQ ID NO: 26100 - DNA, 622 bp, Panicum virgatum
  misc_feature: Ceres CLONE 1867661
  misc_feature: Encodes the peptide sequence at SEQ ID NO. 26101
atttacgtcgcatagcttccccagaccccacccaggcaaaagaccgagccgtccccagccaggcagcgagccatgtccaagtacggcaccatccccgcctcctcatcgcccccgccggcgccggcgggggcatcctcctccacctacccgctcgacttcatctcccgcgccaaggcccgcggcgcgtccgcgctcgccgcgcgccgcccctggcgcgagctcgcggacccgggcgcgctctccctcccgcggggcttctccgacgcctaccgccgcgcgcgcgccaacctcgcacacttcgccgccaactacgcgctcgtcgtcctggccgtcgtcttcgcctccctgctctggcaccccgtctccctgctcgtcttcctcgcctgcttcgccgcctggctcttcctctacttcctccgcgaccgcgacgtcgaccaggcgctcctcatctgcggccgccccgtcggggacggcatcatcatcgcgttcctctccgcggtcacgctcgtgctcctgctgctcaccggcgccacctccaacatcctcatctccctgctcgtcggcctcctcgtcgtcctgttccacgccctgctgcaccgacccgccgacagcatcgacgagg

SEQ ID NO: 26101 - protein, 183 aa, Panicum virgatum
  misc_feature: Ceres CLONE 1867661
  misc_feature (36)..(182): Pfam Name: PRA1 Pfam Description: PRA1 family protein
MSKYGTIPASSSPPPAPAGASSSTYPLDFISRAKARGASALAARRPWRELADPGALSLPRGFSDAYRRARANLAHFAANYALVVLAVVFASLLWHPVSLLVFLACFAAWLFLYFLRDRDVDQALLICGRPVGDGIIIAFLSAVTLVLLLLTGATSNILISLLVGLLVVLFHALLHRPADSIDE

SEQ ID NO: 26102 - DNA, 597 bp, Panicum virgatum
  misc_feature: Ceres CLONE 1867697
  misc_feature: Encodes the peptide sequence at SEQ ID NO. 26103
acaagttcacaagatctggacacactcagctgcacggcaatgcgataatgatcaccagcacaatcactgtcgtcctatttagcaccatggtgtttgggatgatgacgaagccattgatccagttcctgctccctgcctccagcaacactgtcgcctccgagccttcgtcgcccaaatccctgcactcccctctgctgacgagcatgcagggctccgacctcgagaatgccactgcgagcattgtcagaccgtccagccttcggatgctcctcagcaagccgacccataccgtccactactactggcgcaagttcgacgacgcgctgatgcggcccgtgttcggcggccgtggcttcgtgcccttctcccccggatcacccaccgagcatagtggacggtgaacactgccaagataacaaaaactgacacgagaggaagagacatgtttctggtgagtagggagtttggctgctgatagtcagatgacgaagcttatgttgttcagaacttcagatggtgtagtccctcagcaatggtgaggagggaccttcagctaatggaccaaatggagggttagttggtttggatctgcaggac

SEQ ID NO: 26103 - protein, 132 aa, Panicum virgatum
  misc_feature: Ceres CLONE 1867697
  misc_feature: The sequence is a functional homolog of SEQ ID NO 2 in US patent 7250560
  misc_feature: Useful for making plants with modulated water use efficiency
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
KFTRSGHTQLHGNAIMITSTITVVLFSTMVFGMMTKPLIQFLLPASSNTVASEPSSPKSLHSPLLTSMQGSDLENATASIVRPSSLRMLLSKPTHTVHYYWRKFDDALMRPVFGGRGFVPFSPGSPTEHSGR

SEQ ID NO: 26104 - DNA, 648 bp, Panicum virgatum
  misc_feature: Ceres CLONE 1867703
  misc_feature: Encodes the peptide sequence at SEQ ID NO. 26105
atcatcctcttcctcacagctgcttgctttggctgctctctgccgtcgatatatatagatcctctgttctccgctcctccgagttcgatggacctgcaggcggagctgcggcgcccggcggcggctcacgaggcggcgctgagggccgtgcagaagccgcccgccaagccctggcgcgggggaggcgccgcttcgaccccgcccccgccgcccgaggtgtaccgcgtcgagccccgggagttccgggacctcgtgcagaggctcaccggcgcgccgcccgctcccacgggcaggggcggcgtggcgcggccgcagcatcatcagctgccggcggaggtgcagccacaccagccagtggccgttcgcgctacagggaaccaccatcagtagcagcagcagctttacggctcgccgtggttctccttcccgctggccgggctggacggcgccaacgccggcggcctcatgtactcgtcgcgacgcagcgcacgcatcaagggaagagaaggcaagggatcgatgaagcaaatcaaagctttctccttttttttttgttggttatgacacgacagagtagtttgtttctgaaacaaggaaggcaatctagcatacgagaatcagcagcagccggcaccacaccacccatgc

SEQ ID NO: 26105 - protein, 100 aa, Panicum virgatum
  misc_feature: Ceres CLONE 1867703
  misc_feature (38)..(68): Pfam Name: VQ Pfam Description: VQ motif
MDLQAELRRPAAAHEAALRAVQKPPAKPWRGGGAASTPPPPPEVYRVEPREFRDLVQRLTGAPPAPTGRGGVARPQHHQLPAEVQPHQPVAVRATGNHHQ

SEQ ID NO: 26106 - DNA, 764 bp, Panicum virgatum
  misc_feature: Ceres CLONE 1867718
  misc_feature: Encodes the peptide sequence at SEQ ID NO. 26107
cttttttctcccctccgcgcgacggctccccgcctctcctctcctcctgcctcctgcctccgcccgtccgccgcgaccgtcgaacgccgtaccagtaccgtgcaggaacagtcggtagagaggaggaggaggagcgtcgggcgagatggggatgcgggataagaagcgcaaccagaagcgggtcctcgcgcggcgcaccgcggccccccgctccggcgagggcaaggacttcctgccgttggaagacgggtccgggaagaggacccggaggaagctgcagcagcccgaggagccggagaacaccgccacggttgtctacatcgggcacatcccccacggcttctacgaggaccagatgaaagggttctttaagcagtttggggatattaagcggcttaggattgctcggaaccgcaagacaggaaagtccaagcattacggattcattgagtttgagagccctattgtggcgaaggttgtagctgatgagatgaataactatctcttgtttgagcacactttgcgagtttcacttgtcccaccagagaaagttcatccaaaactatggaaaggggtgcggcggggatttataccaattgatcgggtaacaatcgaacggaagaggcacaacaaggacaaatcagtagaagaacacaaaaagatggttgaaggaattgtaaaacgagatgaaaagagacacaaaagaatccaggctgctggaattggactacgagtgtccagcccttataggggatcagtcagcc

SEQ ID NO: 26107 - protein, 206 aa, Panicum virgatum
  misc_feature: Ceres CLONE 1867718
  misc_feature (57)..(128): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTAAPRSGEGKDFLPLEDGSGKRTRRKLQQPEEPENTATVVYIGHIPHGFYEDQMKGFFKQFGDIKRLRIARNRKTGKSKHYGFIEFESPIVAKVVADEMNNYLLFEHTLRVSLVPPEKVHPKLWKGVRRGFIPIDRVTIERKRHNKDKSVEEHKKMVEGIVKRDEKRHKRIQAAGIGLRVSSPYRGSVS

SEQ ID NO: 26108 - DNA, 624 bp, Panicum virgatum
  misc_feature: Ceres CLONE 1867741
  misc_feature: Encodes the peptide sequence at SEQ ID NO. 26109
gatcatagttcttgctttgacacacgcatcatccatccatcatccatccggcgaaacagtgtgctagcagctgatcaatcgatcgaatccatccatccgtcatgagctaccaagcaggctacccgccgccgggccagcaggcctacggcggcgcgcccccgccgccggcctacgtcgcaccaccgccggcgtacccgcccacccaggacggcgggtaccagcagcagcagcagccggagaccaccagccgcggcggcgacggcttctggaaaggatgctgcgccgccgtctgctgctgctgcctcctcgacatgtgcttctgaggacgacgacgagtggcgacaccagctagttgctcatcacgatgattcattgctcaatttgtgtggttgtacctttgttcagtagttattgttccatttattggtagtatgactactaggagcgtcacgggtgatttgttgatttcgagtatgtgctggctcaatgttttgaaggtgtttgtagcggtagaatgatgtgtgtatttaccagagtgagtgtacgtgcgtgtttgtgagtttctacgtgtacactacgtggtccactacgtgtacaaacttctttttaaaagaattttctcat

SEQ ID NO: 26109 - protein, 73 aa, Panicum virgatum; identical to SEQ ID NO: 14742
  misc_feature: Ceres CLONE 1867741
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: Useful for making plants with altered carbohydrate content

SEQ ID NO: 26110 - DNA, 735 bp, Panicum virgatum
  misc_feature: Ceres CLONE 1867745
  misc_feature: Encodes the peptide sequence at SEQ ID NO. 26111
atcacccatcaatcgagcacctcctccaatcttcaaggcatccatcgatcaccagcagcgcgtgccgtgtagagagacagagagagagagtcaccggagaagggaggaatcgccaccgccaccgccaccgccatgggcaaggtccgctccttcttctcccgcagcggcaagcgctgcgccggctcgtcctcgccgtcctcctccgcggcgggcagcgcgccgtcgtccccgtccccgaggaagtcgtcggcgttggccccggcgccggcggcggcggagaaggacgagatggagcgcgtgttccgcaagttcgacgcgaacggcgacgggcggatctcgcggtcggagctggcggcgctgttcgagggcgtggggcacgcggccaccgacgacgaggtgtcgcgcatgatggaggaggccgacgcggacggcgacggcgccatcagcctgcccgagttcgccgcgctcgtgcgctccgccgacgccgacgccggcgccgtcgaggaggacctgcgccacgccttcatggtcttcgacgccgacggcaacggcctcatcacgcccgccgagctcgcgcgcgtcctgcgcggcctcggcgaggccgccaccgtcgggcagtgccggcgcatgatccagggcgtcgaccgcaacggcgacggcctcgtctccttcgacgagttcaagctcatgatggccgccggcggaggcttcggcagggtgtcctcctcttcgttt

SEQ ID NO: 26111 - protein, 200 aa, Panicum virgatum
  misc_feature: Ceres CLONE 1867745
  misc_feature (52)..(80): Pfam Name: efhand Pfam Description: EF hand
  misc_feature (162)..(190): Pfam Name: efhand Pfam Description: EF hand
  misc_feature (88)..(116): Pfam Name: efhand Pfam Description: EF hand
  misc_feature (126)..(154): Pfam Name: efhand Pfam Description: EF hand
  misc_feature: SWISSPROT Homolog: EC 2.7.11.1 Non-specific serine/threonine protein kinase
MGKVRSFFSRSGKRCAGSSSPSSSAAGSAPSSPSPRKSSALAPAPAAAEKDEMERVFRKFDANGDGRISRSELAALFEGVGHAATDDEVSRMMEEADADGDGAISLPEFAALVRSADADAGAVEEDLRHAFMVFDADGNGLITPAELARVLRGLGEAATVGQCRRMIQGVDRNGDGLVSFDEFKLMMAAGGGFGRVSSSS

SEQ ID NO: 26112 - DNA, 711 bp, Panicum virgatum
  misc_feature: Ceres CLONE 1867755
  misc_feature: Encodes the peptide sequence at SEQ ID NO. 26113
aaagacgtagatcactgtcgcggatcgaagaagaggcggaccgacatggcgtggcagcaggcgatgggatctcacgccgcgggcgggagccaggcgccaccggcggcggcggcggcggcggcgggaggaggcgagacgcagcggacgcagtatccgtatgtgactggtacttctgtcattgccttgaagtacaaggatggtgtgatcatggcatgtgatactggagcctcctatgggtcaactttgagatacaagagtgtggaacgcattaaggcagttggtaagcatagcctcattggagcaagcggagagtacagtgatttccaggagattttgcgctatctcgatgaactaactttgtctgatcatatgtgggatgatgggaactctttgggcccgaaagagatccacagttatttgacaagggtaatgtacaacagacgcaacaagtttgatcctctctggaacacccttgtccttggtggagttaaaaagggcccaaagggcgatgagaaatatcttgggatggttaacatgattggtacccactttgaggaaaaccatgttgctactgggtttggaaatcatctggcgatccccatacttcgggctgaatggcgcgaggaaatgacttttgaagaagctgttaagctggttgagaagtgtttgctggtcttgctgtaccgtgataggtcatctatcaacaaaatc

SEQ ID NO: 26113 - protein, 221 aa, Panicum virgatum
  misc_feature: Ceres CLONE 1867755
  misc_feature (38)..(221): Pfam Name: Proteasome Pfam Description: Proteasome A-type and B-type
  misc_feature: SWISSPROT Homolog: EC 3.4.25.1 Proteasome endopeptidase complex
MAWQQAMGSHAAGGSQAPPAAAAAAAGGGETQRTQYPYVTGTSVIALKYKDGVIMACDTGASYGSTLRYKSVERIKAVGKHSLIGASGEYSDFQEILRYLDELTLSDHMWDDGNSLGPKEIHSYLTRVMYNRRNKFDPLWNTLVLGGVKKGPKGDEKYLGMVNMIGTHFEENHVATGFGNHLAIPILRAEWREEMTFEEAVKLVEKCLLVLLYRDRSSINK

SEQ ID NO: 26114 - DNA, 548 bp, Panicum virgatum
  misc_feature: Ceres CLONE 1867774
  misc_feature: Encodes the peptide sequence at SEQ ID NO. 26115
gccggtgacgaccaccgagtccaaagagaaaacccgatgcagcaaccacgccgatcgcgagcgatctcgatcgatcggcggaaagacgccgccccacgcccgctgctcaggccgtccaggcctggtgtggaagaggaagagcggcggcggccgggaccaggaggagagggtgcccgggggccgcctgcccgtggtggcggccgccggaggcgagcgcgtgctggagccggtgcggctgctgcgcgacccgcgcgtctcgcagctgctggacatggcggcgcagcagtacgggtacggcgagccgggcgtgctgcgggtgccctgcgaggcgcggcggttccgcccggtcgtcgacggcgccatgcacagactaggagagctgcatgaccgcgacatgtgaggacacgcccccgctgtgtggggcgacggtgcttgtagtctcgtagtcccacccgatgattcatgcgcttaatctgtgataggatagatcgaccgtatggcgtagatgtcagcagcttagcacagaatgatgactcttattagctcat

SEQ ID NO: 26115 - protein, 132 aa, Panicum virgatum
  misc_feature: Ceres CLONE 1867774
  misc_feature (34)..(121): Pfam Name: Auxin_inducible Pfam Description: Auxin responsive protein
PVTTTESKEKTRCSNHADRERSRSIGGKTPPHARCSGRPGLVWKRKSGGGRDQEERVPGGRLPVVAAAGGERVLEPVRLLRDPRVSQLLDMAAQQYGYGEPGVLRVPCEARRFRPVVDGAMHRLGELHDRDM

SEQ ID NO: 26116 - DNA, 655 bp, Panicum virgatum
  misc_feature: Ceres CLONE 1867775
  misc_feature: Encodes the peptide sequence at SEQ ID NO. 26117
gccattccgtccgccgcccattcgtgttccagtttccaatcccccagatcctccgacctccccgcgcagccgtcgaatcatggcccgcacgaagcagacggcgcgcaagtcgaccggcggcaaggcgccgaggaagcagctggccaccaaggccgcgcgcaagtcggcgccggccaccggcggcgtgaagaagccgcaccgcttccgccccggcaccgtcgcgctccgggagatccgcaagtaccagaagagcacggagctgctgatccggaagctccccttccagcgcctcgtccgggagatcgcgcaggacttcaagacggacctccggttccagtcctccgccgtcgccgcgctgcaggaggccgtggaggcctacctcgtcgggctcttcgaggacaccaacctgtgcgccatccacgccaagcgcgtcaccatcatgcccaaggacatccagctcgcgcgccgcatcaggggcgagagggcctgagcgagcgatggtgctcttcgtcagcgttctttcgatttctctggcctgtcgccttgctagtctgctctgctacaactggactgggaatcgtttcttgccggcctggttggtgtatcttggtagtgctttggcctcactcgaattaaatggaaaaatgatctgtgt

SEQ ID NO: 26117 - protein, 136 aa, Panicum virgatum
  misc_feature: Ceres CLONE 1867775
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAVEAYLVGLFEDTNLCAIHAKRVTIMPKDIQLARRIRGERA

SEQ ID NO: 26118 - DNA, 854 bp, Panicum virgatum
  misc_feature: Ceres CLONE 1867783
  misc_feature: Encodes the peptide sequence at SEQ ID NO. 26119
aaaaagccgccgccaagagggtttctcttctcttccgctcgccatctcgaaagctcgccagcacccttcaatcccaagcagtcctcgacgcagatggcagttcccggcggccgcaacggcctcagggacgacgaggacgacatcgccgagcacgctgaggtcttcgccggcgcctccgacgacgaggacgtgcctccccacctccgcgccctcgccaacgccgcccagaccggcgatgtcgatgccctccgtgccgccctcgataaccatgatggcagtattgatgttcctgttgaagatggtgatactctgcttcacctggcatgcttatatggtcatcttccttgtgtgcagctactgttggaacgtgggtctagcttggaatgtaaagatgaagaaggtgcaattcctcttcacgatgcttgtgctggaggcttcactgagatggtccaatatatgcttaacttcgctgctagcagggatgattgcatagtgcgaatgctcaacaccgtggattctgaaggcgatacaccgctccatcatgctgctagaggagaatatttggatgttgtcaagcttttgctcgaggccggggcttctcccaagaaagagaacacttatgggcagacgcctgctgatatggctgaccaagacactgaagttcgaaccctgttgcttgcgaagcaaattgaggcaagcacacacgagtgatgattaagcacggtgtaattcttggttgaaactggtgatatggagcagtagtcgaaatatattgctatcttctcttccatccatgcttcaacgaaactgaagtaatattgtaatcaaaatgttatagtatggagggattagct

SEQ ID NO: 26119 - protein, 205 aa, Panicum virgatum
  misc_feature: Ceres CLONE 1867783
  misc_feature (69)..(101): Pfam Name: Ank Pfam Description: Ankyrin repeat
  misc_feature (143)..(175): Pfam Name: Ank Pfam Description: Ankyrin repeat
  misc_feature: SWISSPROT Homolog: EC 2.4.2.30 NAD(+) ADP-ribosyltransferase
MAVPGGRNGLRDDEDDIAEHAEVFAGASDDEDVPPHLRALANAAQTGDVDALRAALDNHDGSIDVPVEDGDTLLHLACLYGHLPCVQLLLERGSSLECKDEEGAIPLHDACAGGFTEMVQYMLNFAASRDDCIVRMLNTVDSEGDTPLHHAARGEYLDVVKLLLEAGASPKKENTYGQTPADMADQDTEVRTLLLAKQIEASTHE

SEQ ID NO: 26120 - DNA, 674 bp, Panicum virgatum
  misc_feature: Ceres CLONE 1867832
  misc_feature: Encodes the peptide sequence at SEQ ID NO. 26121
gcaatttcgcatcgatcgagagggaaaaacctaaaaccctgcctcccgatggcggcggcgaacggcgccgccgctcggcgcccgcggccgaacgtgctggtgacggggacgccgggcacggggaagacgacgacctgctccctcctctccgaagccgcgggcctccgccacgtcaacatcggcgacctcgtccgcgagaagggcctccacgacggctgggacgacgacctcgagtgccacgtcatcaacgaggacttggtctgcgacgagcttgaggacatgatggaagaaggtggtatactggtagattaccacggatgtgatttctttccagagcgttggtttgacctagtagttgtgctccagactgataactcaattctgcatgatcgcttgaccagcagaggctatacgggttccaagctctcaaacaacatagagtgtgagatcttccaagtgctcttggaggaggcgagggggagctacaaagaggacattgtgatgcccttgagaagcgacaacgtggaggatattagtaggaacgtaggtacattgacagactgggtaaataactggagaccatcctgatgagctaattgacctgttaaacctatatgttgccctaggggtagtactccactactcccccctacccccacccatgacccacccac

SEQ ID NO: 26121 - protein, 179 aa, Panicum virgatum
  misc_feature: Ceres CLONE 1867832
  misc_feature: SWISSPROT Homolog: EC 2.7.4.3 Adenylate kinase
MAAANGAAARRPRPNVLVTGTPGTGKTTTCSLLSEAAGLRHVNIGDLVREKGLHDGWDDDLECHVINEDLVCDELEDMMEEGGILVDYHGCDFFPERWFDLVVVLQTDNSILHDRLTSRGYTGSKLSNNIECEIFQVLLEEARGSYKEDIVMPLRSDNVEDISRNVGTLTDWVNNWRPS

SEQ ID NO: 26122 - DNA, 706 bp, Panicum virgatum
  misc_feature: Ceres CLONE 1867837
  misc_feature: Encodes the peptide sequence at SEQ ID NO. 26123
tacagaattcatgcatggagggagtattttcgacttcctgtacaatagacaaggaagttttcagctcccagatgtgataagaattgcatctgatgtgtccaagggaatgaattacttgcatcagattaatattgttcaccgggacttgaagactgcaaatcttcttatggatgatcaggttgtcaaggttgcagactttggggtcgcaagggttaaagaccagtcaggagttatgactgcagaaaccggaacctacagatggatggcccctgaggtcattgagcacttgccgtatgaccatagggcggatgttttcagtttcgggatagttctttgggagctgctgactggaaagcttccatacgaagacatgacacctcttcaggcggcagttgctgttgttcaaaaggatctgaggcctactattgctgctgatactcatcctatgcttgcggacctacttcagcgatgctggcagaaagatccagctctaagaccaaccttcgcagagattgtggatatactgaattccataaaagaggtggttcggagttctgggcatcacaagagacattcaggtcgatctcactctgggaagagacaaggctgttgatgcggcagttttgtttagtgttctacgccttttcttttgtgccctttctcatttttcatctttgacagcagtgacttttaggccttatacttt

SEQ ID NO: 26123 - protein, 203 aa, Panicum virgatum
  misc_feature: Ceres CLONE 1867837
  misc_feature (1)..(175): Pfam Name: Pkinase Pfam Description: Protein kinase domain
  misc_feature: SWISSPROT Homolog: EC 2.7.11.1 Non-specific serine/threonine protein kinase
TEFMHGGSIFDFLYNRQGSFQLPDVIRIASDVSKGMNYLHQINIVHRDLKTANLLMDDQVVKVADFGVARVKDQSGVMTAETGTYRWMAPEVIEHLPYDHRADVFSFGIVLWELLTGKLPYEDMTPLQAAVAVVQKDLRPTIAADTHPMLADLLQRCWQKDPALRPTFAEIVDILNSIKEVVRSSGHHKRHSGRSHSGKRQGC

SEQ ID NO: 26124 - DNA, 419 bp, Panicum virgatum
  misc_feature: Ceres CLONE 1867863
  misc_feature: Encodes the peptide sequence at SEQ ID NO. 26125
tttcttcagcttctgggtgctggcccacctgtacccgttcgctaaggggctgatggggcggaggggccggacgccgaccatcgtcttcgtctgggccggcctcttgtccatcaccatctcgctgctgtgggtggccatcaacccgccctcgcagaattcccagatcggtgggtcgttcacgttcccgtgagcggtcacaccattacatgaattccttgcttcgtgccggttgctcagcgctggtgggaaggggaattctgactgctgaaaaggctaagtgcttcggttaaaatccatagtgctgtcatatgagttacaatagttcttttgttctttatttaatttttgccctgtactgtcccgatatgagaattggttctgctggaccatgaaacgagtacaaattttcaagttgttcc

SEQ ID NO: 26125 - protein, 62 aa, Panicum virgatum
  misc_feature: Ceres CLONE 1867863
  misc_feature: SWISSPROT Homolog: EC 2.4.1.12 Cellulose synthase (UDP-forming)
  misc_feature: Useful for making plants with modulated plant growth and development
  misc_feature: Useful for making plants with altered cell wall content and/or composition
  misc_feature: Useful for making plants with modulated biomass
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 26 in US patent 7312377
  misc_feature: The sequence is a functional homolog of SEQ ID NO 2 in US patent 7049481
FFSFWVLAHLYPFAKGLMGRRGRTPTIVFVWAGLLSITISLLWVAINPPSQNSQIGGSFTFP

SEQ ID NO: 26126 - DNA, 814 bp, Panicum virgatum
  misc_feature: Ceres CLONE 1867869
  misc_feature: Encodes the peptide sequence at SEQ ID NO. 26127
acacggtttcaccctccgtcactgtcgctgcggccatgtcctcgtcctcgtccttccccacctcccgcttccccttcgccgccggcgccggggcccccggcggcggtggcggaggaggaggtggaagcagcgtgcggccgtgggggtcgagcggcgggacgtcggtttcgtcttcggggaagcggatacagaaggagctgctggacctcaacgcctccgactgctccgccgggcccaagggcgacaacctctaccactggctgtccaccatcatcgggccccaaggatcgccgtatgaaggagggatatttttccttgatatcgtgtttccccccgattatcctttcaaacctccgatggtaactttcaaaacaaggatttaccactgcaatgttgacgccactggtaaagtgcatttgggcattctgaaggatggctggagtccagctttcactatttcaaaggtgttactggccatcaaagacatcatcagcaatccagatccatacaccccgcttgtgatgaacatttcacgtcagtatctgactgacagaactaaacacgatgaaatagcagctgagtggacaatgaggtttgcaagatagagaattctgtctgtatctaagcaatgttgaccttgtaaaataatattccttaatgtgtcttgagatgtagaatgttggcaaaggacccatgttttgtttagtctgagttgtaacataaaaatgtactttatgcttgaggttatttcttatttagttgcttcttgtaggtgcagaattacctttttttattattattttgcacttctgcc

SEQ ID NO: 26127 - protein, 189 aa, Panicum virgatum
  misc_feature: Ceres CLONE 1867869
  misc_feature (50)..(184): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for making plants with modulated low light sensitivity
  misc_feature: Useful for making plants with modulated light quality sensitivity
  misc_feature: Useful for biocontainment applications
MSSSSSFPTSRFPFAAGAGAPGGGGGGGGGSSVRPWGSSGGTSVSSSGKRIQKELLDLNASDCSAGPKGDNLYHWLSTIIGPQGSPYEGGIFFLDIVFPPDYPFKPPMVTFKTRIYHCNVDATGKVHLGILKDGWSPAFTISKVLLAIKDIISNPDPYTPLVMNISRQYLTDRTKHDEIAAEWTMRFAR

SEQ ID NO: 26128 - DNA, 582 bp, Panicum virgatum
  misc_feature: Ceres CLONE 1867879
  misc_feature: Encodes the peptide sequence at SEQ ID NO. 26129
atctctccgcctccgccattcctcttcccctgcgatccgaggccgaacgctcaggcgcaagaaggataagcgatcacgtgatcgggcgacgcctcccgatctcgcgcctgagcggacatggcgctcgcgtccgcgaccctgttccgccccctcttcgccgagaaggacatgaggatcctcatggttggtctcgacgcggctggtaagaccaccatcctctacaagctcgagctcggggagatcgccacccccctccccaccataggatttagtgttgaaactgttgagtacaagaccattagcttcactgtttgggatgttggtggtcaggacaagatccgtcccctgtggaggcactacttccagaacacccagcgcctcatttttgttgtgcacagcaacgacagagagcgtgttgttgaggcctcagatgacctccatcgtatgctgaatgacgacgagctccgtgatgctgtgcttctggcgtttgcaaactaactacatcttcctaatgccatgaacgctgctgaaatcaccgacgagcttggcctgcactccctgcgccagcgacgctggtatatc

SEQ ID NO: 26129 - protein, 126 aa, Panicum virgatum
  misc_feature: Ceres CLONE 1867879
  misc_feature (5)..(126): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MALASATLFRPLFAEKDMRILMVGLDAAGKTTILYKLELGEIATPLPTIGFSVETVEYKTISFTVWDVGGQDKIRPLWRHYFQNTQRLIFVVHSNDRERVVEASDDLHRMLNDDELRDAVLLAFAN

SEQ ID NO: 26130 - DNA, 795 bp, Panicum virgatum
  misc_feature: Ceres CLONE 1867908
  misc_feature: Encodes the peptide sequence at SEQ ID NO. 26131
aactcacacactcatcatcgctcatctttgctcactttgctcgagcgcttcacttccgatcctgagctctgccatcgctttgagagacacagagccaaacacatggcggctcagggaaggggcggtgctgctcgtggccgcagcggcgccgccgtggtggcgctggtcctcctctgcgtgctcctccacggcgaggtcgccgagtcggcggtgtacaccgtcggcgaccgcggcggctggagcttcaacaccgccagctggcccagcggcaagcgcttccgcgccggcgacgtgcttgtgttcaggtacagcccgaaggcgcacaacgtggtgcccgtgagcgcggccgggtacagctcgtgcgccgcgcccaggggcgccagggcgctcacctccggcaacgaccgcatcacgctgaagcgtggcgccaactacttcatctgcagcttccccggccactgccagtccggcatgaaggtggccgtcaccgccgcgtgaggcccggccgggatgatcggctgccggcgccgccggcgccgcctatagcttattaattttctcttcaaaaaaaaagagagaataaaacagtgtaattgaatagacggtgcgccctgctgctgttcgggtcatgctgtgtgcgtgtcgtcggctcgccgtgccgggtgttgctagttgttaaagatctggcaggttggcactgcagagatggatacattggagcaaatgtactagtgtccgtgttgatgtgaggagcaataaaagagtttatacggctgcgtttgtctgcgctgcatc

SEQ ID NO: 26131 - protein, 131 aa, Panicum virgatum
  misc_feature: Ceres CLONE 1867908
  misc_feature (46)..(124): Pfam Name: Cu_bind_like Pfam Description: Plastocyanin-like domain
MAAQGRGGAARGRSGAAVVALVLLCVLLHGEVAESAVYTVGDRGGWSFNTASWPSGKRFRAGDVLVFRYSPKAHNVVPVSAAGYSSCAAPRGARALTSGNDRITLKRGANYFICSFPGHCQSGMKVAVTAA

SEQ ID NO: 26132 - DNA, 618 bp, Panicum virgatum
  misc_feature: Ceres CLONE 1867912
  misc_feature: Encodes the peptide sequence at SEQ ID NO. 26133
tcgttaaaatcgagaagagaccaggccaaaggaaaatccatctaaaacctcgaagccatgggtctgcaggaggaatttgaggagtatgctgaaaaggcgaagaccttgcccgataacacgagcaatgagaacaagctgatcctctacgcactttacaagcaggccactgtcggaaatgtgaatacctctcgtcctggcatattacaccagagggacagggccaagtgggatgcatggaaggctgttgaaggaaaacccaaggaagaggcaatgagcgactacatcaccaaggtgaagcagctccaggaggaggctgcaagctcttaagtctctgaactgttgaatgaaacagctgctgtcagatgagctcctatgccatctgatgatgaaagctagatcatttgatccactggggatgtgaaacatgtacctatttatgtattgtttacctaagttttccatccatatccatctatctatctgcgaagactttaatcttctattttatgatatctgcctgtgtgatattgagttgcatagttcactgatttgcaaaccagtttgtttctgagacaaatctaagcaggcaaaataacagtacttaagtatgccgatgtc

SEQ ID NO: 26133 - protein, 89 aa, Panicum virgatum
  misc_feature: Ceres CLONE 1867912
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEYAEKAKTLPDNTSNENKLILYALYKQATVGNVNTSRPGILHQRDRAKWDAWKAVEGKPKEEAMSDYITKVKQLQEEAASS

SEQ ID NO: 26134 - DNA, 732 bp, Panicum virgatum
  misc_feature: Ceres CLONE 1867938
  misc_feature: Encodes the peptide sequence at SEQ ID NO. 26135
ctgaaattctagcgaatgtgaagttcatacaggagaaaaaactgattggaaagtattttgaagaaattagtcaagatacggggaagtatgtctttggtgttgatgatacattgaaggctcttgaaatgggtgctgtggagacacttatagtgtgggaaaaccttgatatcaacagatacgtgcttaagaacagtgcaactggagaaattattatcaaacatctgaacaaagagcaagaagctgaccagagccagttccgtgatccatctaccaatgctgagttggaggttcaggataagacctcgctcttggaatggtttgctaacgagtacaaaaagtttgggtgcacacttgagtttgttaccaacaaatctcaagagggttcacagttttgcagaggatttggtggcatcggtggcatgttgcgctatcaactggatatccgttcttttgatgagctttccgatgacgagggggtctatgaggactctgattaagcaatcaatccgtcacatgcctgtgctggaccttggaaggatgcaattgctacagtgttctaaattttgcttcagtgttgtagttttgaatactacttcagaagatgcatgtttcgtttcctctgcagcagcagcttacaattgcattgtgaaccacatcatatcaatccgttgatacctactgtcctgttgtgttgtagactatttatgacttgatttaaggtttgacttttaa

SEQ ID NO: 26135 - protein, 164 aa, Panicum virgatum
  misc_feature: Ceres CLONE 1867938
  misc_feature (8)..(145): Pfam Name: eRF1_3 Pfam Description: eRF1 domain 3
EILANVKFIQEKKLIGKYFEEISQDTGKYVFGVDDTLKALEMGAVETLIVWENLDINRYVLKNSATGEIIIKHLNKEQEADQSQFRDPSTNAELEVQDKTSLLEWFANEYKKFGCTLEFVTNKSQEGSQFCRGFGGIGGMLRYQLDIRSFDELSDDEGVYEDSD

SEQ ID NO: 26136 - DNA, 759 bp, Panicum virgatum
  misc_feature: Ceres CLONE 1867961
  misc_feature: Encodes the peptide sequence at SEQ ID NO. 26137
ctcgctcgctcgctcagatccggaagctttggggaaggagctgtgcgtcgtgcacgggatcggtatcgcgcagtggcagctggccgggtgactacgacgggagcgggatgggcctcctcgacaagctatgggacgacaccgtcgcggggccccgcccggacaccggcctcggccgcctccgcaagcagcccgtgcgccccgccgccgtgaagatcaatgatccggccggggacgcggcggccttcgtcccgccgtcgccggcgtcaggcagcgaggagacgccggtcaaggtgacgcgcagcatcatgatcaagcgccccgcggggtacccgtcgtcgccgaggagcgcggccagcacgccgccggcctcgccgcttgggaccaccccgcccatctcgccgttcgccagcgccggtggtcgcttcagaaggaaatcatcgtctgatgcttatgagagggcatccccaccagggacgaccagccccactcctcccttcgaagtgtgagcacgcaacatgctcacacacctttttgctcgttgacaagcatctacttcaccaaaggtgtaggggaggaggagagaggacatcaagaggggaacaggaataaaccacgggccgtcttacctctactgtgatatattgtagatgctgctatgctagtgtttttgcatccacagtgtggcttagtttgttgaatatgttgaaagctctttgtggtgtgccgtgtcaataagctgctgaagtgtgcatgtggcac

SEQ ID NO: 26137 - protein, 132 aa, Panicum virgatum
  misc_feature: Ceres CLONE 1867961
  misc_feature (7)..(129): Pfam Name: Auxin_repressed Pfam Description: Dormancy/auxin associated protein
MGLLDKLWDDTVAGPRPDTGLGRLRKQPVRPAAVKINDPAGDAAAFVPPSPASGSEETPVKVTRSIMIKRPAGYPSSPRSAASTPPASPLGTTPPISPFASAGGRFRRKSSSDAYERASPPGTTSPTPPFEV

SEQ ID NO: 26138 - DNA, 608 bp, Panicum virgatum
  misc_feature: Ceres CLONE 1867974
  misc_feature: Encodes the peptide sequence at SEQ ID NO. 26139
ctagaagccccctgcctccagcgcctccaccctcctcgccgcctctctccctctgagaccgcagatccttccagtgagaggaacccgcccgccgccatgtcgatcgctgagctcgcctgcacctacgccgccctcatcctcagcgatgacggcatcccgatcacggccgagaagatcgcgacggtcgtgaaggccgcgaacgtcaaggtggagtcttactggcccgcgctcttcgccaagctcctggagaagcgcagcgttgaggacctcatcctctccgttggatctggtggtggtgcggccccagttgctgctgctgcccctgctggtggtgctgcagcagcagctgccccggctgttgaggagaaggaagaggccaaggaggagtctgacgatgacatgggcttcagcctgttcgactgaggagaccccggcccagccattagcaaattcacttatgctgtccaagactatcttatcttatgtctctaggcttttgttacgagtactcaagttttgagtttttgagatgtgctatggctatgtgatgaaccgcaaaccatcttattagagtgaaacctgttcaatcttaaatggttcttgaggtc

SEQ ID NO: 26139 - protein, 108 aa, Panicum virgatum
  misc_feature: Ceres CLONE 1867974
  misc_feature (21)..(107): Pfam Name: Ribosomal_60s Pfam Description: 60s Acidic ribosomal protein
MSIAELACTYAALILSDDGIPITAEKIATVVKAANVKVESYWPALFAKLLEKRSVEDLILSVGSGGGAAPVAAAAPAGGAAAAAAPAVEEKEEAKEESDDDMGFSLFD

SEQ ID NO: 26140 - DNA, 709 bp, Panicum virgatum
  misc_feature: Ceres CLONE 1867976
  misc_feature: Encodes the peptide sequence at SEQ ID NO. 26141
acactgcattcatcactcacgtagaacacagaaccagatctgttaatccaggtgctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggtggccgggtacgtcgacgccggcaaggtgatgcggcgggtggcgcgccggacgggcaagcgggtggagccctggccctacgtgccgtacgacgtggtggcgcacccctacgcgcccggcgcctacgacaagaaggcgccgcccggctacgtgcgcaacgtcgtcgccgaccccgccgccgcgccgctcgcccgggcctcgtccaccgaggtcaggtacaccgccgccttcagcgacgagaaccccaacgccgcctgcgccgtcatgtagagctgcacgctgcctcgctcctgtagtagtaggagtagatggactaggaagttgctggtgtttcttggagcttttttttttttttttttactttagtatttctctacgcttgtgctctggttcgattcgctgtaaaaaaagaagatggttttgatttggaaatcctcagtggtagtaag

SEQ ID NO: 26141 - protein, 156 aa, Panicum virgatum; identical to SEQ ID NO: 18903
  misc_feature: Ceres CLONE 1867976
  misc_feature (29)..(91): Pfam Name: HMA Pfam Description: Heavy-metal-associated domain
  misc_feature: Useful for biocontainment applications

SEQ ID NO: 26142 - DNA, 704 bp, Panicum virgatum
  misc_feature: Ceres CLONE 1867990
  misc_feature: Encodes the peptide sequence at SEQ ID NO. 26143
aacccatactcaagcagctcaaaacctctatccagctaccaagaaatggctctacttgcttcagccctgatgagtcgcactacccatccaggccttattagaagccacataggacccaatggtgacaatttgtcatggcgcctaccttcaaaagagaagagtaagagaaggtgtgacccgagccttagatcacaagcagaaaggatgagcagcgagcttggacaagaacatctcatgccatcagaaaggatgggaagcgagcttggacaagaacatctcatgccacgggaaatccctaggagggactggttccaccccggattcgtctttggcgccgccactgcagcataccaagtattgtttctagcatggatgatgtatacgtctttgctaatcggaaggaaaatagtgctaagttttacttaatactaataactaagagaaaaaaatatggatacccaaaactctaaatgcaagttaagtgatatggtttgttttatatgcacaagaaattatttttatgttccatctatgtagattgaaggtgcttggaatgagcatgacaatttgtataacactataaactaaaatattgtttgttggccaatggtcaaattttaaatgtttgttgctgaagattcaaaacaatgtcatgttctttatcattcagtgaagtgctaattaattgacatgactatttatta

SEQ ID NO: 26143 - protein, 126 aa, Panicum virgatum
  misc_feature: Ceres CLONE 1867990
  misc_feature: SWISSPROT Homolog: EC 3.2.1.21 Beta-glucosidase
MALLASALMSRTTHPGLIRSHIGPNGDNLSWRLPSKEKSKRRCDPSLRSQAERMSSELGQEHLMPSERMGSELGQEHLMPREIPRRDWFHPGFVFGAATAAYQVLFLAWMMYTSLLIGRKIVLSFT

SEQ ID NO: 26144 - DNA, 735 bp, Panicum virgatum
  misc_feature: Ceres CLONE 1867991
  misc_feature: Encodes the peptide sequence at SEQ ID NO. 26145
ctcgctcgctccgtcgcccgcccgaagcaaagcaagggagttgagttgagttgagtcaccggttgcagccatgagtaagttgcaatccgaggttctcaaggatgccatctcccagattgttggggatgccaaagagaagaataggaagttcaccgagaccgttgagcctcagattggtctgaagaactatgacccgcagaaggacaagcgtttcagcggctctgttaagctccctcacatcccccgcccaaagatgaaggtgtgcatgcttggtgatgcccagcacgttgaggaggctgagaagattggacttgactacatggatgtcgaggcgctcaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctgtacatcaagagcaccatgggggagccatacagggtgttctaagtcttgccgcgatc

SEQ ID NO: 26145 - protein, 216 aa, Panicum virgatum
  misc_feature: Ceres CLONE 1867991
  misc_feature (8)..(212): Pfam Name: Ribosomal_L1 Pfam Description: Ribosomal protein L1p/L10e family
MSKLQSEVLKDAISQIVGDAKEKNRKFTETVEPQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGEPYRVF

SEQ ID NO: 26146 - DNA, 677 bp, Panicum virgatum
  misc_feature: Ceres CLONE 1868008
  misc_feature: Encodes the peptide sequence at SEQ ID NO. 26147
gaaactgctcaaccggaaaagcacacacaagccagccaaggcctccccaagttaaaatggaccaagccatggcgtccttgatcggcctctcgcagggggggctgcccagcaggcccccccccggcagggccagaacggccgtcgtcagggcgtcggccaagggcaaggccccggcacaggctggccgccccgcctggttcgggttggtggccaccggcttcgtcggcagcttcttcccccaggcggggcgcgccaataaggccgtcaaaaccatcaaaatcggccccccgccgcccccctctggggaacttcccggaaccttgaattcgaaccaggccaggaacttcaacctcgccttgaaggagcggttctacctgcagcccctgccaccagcgcaggcggcggcaagggccaagtcgtcagcccaggacatcctcaacctcaagccgttcatcaacaaaaaggcttggccgtacttcatgaacaacctccgcctccgggtttcctacctgcgctacaacctcaacaccgtcatcgcctcaaagcccaagaagaagaaaaaaagcctcaaggagctcaccggcaagctcttcagcaccatcaacaatcttgacattgcggcaaaaatcaaaaccaccccaaaggctaagaaatactatgcgccgactaattctgcc

SEQ ID NO: 26147 - protein, 206 aa, Panicum virgatum
  misc_feature: Ceres CLONE 1868008
  misc_feature (12)..(206): Pfam Name: PsbQ Pfam Description: Oxygen evolving enhancer protein 3 (PsbQ)
MDQAMASLIGLSQGGLPSRPPPGRARTAVVRASAKGKAPAQAGRPAWFGLVATGFVGSFFPQAGRANKAVKTIKIGPPPPPSGELPGTLNSNQARNFNLALKERFYLQPLPPAQAAARAKSSAQDILNLKPFINKKAWPYFMNNLRLRVSYLRYNLNTVIASKPKKKKKSLKELTGKLFSTINNLDIAAKIKTTPKAKKYYAPTNS

SEQ ID NO: 26148 - DNA, 926 bp, Panicum virgatum
  misc_feature: Ceres CLONE 1868009
  misc_feature: Encodes the peptide sequence at SEQ ID NO. 26149
gcagaagaacatacagaaaccagtgagccacccaccaatagtttccttccatccatggcatgcatcaacaccttccagagtcgctccattgccagaggggcaaagatcaacacaagagctaggggcagtgctggaaaaggatcaccaacctttcagtgcagggcgtcaactttcgttgacgccagcctccggcttgagctcaacgagaaccctgaggcaatcatctcaggtgagtggcctgagaacttctcccttctcagctacgatgatctccgtgcctaccttcagtcacaggagactgttcaagaaggagatcagcacgtagctctcttgaggaagaccatgtcaacacctgtgctagtggccacagcagagcagacgctggaggaggttgaatgccactttgaggtcgtctcagggcttccagtagtggacagcagcctaagatgtgttggggtggtcgtcaagaatgaccgggccaaagcttctcatgggccaaaaacaaagattgaagaagtaatgacctctccagccatcacactatcatcagataaaacagtgatggatgctgcggttcttatgctcaagaagaagattcacagactaccaattgtaaatcaggataagcaagtgataggtatagttacccgtgctgatgttcttcgcgagttggaaggactgctgaagatttagaagggcagcattccatgctccgaagtcataacttcttgtaaatatgtccatggcgcttttgagtggcagcaagcagatctataatctgcaggtatgcgctgtagaatcggcggaaataagccaggaagagtttgagatcttatccttgtaaaagtagcacgccaggaaacttcttctctgtgttgtactgcttgcgcaaccaaatgttgtaacaagtcaaatatttctagagc

SEQ ID NO: 26149 - protein, 212 aa, Panicum virgatum
  misc_feature: Ceres CLONE 1868009
  misc_feature (95)..(207): Pfam Name: CBS Pfam Description: CBS domain pair
  misc_feature: SWISSPROT Homolog: EC 1.1.1.205 IMP dehydrogenase
MACINTFQSRSIARGAKINTRARGSAGKGSPTFQCRASTFVDASLRLELNENPEAIISGEWPENFSLLSYDDLRAYLQSQETVQEGDQHVALLRKTMSTPVLVATAEQTLEEVECHFEVVSGLPVVDSSLRCVGVVVKNDRAKASHGPKTKIEEVMTSPAITLSSDKTVMDAAVLMLKKKIHRLPIVNQDKQVIGIVTRADVLRELEGLLKI

SEQ ID NO: 26150 - DNA, 680 bp, Panicum virgatum
  misc_feature: Ceres CLONE 1868051
  misc_feature: Encodes the peptide sequence at SEQ ID NO. 26151
agaccttcgtgcagtggagcgacaatccagtggtggtgctagcaaccagcggtagtggccggcgccatccgtctttgtacccgtctcgtcgcgcggctgttcaggccgcctcctcccgcccggacagcggcagcgatggccgaggcgaacggcgagcgccccgcgcagaagttgagcggcgtccgggacgcgccggcggggcgcgagaacgacctcgaggccatcgagctcgcgcgcttcgccatcgccgagcacaacagcaagaccaacgcgatgctggagttcgagaggctggtgaaggtgaggcagcaggtggtggccgggaccatgcaccacttcaccgtggaggtcaaggaggccggcgccgccaagaagctgtacgaggccaaggtgtgggagaaggtctgggagaacttcaagcagctccagagcttcgagcccgtcggggacgccgcggccgcctgaggcaaacgtaccatcttcccagtgtgatgtgtttttcccctgaaggctcaagcttgtcgccggaggctggagcagaacaatgaaaggatttagctatcagacatggatacaccacctcactggaggagtttatatgatgaataaaccagcttaccagatgtatcatatgtttttttaagtcctgcaatgaagtgcgctgtgctacaagcaatctg

SEQ ID NO: 26151 - protein, 109 aa, Panicum virgatum
  misc_feature: Ceres CLONE 1868051
  misc_feature (14)..(104): Pfam Name: Cystatin Pfam Description: Cystatin domain
MAEANGERPAQKLSGVRDAPAGRENDLEAIELARFAIAEHNSKTNAMLEFERLVKVRQQVVAGTMHHFTVEVKEAGAAKKLYEAKVWEKVWENFKQLQSFEPVGDAAAA

SEQ ID NO: 26152 - DNA, 739 bp, Panicum virgatum
  misc_feature: Ceres CLONE 1868053
  misc_feature: Encodes the peptide sequence at SEQ ID NO. 26153
  misc_feature (674)..(674): n is a, c, t, g, unknown, or other
aataaaattccacaaccaaaacacggacatcgacgccaacgccaacgcaccgtccccgcgcccaccggcgacaatgaatccgcccgcagcagccgcgtccaccggcggaggagaccgcgccgcggcagccccggagtacgcgccctacccgaggctctcgccggaggacgtggccccgccgccgcccccatcttaccatgccgccaccgccgcgccgcctccctacggcggcaacccctacgtctcctcccccgccggcggcaccgcgaccgcccccaagaatacgatggactcggtgaaggacgtgctcgggaagatggggaagagattcggcgaggcggcccggaagaccgagaacattaccggcaacttctggcagcacttgaaaactggcccaagcattactgatgcagcaatgggcaggatctcccaggtcaccaaagtcattgcagaaggtggatatgaaaaaattttccatcaaacctttgaggtcgctcctggtgaaaaactcaagaagccatttgcatgctatttgtcaacctcggctggacctgttatgggtgtgctttacctgtccaatgtaaaagtggccttctgcagtgataacccacttgcataccaggttggagacaaaacggagtggagctactacaaggtggtcattccccttgctncactgcgatcagttaactcctcgacaagcagaacaacacatcagagaaatacattcaggtggttt

SEQ ID NO: 26153 - protein, 221 aa, Panicum virgatum
  misc_feature: Ceres CLONE 1868053
  misc_feature (132)..(209): Pfam Name: GRAM Pfam Description: GRAM domain
  misc_feature (201)..(201): Xaa is any aa, unknown, or other
MNPPAAAASTGGGDRAAAAPEYAPYPRLSPEDVAPPPPPSYHAATAAPPPYGGNPYVSSPAGGTATAPKNTMDSVKDVLGKMGKRFGEAARKTENITGNFWQHLKTGPSITDAAMGRISQVTKVIAEGGYEKIFHQTFEVAPGEKLKKPFACYLSTSAGPVMGVLYLSNVKVAFCSDNPLAYQVGDKTEWSYYKVVIPLAXLRSVNSSTSRTTHQRNTFRW

SEQ ID NO: 26154 - DNA, 245 bp, Panicum virgatum
  misc_feature: Ceres CLONE 1868070
  misc_feature: Encodes the peptide sequence at SEQ ID NO. 26155
aaaatccatcattctgcaagcatactaatcaaatttcacagccatggtaatgctactacagcaactgcataagaacacttgacttacgttcaagttgcacacttgcacataatctcctctcctcttgcccggacacacaatcaataatggtggacccggtgatccacttctccgagctcgatggcaacgacagaggcgagaccatgaagcagatcggcaatgacaacaaggagtggggattcttt

SEQ ID NO: 26155 - protein, 32 aa, Panicum virgatum
  misc_feature: Ceres CLONE 1868070
  misc_feature: SWISSPROT Homolog: EC 1.14.17.4 Aminocyclopropanecarboxylate oxidase
MVDPVIHFSELDGNDRGETMKQIGNDNKEWGF

SEQ ID NO: 26156 - DNA, 2037 bp, Panicum virgatum
  misc_feature: Ceres CLONE 1868084
  misc_feature: Encodes the peptide sequence at SEQ ID NO. 26157
aaataggaagcgaattctcagtagccgaggagtggagagaaagagagcgggcggcgggagatgaggagcccgatttcggaacgcagcctcatcatcgagagctccgacgatgaggacacccactcagccgccgccgcggccaccatcgagaaaagacacgtccatgatgaggaggagcagggcgctggctcggactccgactcctcgtcgtcctcgtcctgcgccaccccacgccgcggcccctgttcccccagctccccctacgcccagcaatggccgcagagctacaggcaatcaattgacattcttagtagcgtgcagtcacccaatctcagttttttaggcactccaactctgagcagattgtccaactctttccttgctgtcaccgattcctttcggagcaaaacccctgaaatagtctctaactttatcaagccacttctgagccccactacaagcgatgagcagcagcaacacgaagatacccaaaagagttcccagtaccttctgccctcaagaaagctatctttgcaacaaatccccgaggatcagaaacaattggtagctggtcatgaagtgtctccttatcgaaactgctcttacacacagggagtgatgaatggaataaatgttctatgtggcgtgggaatcctatcaacaccttatgccattaaacaagggggttggattggacttgggatactcagtttattcgctttgcttgcatggtacactggcatgctcctgcgccattgcctggacagcaaggaaggccttgagacatacccagatattggccatgccgcctttggcagcaccggtcgcatagttatatcgataatcctgtatgtagaattgtatgcctgttgcatcgagtatttgatattggagagcgacaatttgtcaaaattgttccccactgcacatctgaccattgggagcttgacactgaactctcatgtattttttgcaatcttgactaccatcatagtaatgccaaccacctggctccgtgacctgagctgtctgagctatatttcagctggaggtgtcattgcatcgatccttgtggtcatctgcctgtcctgggtgggggttgttgatgatgttggctttgagaacaaagggactatgctgaacctcccaggaattcctattgcacttggattgtatggttactgctattcagggcatggggtgtttccaaacatctattcgtctctgaagaatcgcaatcagttcccttcaattctttttacttgcattgggctgtctactgttttatatgctggtgctgctgtgatgggatacaaaatgtttggagaagccacagagtctcagttcacgcttaacttaccagacaactcagtggtttcaaaggttgctgtttggacaacggtggcaaatccaataacaaaatatgcattaaccataatcccactggccatgagtttggaagagctgctgccatcaagtcaacagaagtactggagcattatcatgcttagatcagccttggtggtgtcaaccctgctgattgctttatctgtgccattctttggacttgtgatggccttggtgggttccttattcgccatgcttgtgacctatattttgccttgcgcgtgttatttggcaatccttaagacaaaagtggggtggcatcagatagcagcttgttcgttcatcatcattgtcggggtttgctgcgcttgcttggggacatactcatccctgtccaagataatccagaactacacataatacagttcctatgatcctttatatacagctgcccagcagtactgtgtgctatatgaaccaaagatatacaaggtggaaagtttcccagcaattgagtcgtgtatattaaatatgtggcatgctgtacttcgtgggtcaacagtatgtagtatgggcttgaggttgtatcatgcggaagtaacagtattctttatggcgcagacaaaaaacaagtttgagttgtcttgtagtttttatgatttgattctatcaatatatgttcttctggtt

SEQ ID NO: 26157 - protein, 568 aa, Panicum virgatum
  misc_feature: Ceres CLONE 1868084
  misc_feature (178)..(561): Pfam Name: Aa_trans Pfam Description: Transmembrane amino acid transporter protein
MRSPISERSLIIESSDDEDTHSAAAAATIEKRHVHDEEEQGAGSDSDSSSSSSCATPRRGPCSPSSPYAQQWPQSYRQSIDILSSVQSPNLSFLGTPTLSRLSNSFLAVTDSFRSKTPEIVSNFIKPLLSPTTSDEQQQHEDTQKSSQYLLPSRKLSLQQIPEDQKQLVAGHEVSPYRNCSYTQGVMNGINVLCGVGILSTPYAIKQGGWIGLGILSLFALLAWYTGMLLRHCLDSKEGLETYPDIGHAAFGSTGRIVISIILYVELYACCIEYLILESDNLSKLFPTAHLTIGSLTLNSHVFFAILTTIIVMPTTWLRDLSCLSYISAGGVIASILVVICLSWVGVVDDVGFENKGTMLNLPGIPIALGLYGYCYSGHGVFPNIYSSLKNRNQFPSILFTCIGLSTVLYAGAAVMGYKMFGEATESQFTLNLPDNSVVSKVAVWTTVANPITKYALTIIPLAMSLEELLPSSQQKYWSIIMLRSALVVSTLLIALSVPFFGLVMALVGSLFAMLVTYILPCACYLAILKTKVGWHQIAACSFIIIVGVCCACLGTYSSLSKIIQNYT

SEQ ID NO: 26158 - DNA, 707 bp, Panicum virgatum
  misc_feature: Ceres CLONE 1868085
  misc_feature: Encodes the peptide sequence at SEQ ID NO. 26159
aatagttcaaagctttctgctagcatgattgatccctaatggaagaagagtcctgagctctggccacctcgctatgcaagcaagctactcgcataaagtccaagagagacgcggcgcggcacatggcgcccatcatcaacaccaaccaacaccacggcgacgcacaccgctgctccagtctagaatcttcccctcgacctcaccctccacctttcccgcgcctccgctctagcttcgttgcccgggttttcgttcgatcattcgcgccatggacgccgccacctcggtgcagcgacggcggtggctgccgtgggcgcggcgccgtacctggcggcggccgggggaggcggcggcgacgggctggcggcgtcggcggtgtccgcggcgcgggtcgtggcgtgcttcctggccgtgatggtgagcacggcggtgtgggcggtggtgatgctgctgctcctgccgcggccctgcgagcgcatccgccagagcaacgcctacggccacgtcaccgggcgcatgctgctgtggatcctggggaacccaatcaaagtggaaggcttggagcacctccgcgcgaggggaatcttcatctgcaaccacgcctcgccgctggacatcttcctcgtcatgtggctcgcccccaccggcaccgtcgggatcgccaagaaggagatcatctggtacccgctgttcgggcagctctacgt

SEQ ID NO: 26159 - protein, 97 aa, Panicum virgatum
  misc_feature: Ceres CLONE 1868085
  misc_feature: SWISSPROT Homolog: EC 2.3.1.51 1-acylglycerol-3-phosphate O-acyltransferase
MVSTAVWAVVMLLLLPRPCERIRQSNAYGHVTGRMLLWILGNPIKVEGLEHLRARGIFICNHASPLDIFLVMWLAPTGTVGIAKKEIIWYPLFGQLY

SEQ ID NO: 26160 - DNA, 1572 bp, Panicum virgatum
  misc_feature: Ceres CLONE 1868089
  misc_feature: Encodes the peptide sequence at SEQ ID NO. 26161
gtacagcccaaggcgccaagcgaagcgaagcgaagcgagcaacagggagtcgcacggcagcattgcacgagccctagcttggagctaaggccgcgccgtacaccaaagcccttgcttgctctctctcgccgttgccggctcctcttcgcttgcggcgaagaagcttaatccctccgcgaaagaacgaccgcaccggcagcgcgctactaccaactagctagctagctcgacagcggcaatggaggtcaaggtgctgagctccaagctcgtcaggcccgcctacaatgccggcgcggccccggcggcgggcgagtacatcccgctgtccgtcttcgaccgggtgacgtacaacatgcagatggccatcatctacgcgttcccgccgccggcgccgtccacggcggccgtcgagagggggctcgccgcggtgctggccgagtaccgcgccttcgcggggcagctgggcgaggcccccgacggcaccccggccgtgctgctcaacgaccgcggcgcgcgcttcgtggaggcggccgtggacgccgacctcgtggacatggcgcccgccaagcccaccccggagctgctgcgcctgcacccggacctcgagggggacctcccggaggtggtgcgcctgcagctcaccaggttccgctgcggctccctcgccgtgggcttcacgtccaaccacgtcgccgcggacggccacgccaccagcaacttcctcgtcgcgtggggccgcgccaccaggggcctccccacggggctgccccccgtgcaccaccaggcggggctcttcaagccgcgcgcctcgccccgcgtcgagttcgaccaccgcagcagggagtaccgcctgccgtcgcccgccgacgccgacgagcagctgcacggccacggcggggagggcggcgccgccgagaacatcgtgatccacaaggcgcacttcaccaaggacttcatcgcagcgctgcgcggcaaggcctcggagggccgcggccgcccgttcagccggttcgagacgatcctggcccacctgtggcgcaccatgacgcgcgcccgcgggctgagccccgaggagacctcgcagatccgtctctccgtggacgggcggcaccggctgggcctccccgcggagtacttcggcaacctggtcctgtgggcgttcccgacggcgacggtggcggacctcctggggcggccgctgaggcacgcggcgcaggtgatccacgacgaggtggcccgcgtggacggcggctacttccggtcgttcgtggacttcgcgagctccggcgcggcggagcgggagggcctggcgccgagcgcggtgtgcagggacgtgctgtgcccgaacgtggaggtggacagctggctgacgttcccgttctacgagctcgacttcgggacggggagcccgacctacttcatgccgtcctacttcccgacggaggggatgctgttcctggtgccgtcctacatcggcgacggcagcgtcgacgccttcgtccccgtcttccagcacaacctcgaggccttcaaggagtgctgctacgccatggagtaggaggagatcgaggg

SEQ ID NO: 26161 - protein, 439 aa, Panicum virgatum
  misc_feature: Ceres CLONE 1868089
  misc_feature (1)..(438): Pfam Name: Transferase Pfam Description: Transferase family
  misc_feature: SWISSPROT Homolog: EC 2.3.1.144 Anthranilate N-benzoyltransferase
MEVKVLSSKLVRPAYNAGAAPAAGEYIPLSVFDRVTYNMQMAIIYAFPPPAPSTAAVERGLAAVLAEYRAFAGQLGEAPDGTPAVLLNDRGARFVEAAVDADLVDMAPAKPTPELLRLHPDLEGDLPEVVRLQLTRFRCGSLAVGFTSNHVAADGHATSNFLVAWGRATRGLPTGLPPVHHQAGLFKPRASPRVEFDHRSREYRLPSPADADEQLHGHGGEGGAAENIVIHKAHFTKDFIAALRGKASEGRGRPFSRFETILAHLWRTMTRARGLSPEETSQIRLSVDGRHRLGLPAEYFGNLVLWAFPTATVADLLGRPLRHAAQVIHDEVARVDGGYFRSFVDFASSGAAEREGLAPSAVCRDVLCPNVEVDSWLTFPFYELDFGTGSPTYFMPSYFPTEGMLFLVPSYIGDGSVDAFVPVFQHNLEAFKECCYAME

SEQ ID NO: 26162 - DNA, 1435 bp, Panicum virgatum
  misc_feature: Ceres CLONE 1868093
  misc_feature: Encodes the peptide sequence at SEQ ID NO. 26163
gcgtgacatcgtcagcgtgaacgcgtctccgagcacgaccggccggcgccgccgtacgcccctcccaggcgcggccgcctctcgccggctccttcgtcgcctactcctccgcagcattagcggcgattaattagcggagaagggcgcgaatgcagccgccgccgccgccgctgccgcagccgctgggagcaatggccaccggcgccgccaccctcaccgtcccgtgctccgtgggccgccgcccgaagcggagcagccagcgccgcggctccggctcagcctccgtctccgtccgtgcgtcctcggacgcaaacacggtgacgctgctggactacggcgcggggaacgtgcgcagcgtgcgcaacgccatccgccacctcggcttcggcatccgcgacgtgcggagcccggaggacatcctcgccgccgaccgcctcgttttccctggcgtcggcgccttcggctccgccatggacgtcctcaatagcactggcatggccgacgcgctccgcgagtacatccaaagggaccgccccttcctaggcatctgcctcggcctccagctgctcttcgactccagcgaggagaacggaccggtgagcggtcttggtgtgataccgggcgtgatcagacgattcgactcctccaagggcctcatagttcctcacattggctggaacgctcttgagatcaccaaggacacacagctgctgcagggagctgatggccaccatgtttacttcgttcactcctaccacgcactgccttcagatgctaacagagactggatttcatcaatatgcaactacggggacagcttcatatcatccatctcaatgggaaacattcaggcagttcagtttcacccagaaaagagcggagatactggactttctattttaaaaaaatttctcagtgctaatccttcaggaacaaaggtcccagcacgtaggaaagcatcaaaacttgcaaagagagtgatagcatgccttgatgttcggtcaaatgataatgggtatcttgtggtaacaaaaggtgatcagtatgatgtaagagatcatactagcagcaaagaggtaagaaaccttggcaagccagtcgatttagcaagtcaatactacatagatggtgctgatgaggtcagcttcttgaatataactggtttccgtgactttccattgggtgatttgccaatgctagaggtactgcgttgtgcatctgaaaaggtttttgtgccacttacagttggtggaggtatacgagacttcacagatgcaaacggaagatactattcaagcttggaggtagcatcagaatatttcaggtctggtgcagacaaaatttcaattggaagtgatgctgtttatgctgctgaagcctttttacaaaccggtgtaaagacagggaaaagcagcttggagcagatttctagagt

SEQ ID NO: 26163 - protein, 414 aa, Panicum virgatum
  misc_feature: Ceres CLONE 1868093
  misc_feature (44)..(243): Pfam Name: GATase Pfam Description: Glutamine amidotransferase class-I
  misc_feature (262)..(413): Pfam Name: His_biosynth Pfam Description: Histidine biosynthesis protein
  misc_feature: SWISSPROT Homolog: EC 5.3.1.16 1-(5-phosphoribosyl)-5-((5- phosphoribosylamino)methylideneamino)imidazole-4-carboxamide isomerase
MATGAATLTVPCSVGRRPKRSSQRRGSGSASVSVRASSDANTVTLLDYGAGNVRSVRNAIRHLGFGIRDVRSPEDILAADRLVFPGVGAFGSAMDVLNSTGMADALREYIQRDRPFLGICLGLQLLFDSSEENGPVSGLGVIPGVIRRFDSSKGLIVPHIGWNALEITKDTQLLQGADGHHVYFVHSYHALPSDANRDWISSICNYGDSFISSISMGNIQAVQFHPEKSGDTGLSILKKFLSANPSGTKVPARRKASKLAKRVIACLDVRSNDNGYLVVTKGDQYDVRDHTSSKEVRNLGKPVDLASQYYIDGADEVSFLNITGFRDFPLGDLPMLEVLRCASEKVFVPLTVGGGIRDFTDANGRYYSSLEVASEYFRSGADKISIGSDAVYAAEAFLQTGVKTGKSSLEQISR

SEQ ID NO: 26164 - DNA, 639 bp, Panicum virgatum
  misc_feature: Ceres CLONE 1868093-R
  misc_feature: Encodes the peptide sequence at SEQ ID NO. 26165
caaccaggctgtagttgtaagtattgatcctcgacgggtatatgtcaatagtccagaagatgtgccatttaaaactgtgaaggtgtccagtaaaggtccatcaggagaagaatacgcatggtaccagtgtacagtgagtggtggacgtgatagccgacctataggagcatatgaactagcaaaagctgtggaagaattgggtgctggagaaatactacttaactgcattgattgtgatggccagggctgtggatttgacatagatttggtcaaaatggtgtctgatgctgtgacaattcctgtcattgcaagcagtggtgctggtgctgttgaacatttttccgaagtctttgagaaaacaaatgcttcggctgcccttgctgctggcattttccatcggaaagaggtccccatactagccgtgaaagagcatctggtggatgctggtgtcgaggtcagggtgtagcaggaaaatctttgttattgttgaaaaattcctgtctgatcttgtctgatgtagtgaatgttgcaactactctctgttctgtttctggaacatgttgggcgcagtgcctaggcccctgatgggaaactgcaatttcgtaataagttaataaggcgatgctgaacggcttaagc

SEQ ID NO: 26165 - protein, 154 aa, Panicum virgatum
  misc_feature: Ceres CLONE 1868093-R
  misc_feature (1)..(137): Pfam Name: His_biosynth Pfam Description: Histidine biosynthesis protein
  misc_feature: SWISSPROT Homolog: EC 5.3.1.16 1-(5-phosphoribosyl)-5-((5- phosphoribosylamino)methylideneamino)imidazole-4-carboxamide isomerase
NQAVVVSIDPRRVYVNSPEDVPFKTVKVSSKGPSGEEYAWYQCTVSGGRDSRPIGAYELAKAVEELGAGEILLNCIDCDGQGCGFDIDLVKMVSDAVTIPVIASSGAGAVEHFSEVFEKTNASAALAAGIFHRKEVPILAVKEHLVDAGVEVRV

SEQ ID NO: 26166 - DNA, 698 bp, Panicum virgatum
  misc_feature: Ceres CLONE 1868100
  misc_feature: Encodes the peptide sequence at SEQ ID NO. 26167
  misc_feature (634)..(634): n is a, c, t, g, unknown, or other
catagggagtaaaaattactatgacatcaggaaaccatgtgttggaagcctgtgctatgatttctcaaatttggagaaatttctgaataaaaaaactgttagagagagccttggagttggagacatagagttcgtttcatgcagcccgagtgtctatgaggccatgttattagattggatgaggaaccttgaagttggaatccctgaactccttgagaatgacatcaaagtgttgatttatgcgggagagtatgatctcatatgcaactggctcgggaactcgagatgggtaaactctatggaatggtctggaaaggaagcttttgtctcatcgtctgataagcccttcactgtcgatggaaaagaagccggtgttctaaagagccatggtcctttgagtttcttgaaggtgcatgatgctagtcacatggtaccgatggatcaaccgaaggctgctctggagatgctgaagaggtggacttccggaaacctttcgagcccgtcttcagtctcccagaagcttgatttcgatatgtgaccaacaaactgtttctcctatgatccttcggggtttgcaacgctgccctgcactagtctccgaagactaccgtatgtaatttactgtgtacttcangatgatattgggctctgacaagcttatcttgcgaccgtacagatgttatttgccttgtacgggc

SEQ ID NO: 26167 - protein, 178 aa, Panicum virgatum
  misc_feature: Ceres CLONE 1868100
  misc_feature (1)..(162): Pfam Name: Peptidase_S10 Pfam Description: Serine carboxypeptidase
  misc_feature: SWISSPROT Homolog: EC 3.4.16.5 Carboxypeptidase C
IGSKNYYDIRKPCVGSLCYDFSNLEKFLNKKTVRESLGVGDIEFVSCSPSVYEAMLLDWMRNLEVGIPELLENDIKVLIYAGEYDLICNWLGNSRWVNSMEWSGKEAFVSSSDKPFTVDGKEAGVLKSHGPLSFLKVHDASHMVPMDQPKAALEMLKRWTSGNLSSPSSVSQKLDFDM

SEQ ID NO: 26168 - DNA, 1390 bp, Panicum virgatum
  misc_feature: Ceres CLONE 1868101
  misc_feature: Encodes the peptide sequence at SEQ ID NO. 26169
acttttggggacctctaggcctctcaaatccagagaaccaaaaaggagagagagagagagagagagagaccgagaaaaggttccctcctcctcagccttgcgctcacccccgtcctcccacatccgattgttctctacgcttcttggatcctagatttggtcgaccggcggcggcggttccgggagctgggaaagactggatttttctgcccatggaggcgtggcctgatccgttcaggcccgggcgctggagtggctccctgaccaggtccgagtcgtattggttcaaatgatctgggcagcctgattggttggttggttggttccgccagggggatcggagctagggtgtgggttcttggctgtctgggcggtgggttcgtcagcttgggtctggtgagatcttggggttgttggttcagctcaggagccgcaggtctgcgtagatcccttctttgcttccgtggctgatttgtactgctagggttttggttgcctgttgtggaagatgattaagcagattcttggccggctgccgaggaagccagggaaggctggggatagccgggatgctgctgctggggtggctgcggggaacggtacagagccgtcgaattcttacagtgttgccaggagcgtggactcggggaacaagagggctggaaatggggattactcagtgccacctggggtaactcctaacccggtgatgaatggggctgtgctgtatcactccaatgagccgctgccagccttcaaggatgtggcagcgtccgagaagcagaatttgtttgtcaagaaggtgaacctgtgctgcgccgtgtatgacttcatggatccgacaaagaacctgaaggaaaaggaggtgaagcgccagacacttatggagctggtcgattacgtcacttcagcaaatggcaagttctcggaggtcgtcatgcaggagatcaccaagatggtgtcgattaacttgttccggagctccaaccccgcgccccgtgagaacaaggccattgagggagttgatctggaggaggacgagcccctcatggaccctgcatggtcgcacttgcagattgtgtatgaggttttcttgaggtttgttgcatcgcaggagacagatgcaaagctcgccaagagatacatagatcattccttcattcttaggctactagatctttttgactcagaggaccccagggaaagggactatctaaagacaatacttcacagaatatatggtaaattcatggttcatcgcccattcatcaggaaagcaattaacaacatattctacaggttcatatttgaaacagaaaagcacaatggtattgcagagctgttggagatcctgggcagtattattaatggttttgcccttcctcttaag

SEQ ID NO: 26169 - protein, 293 aa, Panicum virgatum
  misc_feature: Ceres CLONE 1868101
  misc_feature (79)..(293): Pfam Name: B56 Pfam Description: Protein phosphatase 2A regulatory B subunit (B56 family)
MIKQILGRLPRKPGKAGDSRDAAAGVAAGNGTEPSNSYSVARSVDSGNKRAGNGDYSVPPGVTPNPVMNGAVLYHSNEPLPAFKDVAASEKQNLFVKKVNLCCAVYDFMDPTKNLKEKEVKRQTLMELVDYVTSANGKFSEVVMQEITKMVSINLFRSSNPAPRENKAIEGVDLEEDEPLMDPAWSHLQIVYEVFLRFVASQETDAKLAKRYIDHSFILRLLDLFDSEDPRERDYLKTILHRIYGKFMVHRPFIRKAINNIFYRFIFETEKHNGIAELLEILGSIINGFALPL

SEQ ID NO: 26170 - DNA, 317 bp, Panicum virgatum
  misc_feature: Ceres CLONE 1868101-R
aggttctcagtaaccttgtcaagaatagcttgcttagaggagttgtaagtatcatcgcccatattatataggtggctaccacgatacggttagtcgctccgaagatgctgtgagtatagaatgcttttacaaaactgggagcgatttatggttctacatatgtggggcgcttgcttgcttacataatctcttttcctagagttgtaggggtttctgttgctcccaaaatccagcatgaaaggacagaaaagacatactcatgtatacataagatggcttggaagcagcatagaagtggtggctgaagtgttttgtcc

SEQ ID NO: 26171 - DNA, 763 bp, Panicum virgatum
  misc_feature: Ceres CLONE 1868136
  misc_feature: Encodes the peptide sequence at SEQ ID NO. 26172
acgagcgccagccagtcacctaccccgaagccgccgcgaccgatcgagccgagcgccccgccccacgccgcgccgcgccgcgccgcgccgcaccgaaaccctagctccttctcctcagccatggccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgccgcggcgtggtcagactgccccgccgccgccgcctccgcggcggcggaggtcagcgcaatccccaacgctaaggttgcgcagccatccgccgtcgtacaggccgagcgtaacctgctcggctccgacgccagccttgccgtccacgcgggcgagaggctgggaagaaggatcgccacggatgcgatcaccacgccagtagtgaacacgtcggcctactggttcaacaactcgcaagagctaatcgatttcaaggaggggaggcatgctagcttcgagtacgggaggtatgggaacccgaccacggaggcattggagaagaagatgagtgcactggagaaagctgaatccactgtgtttgtggcgtcggggatgtatgcagctgtcgctatgctcagtgcacttgtcccagctggtgggcacattgtgaccaccactgattgctacccgcagacaagaatttacatggaaaatgagctcccta

SEQ ID NO: 26172 - protein, 214 aa, Panicum virgatum
  misc_feature: Ceres CLONE 1868136
  misc_feature (97)..(214): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAAAASAAAEVSAIPNAKVAQPSAVVQAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYPQTRIYMENELP

SEQ ID NO: 26173 - DNA, 763 bp, Panicum virgatum
  misc_feature: Ceres CLONE 1868140
  misc_feature: Encodes the peptide sequence at SEQ ID NO. 26174
atgtctatgcaaccaatcaaccaagggaagcaaatgcacatggccagcagctccggccaccgctctccgcggcgcaccgccgcgacggcgctgctcctcgccaccgccggcctcctcctcctggcgccgccaccggcacgcgggtcgtcgtcgcctgagcagcagcagcagaatgccgaccgcatcctggggctgccggggcagcccaacggtgtggcgttcgacatgtacggcggctacgtcaccgtcgacgagcaggccggccgcgcgctctactactggttccaggaggccgaccagccggaggcagcgccgctcctcctgtggctgaacggcgggcccgggtgctcctccatcggtggcggcgcgctggaggagctcggcgcgttccgcgtccacaccgacggccagacgctcctgctcaacgagtacgcatggaacaaagcggcgaacgtgctcttcttggagtcgccggccggcgtggggttctcttacagcaacaccagctccgacctcgtcgtcggcgacgacagaacggctcaggacgcgtacattttcctggtgaaatggttcgagagatttcctcagtacaagtaccgtgatttctacattgcgggagagagctacgcaggtcactatgttccacagctgtcccagcttgtgtacaagaacaacatcggtgtagagaagcctgatatcaacttcaaaggattcatggtcggaaacggtgtgaccgacgaccgcatcgacactatcggcatgt

SEQ ID NO: 26174 - protein, 241 aa, Panicum virgatum
  misc_feature: Ceres CLONE 1868140
  misc_feature (53)..(241): Pfam Name: Peptidase_S10 Pfam Description: Serine carboxypeptidase
  misc_feature: SWISSPROT Homolog: EC 3.4.16.6 Carboxypeptidase D
MASSSGHRSPRRTAATALLLATAGLLLLAPPPARGSSSPEQQQQNADRILGLPGQPNGVAFDMYGGYVTVDEQAGRALYYWFQEADQPEAAPLLLWLNGGPGCSSIGGGALEELGAFRVHTDGQTLLLNEYAWNKAANVLFLESPAGVGFSYSNTSSDLVVGDDRTAQDAYIFLVKWFERFPQYKYRDFYIAGESYAGHYVPQLSQLVYKNNIGVEKPDINFKGFMVGNGVTDDRIDTIGM

SEQ ID NO: 26175 - DNA, 1295 bp, Panicum virgatum
  misc_feature: Ceres CLONE 1868162
  misc_feature: Encodes the peptide sequence at SEQ ID NO. 26176
attggtttcggttcggttgggagctcgcggtccggaggaggaggaagacgaggaggaggagggcgggggcgcaatggtggaggtggggagccgggtgcaggggttcctgcggaaccggtggctggtgttcgtggcggcgatgtggatgcagtcctgcgcgggggtggggtacctcttcggcagcctctcgccggtgatcaagagctcgctggggtacaaccagcgccaggtggccgggctcggcgtcgccaaggacctcggcgacagcgtcggcttcctcgcggggacgctctgcgcgctgctcccgctctgggccgcgctcctcgtcggcgccgcgcagaacctcctcggttacggatgggtctggctcaccgtcacgcgacgggtccccgtgccaccgctctgggcgatgtgcattctaatcttcattggcaacaatggtgagacatacttcaacacggctgcactcgtctcctgtgttcagaacttccccaagagccgtggaccaattgttggtatcctcaagggatttgctgggttaagtggtgcaattctgacacagatctatgcaatgatacactcgcctgatgatgctgcactgatcttcatggttgccgttggcccaacaatggtagttatagctttaatgttcattgtaagaccagttggaggacacaggcaagtacggccttctgatggcacaagtttcacatttgtatacagcgtctgcttgctcttggccgcttatctgatgggcgtcatgctacttgaagaccttgtcgacctaagccagtcaatgattaccttgttgaccatcattctaatcatctttttattagttccaatagtcatcccagtgctactcagcttcttttcagatgatgatgagactttgtatgcactattactgccatcacctcggaaagaagaaccaagtgcatcaacatcatctgaggagcaacaggaggttatactcagtgaattggaggatgaaaagccaagggatattgatcttctttcagcctcagagaggcaaaaaaggattgcagcattgcaggcaaggctgtttcaggcagctgctgttggtgcagtgagggttaagaggaggagaggtccacgacgaggtgaagatttcacactgatgcaagcgctgatcaaggcagatttttggcttctatttttctcccttttattgggctctgggtcagatctcactgtgattgataatcttgggcaaatgagcccatcattgggttacaaggaaacccacatttttgtgtcgatgattagcattt

SEQ ID NO: 26176 - protein, 407 aa, Panicum virgatum
  misc_feature: Ceres CLONE 1868162
  misc_feature (15)..(262): Pfam Name: Nodulin-like Pfam Description: Nodulin-like
MVEVGSRVQGFLRNRWLVFVAAMWMQSCAGVGYLFGSLSPVIKSSLGYNQRQVAGLGVAKDLGDSVGFLAGTLCALLPLWAALLVGAAQNLLGYGWVWLTVTRRVPVPPLWAMCILIFIGNNGETYFNTAALVSCVQNFPKSRGPIVGILKGFAGLSGAILTQIYAMIHSPDDAALIFMVAVGPTMVVIALMFIVRPVGGHRQVRPSDGTSFTFVYSVCLLLAAYLMGVMLLEDLVDLSQSMITLLTIILIIFLLVPIVIPVLLSFFSDDDETLYALLLPSPRKEEPSASTSSEEQQEVILSELEDEKPRDIDLLSASERQKRIAALQARLFQAAAVGAVRVKRRRGPRRGEDFTLMQALIKADFWLLFFSLLLGSGSDLTVIDNLGQMSPSLGYKETHIFVSMISI

SEQ ID NO: 26177 - DNA, 488 bp, Panicum virgatum
  misc_feature: Ceres CLONE 1868162-R
cgtccctgatcatgtccgggttctgcatcattgctgttgttttgagcttgatcctggtctaccggacaaagattgtatacacaaatctatacgggaagccgcgtacttgaaagatcaattcttaaaggccagagggcatgatgtagtttcagtctttcagagttatcaaagcttcagttttgaattcaggctatggtaccccggcatgcctggtgttggccttcaacttgttctggaccaagttctttggagggcagaactggagcttgacgttcattagaaagtgctgccgatgagcctggaagtcttggagtggcagaagctgatcccaagcagcattcaagttaatggttgaattgtgccttttgcttgaattttgctatatttagtgggaaaatattgtatacacatgtaataagctggatgtctttctatgttccctcacacagggaaaggcatatactttcctattagttaaaaaaaattct

SEQ ID NO: 26178 - DNA, 459 bp, Panicum virgatum
  misc_feature: Ceres CLONE 1868163
  misc_feature: Encodes the peptide sequence at SEQ ID NO. 26179
agccgtggtgctcccctgagctcctcatcccaaacaccaccaccacagccatctcttcttccccaacgccgccaccgccgccgccgcaaccccaatccaaagcccacaaacacaacaccgtctccggcgaggtctgagcgaggtaggtttagttctgagcgacttcttgcgtcctcctggtaaacaaacccctctcggtctcatcagtcttcaccagtttgttcttcttcttgtccccacagcagagatccagagccttttagttcctgatctctgatcctttttttccctttttctgtggaatagtttgcagtagttagcaaggagaggttctttttccacacctctttgtgcttctttgtccattaataggtagatctgtgtagagcaaccatactagtcctgcctgttctttgattttagctaagaacaaggctatttattctttcttttttcccc

SEQ ID NO: 26179 - protein, 44 aa, Panicum virgatum
  misc_feature: Ceres CLONE 1868163
  misc_feature: The sequence is a functional homolog of SEQ ID NO 1020 in the 10/412,699 US patent application
  misc_feature: The sequence is a functional homolog of SEQ ID NO 525 in the 10/374,780 US patent application
  misc_feature: The sequence is a functional homolog of SEQ ID NO 467 in the 10/374,780 US patent application
PWCSPELLIPNTTTTAISSSPTPPPPPPQPQSKAHKHNTVSGEV

SEQ ID NO: 26180 - DNA, 2896 bp, Panicum virgatum
  misc_feature: Ceres CLONE 1868166
  misc_feature: Encodes the peptide sequence at SEQ ID NO. 26181
agcgctcacatttctctgcgatccttcttttcacaagcgaatcgaaaagaaggggaagaaagaaagcgcctttttttatgaaaggaatctgacggcgatttgcgagggcacaaagctgctcgtagcatttcgcgacccacgagtgctgtctttccagtctccactcccgaatccgctgctcgtccaggaaagatcctcgccaaatccgaggcggcatcaggttactcttgtccgccactagcgccggggacggaatgtggcttcgcggcgcctgtagatcagctccgcccaattcgccgcgcccctggtggtggttcggcttcccgcttccctcttcctcccaccgtggcgtcgccgagcagatgacaaggtgctagtcggctcggctctgctcgaaccatttcgtttcctccccgtcggacgcttcgtcgaacagttggtgtgcggccaccggagcagcaggagcgcttggcgaaatggacggatcaaaggtcgtcaagaacgcgacactttcttcctggtcctcggagatgggctatgcttacttcgccgccatgcttctgtgtggcttcatggtcgccagtggaaccacggcagctaaccagaatagcaccggtgaccccgcaaggccggcagaggtgcgcatcggtgcgctgttcacgtttgactcagttattggaaaggcggtgaggcccgctattgagctcgctgtcgagcatgtcaattctgatcctagtatactccgggggacgaaactcagtgttcttatgcaggacaccaactgcagtggatttattggcaccatagaagcgttgcagcttctggctaaagatgtaatcgcagtattaggtccacaatcctcggctgttgctcatgtcatttcccacgctgtcaatgaactccatgtccctcttatctctttcgcagccactgatcctaccctttcttcccttgaatacccttattttgtgaggtctacacaaagtgattactaccaaatggatgctatcgctagcatcattagccagtatcaatggaaacaggtcatcgccatacatgttgatgatgactatggtagaggtggcatcatggcactaggtgatgcccttgcaaaaagaaagtgtaagatagtctacaaagctaagttaccgcctggtgctgcaaatactacaatcgagaatatcttgatgcaggttaatgaaatggaatcgcgtgtctatgttatccacgttaaccctgattctggtcttaacgtgttctcagctgcaaaatctttggggatgatgagcagtggctatgtatggatagcaacagactggctgtctgcagtgatggattcatctgtgcatggtactactgatgtgatggaacttacacagggagttctcgtgcttaggcagcatgtttctcattctgacattcaaaaagcattgttgtccaagtggaatcttaccaggaatggaagtgcttactctatgcgtgcttatgactctgtatggttagttgctcatgctgctgagcgccttttgagtgaagggaatacaatatccttttctgcagacacaaatctgcgagctacaaaaggaagtaaccttcagttagattctctcaggattttcaataatggaaataaactactggagaacgtgtggaatgtgaacttctcaggggtttctggtccagttcaatttaccttggatcggaatttaatccacccagcttatgatattctgaacattggtggtacaggtttaagaaccattggatattggtcaaatatttctggtctctcagtcgttgccccagaaaacttatattcttcagcattgaactcttcaaccaacaatgtacagctccatagtgttatatggcctggtcagattactgagaagcctcgtggttgggagttttcatatcatgggaagcctatgaggattggagtacctctccgaacaagctacaaagagtttgttacacaagacaatggacctgatggagtaaaggggtttgcagttgatgtctttaaagctgcaataagcttgttgccctatccagtttcttgcaattttgttttatttggagacggtttgaagaatcctagctatagtgaccttgtccagaaggtttctgaaaattacttcgacgccgcaataggggacatttctatagtgacgaacagaacaagacttgttgattttacccagccatatatcgaatcgggtctcattattgtagctccagcaaaggaggttgaatcaaatgcttgggcttttctgaaaccattcaccttccagatgtggtgtgtcctaggtgttatcttcctctttgttggtgcagttgtttgggtacttgaacaccgtactaatactgagttccgtggacctccaaggcaacaaattatgacagtgtgctggtttagtttctctaccatgttctttgcacacagagaaaatacagtcagtgcacttggtagattcgtgctgctgatctggctctttgtagtgctgattattaactcaagctacaccgcaagcttgacatcacttctcacagttcaggagctgacatcagggattcagggcctcgatagcttgatctcgagctcaagtgcaattgggtatcaagttggatctttttccagaaactaccttgtcgatgagctcaatattgctgagtcccgtttggttccactaaacagcgcatcagattatgcaagagcccttgagctagggtcaggaaatggtggtgtggctgcaattatcgatgagcttccatatgttgagatcttcttgtcaaaatactgcaaattcaagacagttggtcaggttttcacaaaaagtggatggggatttgccttcccaagggactcccctcttgctgaggacttgtcaacagc

SEQ ID NO: 26181 - protein, 806 aa, Panicum virgatum
  misc_feature: Ceres CLONE 1868166
  misc_feature (70)..(423): Pfam Name: ANF_receptor Pfam Description: Receptor family ligand binding region
  misc_feature (604)..(806): Pfam Name: Lig_chan Pfam Description: Ligand-gated ion channel
  misc_feature: SWISSPROT Homolog: EC 4.6.1.2 Guanylate cyclase
MDGSKVVKNATLSSWSSEMGYAYFAAMLLCGFMVASGTTAANQNSTGDPARPAEVRIGALFTFDSVIGKAVRPAIELAVEHVNSDPSILRGTKLSVLMQDTNCSGFIGTIEALQLLAKDVIAVLGPQSSAVAHVISHAVNELHVPLISFAATDPTLSSLEYPYFVRSTQSDYYQMDAIASIISQYQWKQVIAIHVDDDYGRGGIMALGDALAKRKCKIVYKAKLPPGAANTTIENILMQVNEMESRVYVIHVNPDSGLNVFSAAKSLGMMSSGYVWIATDWLSAVMDSSVHGTTDVMELTQGVLVLRQHVSHSDIQKALLSKWNLTRNGSAYSMRAYDSVWLVAHAAERLLSEGNTISFSADTNLRATKGSNLQLDSLRIFNNGNKLLENVWNVNFSGVSGPVQFTLDRNLIHPAYDILNIGGTGLRTIGYWSNISGLSVVAPENLYSSALNSSTNNVQLHSVIWPGQITEKPRGWEFSYHGKPMRIGVPLRTSYKEFVTQDNGPDGVKGFAVDVFKAAISLLPYPVSCNFVLFGDGLKNPSYSDLVQKVSENYFDAAIGDISIVTNRTRLVDFTQPYIESGLIIVAPAKEVESNAWAFLKPFTFQMWCVLGVIFLFVGAVVWVLEHRTNTEFRGPPRQQIMTVCWFSFSTMFFAHRENTVSALGRFVLLIWLFVVLIINSSYTASLTSLLTVQELTSGIQGLDSLISSSSAIGYQVGSFSRNYLVDELNIAESRLVPLNSASDYARALELGSGNGGVAAIIDELPYVEIFLSKYCKFKTVGQVFTKSGWGFAFPRDSPLAEDLST

SEQ ID NO: 26182 - DNA, 685 bp, Panicum virgatum
  misc_feature: Ceres CLONE 1868166-R
  misc_feature (101)..(101): n is a, c, t, g, unknown, or other
atatgacaatgatgcacaatactgcattgaagtggaagttttcctaccacagaggcccagttggtgaggaaggggtcctcttgtccatgggttgttctgancgtcggattggaaaatatagcatcgaaagcagcttcagagtattgcctcaggagaaataccacagcgctcgagtttttttccccccaacagcaacaaatctggatccccttgcagcaatgtctgggagaagtagcactaggttgcagcttcaacttctgccaagttggcctccttggttttgaagtaactcctacaaaagttcgtgtggctaccatctgattcatctgcttcaagtaagttgggaagttagaatctttgtttggtgtggtatgtggccagttgtgcatgacctttcaactttttttaagaagtcacatgtctaccccctttccgctgcaactatgcaaggagaacatttcagagcagaagctctgacctcacccattttgttcagactcgcatccaccctgattagggatttggacagaagcactctgaactagcattccgttctgaaaagaagcatttatatgaagaaaatatctctgtggtttattgcgtagatatagagaaacttgtgtaccctactttgtaatccaaaaactcaaaatacgtcaattatacatgttatatctcttcatgc

SEQ ID NO: 26183 - DNA, 598 bp, Panicum virgatum
  misc_feature: Ceres CLONE 1868170
  misc_feature: Encodes the peptide sequence at SEQ ID NO. 26184
ttacatcttaagtatgatctccttggttgctctcgtggctttggtcattgccttctccttcggtatgggtgccattccatggcttatgatgtctgagatcctcccggttagcatcaagagtcttggaggaagctttgcgacactggcagcctggttgacgtcatttgctataacaatgacagcaaatttgatgctcacctggagcgttggaggcactttcctctcctacatgattgtgagcgccttcactctggttttcgtcatcctttgggtgccagagacaaagggcagaactctagaggagatccaatggtcgtttcgctgaggttcacacacaatgagcagatgcaatcatccaatgattcttcgggtttttttctcctggaaggcaacggttgattcctgcaactggaaattttgggtattcctcccagcacaaatactaggtgaaggccacgaactctttctgttcgtacgacagtttgtacattcttgtgcaatgctgtgaaaagtacatgtaaatgctggggcagtgactcttatcgaattgctctcctgccttcagtgctgtataagatcgatccaagagtgcattgtc

SEQ ID NO: 26184 - protein, 107 aa, Panicum virgatum
  misc_feature: Ceres CLONE 1868170
  misc_feature: Useful for biocontainment applications
YILSMISLVALVALVIAFSFGMGAIPWLMMSEILPVSIKSLGGSFATLAAWLTSFAITMTANLMLTWSVGGTFLSYMIVSAFTLVFVILWVPETKGRTLEEIQWSFR

SEQ ID NO: 26185 - DNA, 721 bp, Panicum virgatum
  misc_feature: Ceres CLONE 1868171
  misc_feature: Encodes the peptide sequence at SEQ ID NO. 26186
tccaaaggcgcccttagctcgctctcacaccggtctctcagagccgccgcctcctcctgctgctgctggaatggagaacggcggcgagggagaaggaggcggcggggacgcctacaccaaggacggctccgtcgacctccgcggcaaccccgcccgccgctccaagcgcggcggctggaccgcctgcaccttcatcatcgtgtacgagctgttcgagcggatggcctactacggggtggcgtcgaacctggtgatgtacctgacggagcggctgcaccagggcaccgtcgaggccgccaacaacgtcaccaactggtccggcaccgtcttcctcacgccgctcctcggcgccttcgtcgccgacgcctacctcggccgctactggaccttcgtcgccggatccgccgtctacctcatgggaatgctgctgctgacgctggcggtctccgtgccggcgctgaagccgccgccctgcgacgccggcgccggcgtcacctgcccgcgcgcctccgccctgcagctgggcgtctacttcggtgggctgtacaccatcgcgctgggccacggcggcacgaagcccaacatctccaccatcggcgccgaccagttcgacgacttccacccggcggagcggctacggaagctctccttcttcaactggtggatgttcaccgtcttcacgggcatcttattctccacgaccgtgctcgtctacctccag

SEQ ID NO: 26186 - protein, 216 aa, Panicum virgatum
  misc_feature: Ceres CLONE 1868171
  misc_feature: Useful for making plants with altered carbon content
  misc_feature: Useful for making plants with altered nitrogen content
MENGGEGEGGGGDAYTKDGSVDLRGNPARRSKRGGWTACTFIIVYELFERMAYYGVASNLVMYLTERLHQGTVEAANNVTNWSGTVFLTPLLGAFVADAYLGRYWTFVAGSAVYLMGMLLLTLAVSVPALKPPPCDAGAGVTCPRASALQLGVYFGGLYTIALGHGGTKPNISTIGADQFDDFHPAERLRKLSFFNWWMFTVFTGILFSTTVLVYL

SEQ ID NO: 26187 - DNA, 741 bp, Panicum virgatum
  misc_feature: Ceres CLONE 1868173
  misc_feature: Encodes the peptide sequence at SEQ ID NO. 26188
gcaaacaaaccccgccccgccccggccactccacacaacacacggcacgctgttgcagcgcccccggccggcggaggagtactcaagcggagtcagaggctcgatcgatcgacatgccggcggcgggcggcgtgttctccgggtcggtgaacctcaagtacgtgaagctggggtaccagtacctggtgaaccacttcctgacgctgctgctggtgccggtgatagcggccaccgcgctggagctggcgcgcctgggccccggcgagctgctctcgctgtggcggtcgctggagctggacctcgtccacatcctctgctccgccttcctcgtcgtcttcgtcggcaccgtctacgtcatgtcgcgcccccggcccgtgtacctggtggactacgcctgctacaagccccccgccagctgccgggcgcccttcgccaccttcatggagcacacgcgcctcatcagcgacgacgacaagagcgtgcgcttccagaccaggatcctcgagcgctcggggatcggcgaggaaacgtgcctcccgcccgccaaccactacatcccgcccaatcccagcatggaggccgcgcgcgccgaggcgcagctcgtcatcttctccgccatcgacgacctcgtccgccgcacggggctcaagcccaaggacatcgacatcctcgtcgttaactgcagcctcttctccccgacgccctcgctctccgcaatgatcatcaacaagtacaagctcc

SEQ ID NO: 26188 - protein, 209 aa, Panicum virgatum
  misc_feature: Ceres CLONE 1868173
  misc_feature (80)..(209): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MPAAGGVFSGSVNLKYVKLGYQYLVNHFLTLLLVPVIAATALELARLGPGELLSLWRSLELDLVHILCSAFLVVFVGTVYVMSRPRPVYLVDYACYKPPASCRAPFATFMEHTRLISDDDKSVRFQTRILERSGIGEETCLPPANHYIPPNPSMEAARAEAQLVIFSAIDDLVRRTGLKPKDIDILVVNCSLFSPTPSLSAMIINKYKL

SEQ ID NO: 26189 - DNA, 1518 bp, Panicum virgatum
  misc_feature: Ceres CLONE 1868190
  misc_feature: Encodes the peptide sequence at SEQ ID NO. 26190
agaaactcgttcgattgcaacccctccccgccgccgtaatcagacgagcaccaaaaccctcgccggcgacgccctccaccgccgcagttttcgcgagaaatggacttccaggtcgtcgtcctcgccggcggcacctccgagacgttgtcgcccctcgtctccaaggatgtccccaaggcgctgctcccggtcgcgaaccgccccttgctctcctacgctctggacctcctcgaggccagcgacctcaaggacctcatcgtggtggtggaggggcaggaggcggcgcggctcgtcggtgcctgggtctccagcgcatacctggatcgacttcgtgtggaggtagttgctgtttctgaagaccttggaagtgctggtgcattacgagctatttcaaagcgactgacagcaaatgatattttggtaattagcggtgacctggtcacagatgtgttgcctggggctgttgctgctactcatagaagaaatggtgcagctgttactgctttactatgttctgttcctgttagtggtccttcagaaactgcttcttctagtgggaaagataaagctaaaaagccaaatcgtctgaacatagttgggctggacaaaactaaacagttcttgttgcatatcgtatcaggaaccgatgttgaaaaagatgttcgagttcataagagaaaaatccaggctgtaggtcagactgccgaaatttgttgactgatgaggcaatctggattctgatataacctcaagcttgacaaaagcacaacttagccgtgaccaggcttaaaatcgcaggagatggactgtattgtaacagattgcagatgattggtagacagcccagaaaatttcacattattcactggaaaaatagccattttggtccctcaactttatcccaagggtcaagttcgtccttcaacttttaaatttgccaatatagtccctcaacttttgttttgaggtcaaactcatccttatgctgatattatgctccataataacatgaggtaaatgcaaaaggtcatttttatccttggtttctttttccccttctcaatttagcgtcaccatttgctatactttctgtaacattttatatggtagtacgtagttatgcaaagtagatttaattttactctccatgagtctgcgatacaatatgatgcatacgtaaataaaattctatgttccaaattaaacactttgtgatgttcagctcctaaatgaatttaggggaaggagccaagggcaaagaggactttttgcacaaatcttatgttattatggagtataatatcagcataaaaatgaaagttgagggactatattggtctgtttaaaagtcgagggatgaacttgaccttcgaatcgaagttgagggactaaaacacctattttgccttattcatttacaagcaattgctaattgaggacagggatactcttctaaggaaacaagtgaagaacctccctttatggatggggtctattatgagaactgaatgacagctc

SEQ ID NO: 26190 - protein, 205 aa, Panicum virgatum
  misc_feature: Ceres CLONE 1868190
  misc_feature: SWISSPROT Homolog: EC 2.7.7.13 Mannose-1-phosphate guanylyltransferase
MDFQVVVLAGGTSETLSPLVSKDVPKALLPVANRPLLSYALDLLEASDLKDLIVVVEGQEAARLVGAWVSSAYLDRLRVEVVAVSEDLGSAGALRAISKRLTANDILVISGDLVTDVLPGAVAATHRRNGAAVTALLCSVPVSGPSETASSSGKDKAKKPNRLNIVGLDKTKQFLLHIVSGTDVEKDVRVHKRKIQAVGQTAEIC

SEQ ID NO: 26191 - DNA, 642 bp, Panicum virgatum
  misc_feature: Ceres CLONE 1868190-R
tatttgacatcaaagatagtgttaaattgcttttgatacattaataatgagcttttgcagatctgattttgcatcaatgttcgaaatggttactttctttatttgtcaaacacgcatttttggcttatttttgtcatttcttatgtttgtttagatagggccacattgtattcttgctgagggttcacagctaggtgacaagtgtagtgttaagagatctgtgattggtcgtcattgccgtatcggttccaatgtaaagattgtcaactctgttgtgatgaaccacgttgttattgaagatggctgccacatccaaggttcagttgtatgtaataatgttcaactgcaagaacggtctgttctgaaagattgccagattggagctggctatatcgtgactgctggcagtgagcacaaagcagaatccctagcaagaaagtagaggaagttttgacagttttggcggaccctgaacgattttgtgcacttgagatgcacccctctgaaaaaagggggtgacaatatttcttgatgtgcaaccccataattttgattcttgtgtaacagtctgaaaggttttggttaactcaattctactagtccgagcttgagctgcagttagcgaaaacatttcatgccgtc

SEQ ID NO: 26192 - DNA, 2577 bp, Panicum virgatum
  misc_feature: Ceres CLONE 1868194
  misc_feature: Encodes the peptide sequence at SEQ ID NO. 26193
acaacacctctcctctccctagagaagcggcgggagagctcctctctcccctccctcctcctgctaccaccaccaccaccttcccagagcacagagctagcacgcagcagcaggtcgcctgctcgctccccattcccggtcggttcccacttcctcccccgccggccggcctcttctctcttgcctgtcctcgagagagacaggaagctagccgccgcggcacgcaggcggcagcgggaaccggggcgcgcgcggcgggcattatggcgcccggcggcggcggagacgcccggcggaacggcgagcacgggtgcgcgtgcggcgggttccccgtgtgcgcgtgcgcgggcgcggcggcggtggcctccgcggcgtcctccgccgacatggaccgcgcggcggtggccgccaccgacggccagatcggcgccgtcaacgatgagagctgggtcgccgtcgacctcagcgacgacctctccgccgacgccgacgacggcgtcgccatcgaggaccgcgccgtcttccgcaccgagaagatcaagggcgtcctcctccacccctacagggtgctcatcttcgtgcggctgatcgcgttcacgctgttcgtgatctggcgcatctcgcaccggaacccggacgcgatgtggctgtgggtgacctccatcgccggcgagttctggttcggcttctcgtggctgctggaccagctgcccaagctgaaccccatcaaccgggtgcccgacctggcggtgctccggcagcggttcgaccgcgcggacggcacctcccggctgccggggctggacatcttcgtcaccacggcggaccccttcaaggagcccatcctgagcacggccaactcggtgctctccatcctggccgccgactaccccgtggagcgcaacacctgctacctctccgacgactcggggatgctgctcacctacgaggccatggcggaggccgccaagttcgccaccgtctgggtgcccttctgccggaagcacgggatcgagccccgcgggcccgagagctacttcgagctcaagtcccacccctacatggggcgctcccaggaggacttcgtcaacgaccgccgccgcgtccgcaaggagtacgacgagttcaaggcccggatcaacggcctcgagcacgacatcaagcagcgctccgacgcgcacaacgccgccagggggctcaaggacggcgagccgcgcgccacctggatggccgacggcacccagtgggagggcacctgggtcgagccctcggagaaccaccgcaagggcgaccacgccggcatcgtgcaggtgctggtgaaccacccgagccacagccggcagctcggcccgccggcgagctcggacaacccgctggacttcagcatggtggacgtgcggctgccgatgctggtgtacgtgtcccgcgagaagcgcccgggcttcaaccacgagaagaaggccggcgccatgaacgccctcacccgctgctccgccgtgctcaccaactcgcccttcatcctcaacctcgactgcgaccactacatcaacaactcccaggcgctccgcgccggcatctgcttcatgctcggccgcgacagcgacaccgtcgccttcgtccagttcccgcagcgcttcgagggcgtcgaccccaccgacctgtacgccaaccacaaccgcatcttcttcgacggcacgctccgcgcgctggacggcatgcagggccccatctacgtcgggaccggctgcctcttccgccgcgtcacgctctacggcttcgacccgccgcggatcaacgtcggcgggccctgcttcccgtcgctgggcgggatgttcgccaaggccaggtacgagaagcccggcctcgagatgaccaccaaggccgccgtcgccaagggcaagcacggcttcctcccgctgccccggaaggcgtacggcaagtcggaggcgttcgtcgactccatcccgcgcgcgtcgcacccgtcgccgttcgccgccgccgccgccgtcgtggccgacgaggccaccatctccgaggccgtggcggtgaccaccgcggcgtacgagaagaagaccgggtggggcagcaacatcgggtgggtgtacggcacggtgacggaggacgtggtgacggggtaccggatgcacatcaaggggtggcgctcccgctactgctccatctacccgcacgccttcatcggcaccgcccccatcaacctgacggagcgcctctaccaggtgctccgctggtccacgggctccctcgagatattcttctcccggaacaacccgctgttcgggagcaccttcctgcacccgctgcagcgcgtggcctacatcaacatcaccacctaccccttcacggccatcttcctcatcttctacaccaccgtgccggcgctgtccttcgtcacgggccacttcatcgtgcagcgccccaccaccatgttctacgtgtacctggccatcgtgctggggacgctgctgatcctggcggtgctggaggtcaagtgggcgggcgtcaccgtgttcgagtggttccggaacgggcagttctggatgacggccagctgctcgg

SEQ ID NO: 26193 - protein, 771 aa, Panicum virgatum
  misc_feature: Ceres CLONE 1868194
  misc_feature (85)..(771): Pfam Name: Cellulose_synt Pfam Description: Cellulose synthase
  misc_feature: SWISSPROT Homolog: EC 2.4.1.12 Cellulose synthase (UDP-forming)
  misc_feature: Useful for making plants with altered cell wall content and/or composition
MAPGGGGDARRNGEHGCACGGFPVCACAGAAAVASAASSADMDRAAVAATDGQIGAVNDESWVAVDLSDDLSADADDGVAIEDRAVFRTEKIKGVLLHPYRVLIFVRLIAFTLFVIWRISHRNPDAMWLWVTSIAGEFWFGFSWLLDQLPKLNPINRVPDLAVLRQRFDRADGTSRLPGLDIFVTTADPFKEPILSTANSVLSILAADYPVERNTCYLSDDSGMLLTYEAMAEAAKFATVWVPFCRKHGIEPRGPESYFELKSHPYMGRSQEDFVNDRRRVRKEYDEFKARINGLEHDIKQRSDAHNAARGLKDGEPRATWMADGTQWEGTWVEPSENHRKGDHAGIVQVLVNHPSHSRQLGPPASSDNPLDFSMVDVRLPMLVYVSREKRPGFNHEKKAGAMNALTRCSAVLTNSPFILNLDCDHYINNSQALRAGICFMLGRDSDTVAFVQFPQRFEGVDPTDLYANHNRIFFDGTLRALDGMQGPIYVGTGCLFRRVTLYGFDPPRINVGGPCFPSLGGMFAKARYEKPGLEMTTKAAVAKGKHGFLPLPRKAYGKSEAFVDSIPRASHPSPFAAAAAVVADEATISEAVAVTTAAYEKKTGWGSNIGWVYGTVTEDVVTGYRMHIKGWRSRYCSIYPHAFIGTAPINLTERLYQVLRWSTGSLEIFFSRNNPLFGSTFLHPLQRVAYINITTYPFTAIFLIFYTTVPALSFVTGHFIVQRPTTMFYVYLAIVLGTLLILAVLEVKWAGVTVFEWFRNGQFWMTASCS

SEQ ID NO: 26194 - DNA, 442 bp, Panicum virgatum
  misc_feature: Ceres CLONE 1868194-R
cccacatccacgggcccggcggcaagcacggcgcccacggcggcaggcactcctcccaccaccacgccggcaacagcctgcacttcacggtctggccgtaggagggatccgtcgagcacatacataccaggcccccaacattgattcatcgaccagaccgaccaccgtgaagagaagagtacgttccgttccagtccattccgttctgctgctgcttctgctgctgctggtgaagctagactgctacttacaacatgcgaccgacgacgtacccgccaccacaatttgatttcttctttttttttttctttctagttttgtccagaaattgaaagatggtgttgatttgatttagttcttttttttcgattattaattaccgtacccgtggtaattaatcatgtacctactactatatatatattacgccaagaggaagtgg

SEQ ID NO: 26195 - DNA, 774 bp, Panicum virgatum
  misc_feature: Ceres CLONE 1868195
  misc_feature: Encodes the peptide sequence at SEQ ID NO. 26196
acaaacccttaggcctgtccgcctgagcaaaacggaacacgataacgagacggcaggtgggggaggagccgaggagggcttcaggggtttcagggcggagaggagaagatggcggcgaagcgcgagaccgagtcggacggcggcgccttcgtcggatccatcgtcggatatagacaaggcctgatcactaagaaaggtttcaagggttcattcagcaatgctgggtcctctgctaagacttttgcagttctatctggggtccagagtttggttgtgtgcttgctgagaaggctgcgtgggaaagatgacattgtcaatgctggtatagctggttgttgcactggcattgctttgagcttcccaggagcaccacaagcgttgcttcagagctgtgccacctttgcagcgttttcttgcatcatggaggggctcaacaagcagcaggctgcaatggctcacactcttggcacaactgcattgacggttgcgcatgataaaggaggtgtactgcccccattcacgcttccaccaattctggatgcatcagatgctttagcttcatgctgccaagccttagtaaagcctaagcactagactacaggataggggagagagacatgctgaagaaagatagcttcagttttcatttctttattatgttgacctagcatatctgcatatgtaaattttgcttctggacaagctgtggaacgtgcctaaaacctagttttgctttgagcaactggacaggttttcttgatgtgttcgtgttgg

SEQ ID NO: 26196 - protein, 161 aa, Panicum virgatum
  misc_feature: Ceres CLONE 1868195
  misc_feature (1)..(112): Pfam Name: Tim17 Pfam Description: Tim17/Tim22/Tim23 family
  misc_feature: Useful for making plants with modulated salt sensitivity
MAAKRETESDGGAFVGSIVGYRQGLITKKGFKGSFSNAGSSAKTFAVLSGVQSLVVCLLRRLRGKDDIVNAGIAGCCTGIALSFPGAPQALLQSCATFAAFSCIMEGLNKQQAAMAHTLGTTALTVAHDKGGVLPPFTLPPILDASDALASCCQALVKPKH

SEQ ID NO: 26197 - DNA, 544 bp, Panicum virgatum
  misc_feature: Ceres CLONE 1868202
  misc_feature: Encodes the peptide sequence at SEQ ID NO. 26198
catataatcctgaactttcctaacccacggagttaaaagactccgagagattccctagccttctctctcgtggtcttcggcacgaatcccgggtgactaattagaccctaaaccctaatccatcatccgcagattcggcgttccgtggtccgggcgtcgggggcaggtggtcgtgagggcgaggagggatgaggctgacgcagagggaagcagagaagctcaccctgcacaattccgggttcctcgcgcagaagcgcctcgcccggggcctccgcctcaactataccgaggccgtcgcacttatcgcctcgcacgatactcgcacattctgtgtggcaaaatttacttgagaagcgcaacacgctgttttttttggatcaacgcaacaggctgttgggatgctgcgtgcataattttgtttttttttgaaggatttgctacttgcctcgtgcagttttcctaattttaatggaaatactaaatagcataaggtcaaggacttgtcccataaagcaatgccgaaatattccccattctggcattc

SEQ ID NO: 26198 - protein, 53 aa, Panicum virgatum
  misc_feature: Ceres CLONE 1868202
  misc_feature (1)..(49): Pfam Name: Urease_gamma Pfam Description: Urease, gamma subunit
  misc_feature: SWISSPROT Homolog: EC 3.5.1.5 Urease
MRLTQREAEKLTLHNSGFLAQKRLARGLRLNYTEAVALIASHDTRTFCVAKFT

SEQ ID NO: 26199 - DNA, 289 bp, Panicum virgatum
  misc_feature: Ceres CLONE 1868206
  misc_feature: Encodes the peptide sequence at SEQ ID NO. 26200
acacccagccagccaccatggcggcaaacctgctctctaacctatgtccaggtctacctcctgctcccgctggatgtcaccactgcccaccacacgttcgataaggcccacgagacgcggctgcagctgcataagctggcggacgccggccctgacgggctcatgatccacgtctggtgggggctgctggaagggaaggccccctgggtctccgcctggactacctattcccggtgttcacgctggtgcaggaggcccggctgaacctgcaggccatcatgttctgcca

SEQ ID NO: 26200 - protein, 87 aa, Panicum virgatum
  misc_feature: Ceres CLONE 1868206
  misc_feature: SWISSPROT Homolog: EC 3.2.1.2 Beta-amylase
TPSQPPWRQTCSLTYVQVYLLLPLDVTTAHHTFDKAHETRLQLHKLADAGPDGLMIHVWWGLLEGKAPWVSAWTTYSRCSRWCRRPG

SEQ ID NO: 26201 - DNA, 628 bp, Panicum virgatum
  misc_feature: Ceres CLONE 1868224
  misc_feature: Encodes the peptide sequence at SEQ ID NO. 26202
tcgttgggtcctgttcgaaatgctgctcaagctgctgctcggatatatcaagtttttagggtgcaatccttccagaggaagcaagcagctcaatatgaggatgataaaggtgggttgtcagatgatcgtgccctttcactcctttctgtcaagccatccaagccagggcagcttgatcccctgcattctgctgcaactcgtatacagaataagttcaggggatggaaggggagaaaggaatttcttcttattaggcagcgaattgtcaagatccaggctcatgtacgaggtcaccaagtgaggaagcattatcggaaaattgtttggtctgttgggatcgttgagaaagttatcctgcgctggcggcgaagaggggctgggttacgtgggtttcggtctacagaagcttcaacagagggcagcagtggtggaacaagtagcaatatgatcaaagataagccttctggagataactatgatttcttgcaagaaggacgaaagcaaactgaagaacggctccagaaagctcttgccagagtgaagtccatggctcaatacccggaagcaagggaccagtaccagaggattttgactgttgtgtcaaaaatgcaggagtcccaggctatgc

SEQ ID NO: 26202 - protein, 209 aa, Panicum virgatum
  misc_feature: Ceres CLONE 1868224
  misc_feature (85)..(105): Pfam Name: IQ Pfam Description: IQ calmodulin-binding motif
  misc_feature (62)..(82): Pfam Name: IQ Pfam Description: IQ calmodulin-binding motif
  misc_feature: The sequence is a functional homolog of SEQ ID NO 1308 in the 10/666,642 US patent application
  misc_feature: Useful for making plants with altered alkaloid content
  misc_feature: The sequence is a functional homolog of SEQ ID NO 1309 in the 10/666,642 US patent application
  misc_feature: The sequence is a functional homolog of SEQ ID NO 588 in the 10/666,642 US patent application
SLGPVRNAAQAAARIYQVFRVQSFQRKQAAQYEDDKGGLSDDRALSLLSVKPSKPGQLDPLHSAATRIQNKFRGWKGRKEFLLIRQRIVKIQAHVRGHQVRKHYRKIVWSVGIVEKVILRWRRRGAGLRGFRSTEASTEGSSGGTSSNMIKDKPSGDNYDFLQEGRKQTEERLQKALARVKSMAQYPEARDQYQRILTVVSKMQESQAM

SEQ ID NO: 26203 - DNA, 1728 bp, Panicum virgatum
  misc_feature: Ceres CLONE 1868225
  misc_feature: Encodes the peptide sequence at SEQ ID NO. 26204
ctgcaaaccaactttctctgcaaaccattttgattgctgtaatcagaagaggttttggttactgtagtttgagtctgtcacacaattgtggttgattactatattcttagatcataattcaggatgcatctcaggcaaacatatgtgctatgcctaccattagaattgcaaatcaaagtggtattgtgaatttggtaacatattacttttttctgattactgagaaaatgccttatggcaaatgacatgtttctttggtgggattagccatgaattcagttcctgccatttctttgttggtgaatttggcgctttgatgtggagcatggttctgcggcaggttggcacaattgctcgccctgaagtggctggccgcaatgctggtaacatcacggcgagtttgcttgtcaataattatttgctgatttttgctgccttgtgttatcttaaagttagctagagtcctattgatgaaaatttccgtttactgaaatttctgggacttgtcaagttaaaaaatggaaggagtagtgattcagttccatttatattgtctcattgttctgcttctaaattgtatccctatatattcctgatgctaacctaaatgctgctgccaaataaattcagacaatataaacctcctatatgcacgcctgttaagtttatccgttgacttttttttgttatatattttgaatggaatcgttgacaagtaaaaatattttgatgcaaaaatcattcaggacaagatgtgagcagagcaaaccatggttgtattcaatcctttctatctcatgttttccggtgtgccttgaaatcatgtcactagcagaagccatgttcttgactgatctggagctgaatacagtatctcttttcacttctttgatgtctttctctgtgagttgttgtatgacatttttcccccatccgtttcatgctgatttttgttattttacaagttgacttcgtaccaaaccttgataactcacagaaggaaccatctctgctgccagctcgtatttcatctctattgttgaatgattcttctgggattgcggtcggaatggcaacaaacattcctcataatctgggggagcttgttgatgcactttctgttataattcaaaaccctgaagccacagtgagtgatttgtaccacatatcattatgagttcagtattatgtacgcctgtttgtatgcatgtatgttgaaaaggcactcagctgctatttttcctatgataattattaacaagttcccataagaagcaaggaacagcaaatattttcttaccttgggcatgatattattaccacttttcatatcccgtcataaaatcattggaattatgttagttttgtgataccagcttcttcagaaacatccagcttctcaatatggacattcaatttcaggaaggaaatctccatcccggagatgttcaagagcacgtgtatgacaatgtcttaaattcttatattcacctatatctagatgatgatgaaggaacattccactacatgggcctgcaattctttgtaagcacatagagtcgtttgatatacattcttttcttggacatatcatattgttctcacttgatatggaatcttgaactgtatctatattggacccaatgcccatacctcacaattttaagttgtgattttactctatggatgtgtttgtgtaatcaacataataactttgtcctttgtgcg

SEQ ID NO: 26204 - protein, 78 aa, Panicum virgatum
  misc_feature: Ceres CLONE 1868225
  misc_feature: SWISSPROT Homolog: EC 5.99.1.3 DNA topoisomerase (ATP-hydrolyzing)
MLIFVILQVDFVPNLDNSQKEPSLLPARISSLLLNDSSGIAVGMATNIPHNLGELVDALSVIIQNPEATVSDLYHISL

SEQ ID NO: 26205 - DNA, 671 bp, Panicum virgatum
  misc_feature: Ceres CLONE 1868231
  misc_feature: Encodes the peptide sequence at SEQ ID NO. 26206
agctgtacatcgtcaagaacaacgtactcagcaggtagactacaaacagaatcgactatctctagaagaagagtaccttgtgaaattgggatgcacactgctcgctgaatttcttacagtccagccatggagcatcttcccaagtccttccttgtacccttcttcctcctttgccttagcctcaaccttccgagcttctgtcgtgtcgccggcggcaacgagtcctttgtcttctcgggcttcgccggcgccaagaacaacctcaccctcgacggcacggccgcggtcaccggggaagggctccttgagcttaccaacaacgagcctggcgtcaagggccacgcgttctaccggatccctcttcagttcaaggactcccccaacggcacggcgcggtccttctccctcaccttcgtcttcgccatcctctcggcatcctcggatgtgagcacggatggcatggccttcgtcatcgccgccgggaaggatttctccaacgcgtcgccggcccagtacctgggcttgctcaacagccacagcaccggcggccccgcaaacgcgagcgggaaccacttcctcgccgtggagctcgacaccatcaagaacgacgagttccaggacatcgacgacaaccacgtcggcgtcgacatcgacgcgctctcctccgtgga

SEQ ID NO: 26206 - protein, 181 aa, Panicum virgatum
  misc_feature: Ceres CLONE 1868231
  misc_feature (30)..(181): Pfam Name: Lectin_legB Pfam Description: Legume lectin domain
MEHLPKSFLVPFFLLCLSLNLPSFCRVAGGNESFVFSGFAGAKNNLTLDGTAAVTGEGLLELTNNEPGVKGHAFYRIPLQFKDSPNGTARSFSLTFVFAILSASSDVSTDGMAFVIAAGKDFSNASPAQYLGLLNSHSTGGPANASGNHFLAVELDTIKNDEFQDIDDNHVGVDIDALSSV

SEQ ID NO: 26207 - DNA, 1768 bp, Panicum virgatum
  misc_feature: Ceres CLONE 1868253
  misc_feature: Encodes the peptide sequence at SEQ ID NO. 26208
ccctctcctagccaaggcacaacacaagaggcccaagaaataaatcgcaataaaaaatcacatccgggcgaaagtgggcactaccgccgctaccagcatcgccgtcgccgagtagagaaggagagcagaggggatcaggggagcccagggagatttttattccttcccttcccccgcacacaagagcgcgggctgctggctgctgctgctggtggcgggcggcggccgactgctgctgctgctgcggccgcagctagctgagctctgcgaaatccattccgggcctataagtgtggcttcgggacggcgcctcccatccgacaccggcgccttcgcggactgggtcgcctcctccgccgccgccgcccgcggggacgacctctccctcggcttcaatgccggcgcggccgccgcggccgcggccgcctccggcgcctcgctgggcgccggcctctggggcccggcctcctccatgcgccaggcggccgcgctgaactacgggatgcccgacgtcggcatggtcgtcgtcgcgcccgccgcctccttccaccacacgcaccaccaccaccaccaccacgaggccgccgccgccgcggaccccatcttcccgctgctctccggggggccctgcgtgcttgatccggacgccgccaagtcggcctccggggcgccgcccggcagcgccatccaattctggcagccgcagtcgccgtcgtccgcaccggcagctaaccctaaccctagcgccagccccttcgcctacatcaagaagcccctcccgatgctggacaccggcgccggctcctccggctccggcgccaccacgtgccaggactgcggcaaccaagccaagaaggactgcggccacaaccggtgccgcacctgctgcaagagccgcggcttcgactgctccacccacgtcaagagcacctgggtgcccgccgcccgccgactggagcgccagcagctcgccgcgtcaggctccgcatcgtcctcccccgccaccgccactgcctcagcggcggcggccgcggccgcgtccgcctccgcgtccaagaaaccccgcctcctcgcgtcgcagaccaccacatcgcacacatcaacctccaacgccaccacgccgcgaagcttcgacaccacctccagccaccaagacgcgtcgttcagggacagccttccgcggcaggtgcgcgcgccggcggtgttcaagtgcgtgcgcgtgacgtccattgaagacggcgaggacgagtacgcgtaccaggccatggtgaccatcaacggccacctgttcaaggggttcctctacgaccagggccccgacgacggccgtcacgcggccaccagcaacgacgactccgccgcgggggtgcccaacatctcggagctccacctcggagcggcgtccgcttccgtcgccggtggcagcggcgtcagggaaggtgtctcctcgatggtgcccgcggacctatacggcggcggcggcggtggcgggcagcatcgcattctcggcgggtcaagctacggcggcaccatgaactgagtacgttgttctacaccgggaaagtatggctacatcgagcgtatggccattctttgttccttcctcttcgttgctggtggagattaattttcccttgtttcttgcccgtgccgccattagagaggccatcgatcaatgcatgatatgctggtgttattagtagcaattttctcgtgattcgttggtgtactaaaataacatcgatgaagaattgtttctagtcgttct

SEQ ID NO: 26208 - protein, 355 aa, Panicum virgatum
  misc_feature: Ceres CLONE 1868253
  misc_feature: The sequence is a functional homolog of SEQ ID NO 482 in the 10/666,642 US patent application
MRQAAALNYGMPDVGMVVVAPAASFHHTHHHHHHHEAAAAADPIFPLLSGGPCVLDPDAAKSASGAPPGSAIQFWQPQSPSSAPAANPNPSASPFAYIKKPLPMLDTGAGSSGSGATTCQDCGNQAKKDCGHNRCRTCCKSRGFDCSTHVKSTWVPAARRLERQQLAASGSASSSPATATASAAAAAAASASASKKPRLLASQTTTSHTSTSNATTPRSFDTTSSHQDASFRDSLPRQVRAPAVFKCVRVTSIEDGEDEYAYQAMVTINGHLFKGFLYDQGPDDGRHAATSNDDSAAGVPNISELHLGAASASVAGGSGVREGVSSMVPADLYGGGGGGGQHRILGGSSYGGTMN

SEQ ID NO: 26209 - DNA, 677 bp, Panicum virgatum
  misc_feature: Ceres CLONE 1868270
  misc_feature: Encodes the peptide sequence at SEQ ID NO. 26210
aatctcgattcgtagtcggcgtgcccatggatgcgagcgagggctccgaccccgccgtcgaggtgagacgatgagcctcacggcggccttccgagccgcgaagatcccccgcacgctccctccgaaatgcggcgaggccgcctccgcctccgtgtccggggatccgtcggcgggggccgagaagaggaaggcgccgccgccgtggtgcgtgtacctgattgcctcctcccggatgccccgcacctacgtcggcgtcaccaccgacttcccccgccgtttgcgacaacataatggtgaattaaaaggtggtgcaaaagctgcctctgctgggaggccttggaatctcgcatgccttgttgaaggctttgcgaacagaagtgaagcttgtgagtttgaatcgaagtggaaaaatatctcccggaaaatggcacggaaaaggactgagcctagtgtggagtcggtgttgcaacatcgacaggcagcattgagcagagtggaaacctgtatggattgtagccacctacaaatcaaatggcgctcaagttgagattatttattcgcactgtgcaagctgcgggcatctaactgtgaaaaataattatcactgcttaaccataaattgtataaaataattccatgtcttagctcattgtgcagacaatacttcggtttcctgt

SEQ ID NO: 26210 - protein, 158 aa, Panicum virgatum
  misc_feature: Ceres CLONE 1868270
  misc_feature (44)..(126): Pfam Name: GIY-YIG Pfam Description: GIY-YIG catalytic domain
MSLTAAFRAAKIPRTLPPKCGEAASASVSGDPSAGAEKRKAPPPWCVYLIASSRMPRTYVGVTTDFPRRLRQHNGELKGGAKAASAGRPWNLACLVEGFANRSEACEFESKWKNISRKMARKRTEPSVESVLQHRQAALSRVETCMDCSHLQIKWRSS

SEQ ID NO: 26211 - DNA, 673 bp, Panicum virgatum
  misc_feature: Ceres CLONE 1868272
  misc_feature: Encodes the peptide sequence at SEQ ID NO. 26212
agccacgacccaccacactctccagcacccggcggagcaagcggccagcgagatcgagatccagaggcagcagccatggccaccgtcagcgccgccgcggcgaccaccgtcgttgcccgcgccaccctagggctgccgcagctgagggcgaggagcgagagggtgcggtgcagctactccagggacgccaagagcgcggcggccgccgtgagcgctaggggcgccggcgcgtcgctgctggccgcggcgggcgcggtgacctcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagatcatgtccatcctctgctcctgttactacgactgctccggatgtaaacatggcggtggtcatcggtgtaatgtggattcgaatcggatacggatgaaataaaatccggatgtcaccttttaacacattttaatccgaatgcgaatgcggatctcatcggatacgaatacaaaacggatagttcgaatccggattcggatccggataccttctcgatttg

SEQ ID NO: 26212 - protein, 125 aa, Panicum virgatum
  misc_feature: Ceres CLONE 1868272
  misc_feature (1)..(125): Pfam Name: PsbW Pfam Description: Photosystem II reaction centre W protein, PsbW
MATVSAAAATTVVARATLGLPQLRARSERVRCSYSRDAKSAAAAVSARGAGASLLAAAGAVTSSAGPALALVDERMSTEGTGLSLGLSNNLLGWILLGVFGLIWSLYTVYTSDLDEDEESGGLSL

SEQ ID NO: 26213 - DNA, 2491 bp, Panicum virgatum
  misc_feature: Ceres CLONE 1868282
  misc_feature: Encodes the peptide sequence at SEQ ID NO. 26214
gctgccagctgccgccgtgctagtttccagtgcccgcgcgcacacgcacacttcatcagggttgaaaagcggcgccacgatctgtgaaacagggggataaatcggtcggattcggaggagccgagtaaacatacggagctcttcccttccgactcctagcgttttcgttaggggggaaggggagggggaggagagcattgctgcgcggggatggcgccgaggaggagcggaggcggtgccgggactgtgggcgtgccatggctgctgctggtcctcggatgctgctgcagcagcagcatttggcccggcggacggatcttcgctgctgcggacacggaccccaacgatcttgctgtcctcaatacgctctttaaaagtctgaattctcctgggcagctcaatggttggcaggcaaatggtggtgatccttgtggccagtcatggaagggggtaacttgctcaggatcaggggtcactaaaatcatattgccgaacttgggactcaccggaaatttggcctacaacatgaatagcttgggttcattgactgagcttgacatgagccaaaacagccttggcggtggaaaccaaatacagtacaatcttcccaatatgaagcttgaaaaactcaatcttgcaggaaatcagtttggcggaaatttaccctactcgatttcaacgatgaataatcttaagtatttaaaccttaaccataaccaattacaaggaaatatttccgatgtattttccagcctttatagtttgacagaactggatctctcctttaattctcttactggtgatctaccacaaagtttcactggattgtcaagcctgaaaaaattatatttgcagaacaatcaatttactggttatatcaatgtcctagctaatctcccccttgatactctgaatgttgcaagcaaccgtttcacaggttggattcctagccagcttaagaagataaacagtatacagactgacggaaattcttggagcacaggaccagcgccacctccacctccatatacagcgccgcctcccccaaaccgtcagaacagtccagggcagaatggtgatggttctggtggaaaatctggaataggtggtggaggtgtagcaggaattatcgtatcattgctggttgttggagcaattgttgcattctttctaataaaaagaagaaaacgcaaagctgctatggaagaacactttgaacagcaccagccattcacttccttcccctcgaacgaagttaaagacatgaagcctattgatgagtcttccgcagtagacatagagtctttggcttcacctgcttcgattagtttgaaaccacccctgaagatagaacgccacaaatcgtttggtgatgatgatgattttccaaacaaacctgttgcaaagaaaagcaatatagcacctataaaggcaactgtttattcagttgcggatctacagatggcaacagatagcttcaacttggacaaccttgttggagagggtacttttggacgtgtttacagggcacagttcaatgatggaaaggttctggccatcaagaaattagacagcaccgtgatgccattccaatcatctgatgactttgctgaactggtctcaaatatttcaaagttacaccatccgaatctgaatgagcttgtgggctattgtatggaacatgggcagcacttgctagtgtatgatttccacaggaatggatcccttcatgatctactccacctttctgacgagtacagcaagccacttagttggaactctcgtgtcaagatcgcgcttggctctgctcgtgcactagagtatcttcatgaaatatgctctccatccatcatccataagaatttcaagtcatcaaacattttgctggactcggaattcaatccacacctttcagatgctggacttgcaagctttattcctgatgctgaattccaggcagcagaacaaagtgccggatacactgccccagaggtggacatgaccggtcagtacaccctcaagagcgatgtctacagctttggagttgtcatgcttgagctaatgactggacgtagaccgtttgatagctctagacccagatcagagcagtcacttgtgcggtgggcgactcctcagctgcatgacatcgatgcattggacaggatggtcgatcctgcactcaagggtctatacccagccaaatctctatcccgatttgctgatgtgctcgcgctgtgtgtccagcccgaaccagaattcaggccaccaatgtcagaggtggtgcaagcattggttcgacttgtgcagagggccaacatgacgaagagaatgctcgatggagatacttctcggcgagcagatgaccaggacccagatttcatatgacggaagcaaaacccgagcctttcaggttgtatctatttcagcatatgacgaaacagagaagtttgttggttccgcgggtacataatcacaggtttttcatggtgac

SEQ ID NO: 26214 - protein, 724 aa, Panicum virgatum
  misc_feature: Ceres CLONE 1868282
  misc_feature (423)..(694): Pfam Name: Pkinase_Tyr Pfam Description: Protein tyrosine kinase
  misc_feature (43)..(84): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPRRSGGGAGTVGVPWLLLVLGCCCSSSIWPGGRIFAAADTDPNDLAVLNTLFKSLNSPGQLNGWQANGGDPCGQSWKGVTCSGSGVTKIILPNLGLTGNLAYNMNSLGSLTELDMSQNSLGGGNQIQYNLPNMKLEKLNLAGNQFGGNLPYSISTMNNLKYLNLNHNQLQGNISDVFSSLYSLTELDLSFNSLTGDLPQSFTGLSSLKKLYLQNNQFTGYINVLANLPLDTLNVASNRFTGWIPSQLKKINSIQTDGNSWSTGPAPPPPPYTAPPPPNRQNSPGQNGDGSGGKSGIGGGGVAGIIVSLLVVGAIVAFFLIKRRKRKAAMEEHFEQHQPFTSFPSNEVKDMKPIDESSAVDIESLASPASISLKPPLKIERHKSFGDDDDFPNKPVAKKSNIAPIKATVYSVADLQMATDSFNLDNLVGEGTFGRVYRAQFNDGKVLAIKKLDSTVMPFQSSDDFAELVSNISKLHHPNLNELVGYCMEHGQHLLVYDFHRNGSLHDLLHLSDEYSKPLSWNSRVKIALGSARALEYLHEICSPSIIHKNFKSSNILLDSEFNPHLSDAGLASFIPDAEFQAAEQSAGYTAPEVDMTGQYTLKSDVYSFGVVMLELMTGRRPFDSSRPRSEQSLVRWATPQLHDIDALDRMVDPALKGLYPAKSLSRFADVLALCVQPEPEFRPPMSEVVQALVRLVQRANMTKRMLDGDTSRRADDQDPDFI

SEQ ID NO: 26215 - DNA, 718 bp, Panicum virgatum
  misc_feature: Ceres CLONE 1868295
  misc_feature: Encodes the peptide sequence at SEQ ID NO. 26216
gaatccctagttccccgtccagtccttcggcacccgaattccggcggcggcggcgatggcggcggctgcggcgaggtccggtttccggcgcatgttctccatctcggccttcgcgccgccgaagccgcccgccccgcgaccccaggccgacccctccccgaacctcttcgtctccggattaagcaagcgtaccacaacagatggacttagaaatgcttttgcaaagttcggggaagttgtgcatgctcgagttgtgacagaccgtgtcactggttattcgaaggggtttggctttgtaagatatgctacaactgaagaggcagggaaaggaatagaaggaatggatggaaagttccttgatggatgggttatttttgcggaatacgctaaacccaaaccagcaccccaggaagcagagatgaactcgcagccacaacaatcatggggtcctccatcaagttcctggggttcacagtagatgaagagctgccagccctctatccagccttggggctcacagtggatcaagaggccatcaattcagcatctaatttatagatattgtgtgtgctgtgcgaggtgtgaatgccctagacgatccgatattcttgccgtgttggagtggtcgtttactcgggtccatgatttccacatgaagaggtagttgtcaatccccacacggaccaaaacaaatattactatgtgcaacagatgagaa

SEQ ID NO: 26216 - protein, 140 aa, Panicum virgatum
  misc_feature: Ceres CLONE 1868295
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAARSGFRRMFSISAFAPPKPPAPRPQADPSPNLFVSGLSKRTTTDGLRNAFAKFGEVVHARVVTDRVTGYSKGFGFVRYATTEEAGKGIEGMDGKFLDGWVIFAEYAKPKPAPQEAEMNSQPQQSWGPPSSSWGSQ

SEQ ID NO: 26217 - DNA, 2320 bp, Panicum virgatum
  misc_feature: Ceres CLONE 1868302
  misc_feature: Encodes the peptide sequence at SEQ ID NO. 26218
catccaagcccagcagcagcagcaggtaataaactgaacttaccatttaccatgctagttgctaccatctcatcatcatcatcatcatcatcatcagcttcgccgttcatgtcgtctctttgactaatttccaccggtactttcgtggcttagttcgtgttcaaagtccaaaagaaatggccttgcgtcgcagctggaaccgagtagttagtcaacgttgtacttccatgttaccaaaaaaaatattaagatcccttgaacatctttccactaaaatatctcgtgaaaaagcagcagccagcaaagcgagactcatttcacacaagatctgctcctatataaacccgcgcgtctaaattgcccgccataatctgtgtgcatccgagatgaattgacactctaccagtttgattcccattttctttgtatttctctctagtttacagtactactttcaaaggttgcattgccaaactggttcagaacttcagatggcaccctcatttctgtgaccactggcactatatatggtactgaaataaaatacgcaagaccacttgtgtactagcttagttgagctcaactgttgtgcatcgaaacccataaacaaaatttcaacacctgattaggttggtagtcaaatctttgttgcccattaatgatttggagagaggtgtcccgatccatgtttacgcgctgcacatacagtagcacggggctaccggccatgtagatctcgccatcgcaagcacctttggccgtgccaacaggaaccaggcttgagaacaaagccacacttactaataatggttgttagcgtgttcgtgtcgacaactcgatccgatcggcattaccaccgtgcatcccgtgtacgcgcgcagcgctgacaccatttttctcttagtcccgtaactctcataattcaattcggctgctacgtacgtactgccaataatgatcatgtgacaagcaacacatcagcaacgccttcgtcaactgccatggatcggtgcaggccagcggcgcggcgaactcgatgctaccggcggcggcggcgacggtgccggcgggactgcaattcgtggacccccgcatggctccggcggtacgagctccggcggcgcttgacggcggcgacaggggggattccgacggtggcagcggcagcgccggcgaagccgatcgtcagaacagtgggaggtcggcgcggcaggaggaagggtcggggacgcctgagcacgacgaggtcagcgccgagcgggcggcggaggcgccgctgcggagagtgagggtgtcggtgcgcgcgcggtccgaggcaccaatgatcagtgatggatgccaatggagaaagtatgggcagaagatggccaagggcaacccgtgccccagagcttactaccggtgcacaatggccacaggatgccccgtcaggaagcaggtgcaacggtgcgcggaggacaaggcggtgctgatcaccacgtacgagggcacccacaaccaccagctgccgccggccgccgccgcgatggccaagaccacctcgtccgcggccgccatgctcctctcgggcccggccgccagccgcgacgccggcgcgctcttcgccggccaccacgtcgcggcgccgctcttccagtcatcgtacccctacgcgtctgccgccatgggcgccacgctctccgcctccgcgccgttcccgaccatcaccctcgacctcacccacccgccggcgccggcgtcggccgcagcgggcctgctcccgcaccgcccgccggccctccccgcgctgccgttcccgatgtacggcggattccctgctgcgcgcaggccggcggtgccgccacagccggcgacggtgtcggtggggttgatggacggcaggaaccggtcggcgctggagaccatgaccgccgcgatcaccagcgaccccaacttcaccgcggcgctggcggccgccctctcgacgatcattgggggaggcgctgaagcagctccccggagtggcgccggcgccagcgacggagatggtaataatagcggtagcggcggcgggcactgagccggccaccacggcgtcggcggccggagcacgggagacggcattgcatgcgcttttacaaagacttcatgacagccggcaatgaaattttggaatcaaagcttatggacgaccatcgtctgtacatacatatccatgcatacatacactgtgcacatcggttttgtctgttatatgtaccgtatagtccaatgtgctagtgttgtaaatggattatataattgagatttttatagaggcgatacgatttaattttccacg

SEQ ID NO: 26218 - protein, 340 aa, Panicum virgatum
  misc_feature: Ceres CLONE 1868302
  misc_feature (97)..(157): Pfam Name: WRKY Pfam Description: WRKY DNA -binding domain
  misc_feature: The sequence is a functional homolog of SEQ ID NO 885 in the 10/666,642 US patent application
  misc_feature: The sequence is a functional homolog of SEQ ID NO 886 in the 10/666,642 US patent application
  misc_feature: The sequence is a functional homolog of SEQ ID NO 887 in the 10/666,642 US patent application
  misc_feature: The sequence is a functional homolog of SEQ ID NO 154 in the 10/666,642 US patent application
  misc_feature: The sequence is a functional homolog of SEQ ID NO 236 in the 10/714,887 US patent application
  misc_feature: The sequence is a functional homolog of SEQ ID NO 236 in the 11/435,388 US patent application
  misc_feature: The sequence is a functional homolog of SEQ ID NO 1594 in the 10/374,780 US patent application
  misc_feature: The sequence is a functional homolog of SEQ ID NO 1640 in the 10/412,699 US patent application
MLPAAAATVPAGLQFVDPRMAPAVRAPAALDGGDRGDSDGGSGSAGEADRQNSGRSARQEEGSGTPEHDEVSAERAAEAPLRRVRVSVRARSEAPMISDGCQWRKYGQKMAKGNPCPRAYYRCTMATGCPVRKQVQRCAEDKAVLITTYEGTHNHQLPPAAAAMAKTTSSAAAMLLSGPAASRDAGALFAGHHVAAPLFQSSYPYASAAMGATLSASAPFPTITLDLTHPPAPASAAAGLLPHRPPALPALPFPMYGGFPAARRPAVPPQPATVSVGLMDGRNRSALETMTAAITSDPNFTAALAAALSTIIGGGAEAAPRSGAGASDGDGNNSGSGGGH

SEQ ID NO: 26219 - DNA, 764 bp, Panicum virgatum
  misc_feature: Ceres CLONE 1868322
  misc_feature: Encodes the peptide sequence at SEQ ID NO. 26220
acacacctgccgagtgccgaggtgccatccccagcagctccaatccttccgtccatctcgatccccagcccaagaagctagctctcggccatggccaccaccgcgtcgaccctcctcaaatcctccttcgccggcgcccggctcccggccgccccgcgcgccccgtcctccgtcgccgtggcgaccccccgcgccgccgggcccatctgcgcctccgcctccgcctccgcctctgcctcctcctccaccccgccctacgacctcacctccttccggttcagccccatcaaggagtccatcgtcgcccgcgagatgacccgccggtacatgaccgacatgatcacccacgccgacaccgacgtcgtcatcgtgggcgccggctccgcggggctctcttgcgcgtacgagctctccaaggacccctccgtcagcatcgccatcgtggagcagtccgtgtcccccggcggcggcgcctggctcggcgggcagctcttctcggccatggtggtgcgcaagcccgcccaccgcttcctcgacgagctcggcgtcgcgtacgacgaggccgaggactacgtggtcatcaagcacgccgcgctcttcacctccaccatcatgagccgcctcctggcgcgccccaacgtgaagctcttcaacgccgtcgccgtcgaggaactcatcgtcaagcagggccgcgtcggcggcgtggtcacgaactgggccctcgtctccatgaaccacaacacccagtcgtgcatggacccaac

SEQ ID NO: 26220 - protein, 224 aa, Panicum virgatum
  misc_feature: Ceres CLONE 1868322
  misc_feature (63)..(224): Pfam Name: Thi4 Pfam Description: Thi4 family
MATTASTLLKSSFAGARLPAAPRAPSSVAVATPRAAGPICASASASASASSSTPPYDLTSFRFSPIKESIVAREMTRRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIMSRLLARPNVKLFNAVAVEELIVKQGRVGGVVTNWALVSMNHNTQSCMDP

SEQ ID NO: 26221 - DNA, 581 bp, Panicum virgatum
  misc_feature: Ceres CLONE 1868335
  misc_feature: Encodes the peptide sequence at SEQ ID NO. 26222
actctcggaaccctagtccccctcccatccccggccgccacagttccccgtctcgtccgcgcctccggccctcgcgaagcgcctcctcaaccgccgggagtgagaagagatggagggcgagggcgacggggcggcgatgggcatcgacctcggcaccacctcctcgtgcgtcggagggcgggagcacgaccgcgtctagatcaccgcctactaccatcggaaccgcaccacccccgcctgcctcgccttcaccgactccgagcgcctgatcggagatgccgtcaagaaccaaggccgcctgagccccatcaacaccgactttgatgccaagtctcgcatctgcaggaggttcactgatgcttctgtccgtagtgatgtcgcgctctggcgcatccagggcattgctggacctggtgagcagcccatgattgttgtccagcgcaaggctgaggagaagcagtttgcccctgaggacatttcatccatggttctgatcaacatgcgcgagagtgctgaatctgaccttggcagcactagcagcaacgctgtggtcacagttcccgtctacttctttgactccc

SEQ ID NO: 26222 - protein, 52 aa, Panicum virgatum
  misc_feature: Ceres CLONE 1868335
  misc_feature: Useful for making plants with modulated drought sensitivity
  misc_feature: Useful for making plants with modulated heat sensitivity
MIVVQRKAEEKQFAPEDISSMVLINMRESAESDLGSTSSNAVVTVPVYFFDS

SEQ ID NO: 26223 - DNA, 2754 bp, Panicum virgatum
  misc_feature: Ceres CLONE 1868345
  misc_feature: Encodes the peptide sequence at SEQ ID NO. 26224
ccgcctcctcccctcctctcccatctgtggcggctatcccctcccgtcttcctctccgccctccttggctagggtttatcctctgccaccgcctctccccaccaccataaacaattttgttacccaattgcgcctctcggcccgcgccgcccctcaccttctgccgccgccccgtcccccgatagccgccgccatcgccccggcctgcggatccgcggttgcacctcctagacggccggctcggccgccgctgccccggactcctctcgctgctatcgccccaagctcgccttcctcgacgtccgcaccctccccttccatcgacgccccacaatcaaaatcaaaataaaaaagaagctgaaggatctgccatggcgactgttgctcctgccccgaccgttgccgaccaggccaccaatctcatgcagaagctgtctctggagagcaagaaggatggttccagcgctgccaaaaagccttctgggttgccatatggatctgccaatgctggagatgcgcagagtgctgcttcgcaggtggacaggtcgataactcctctacttcaagaggccatggatcctaacttcttctatcagcccagtggatatgcctctccagcctattactatcctagtggttatgatggctcagccaatgagtgggactcaaggtatgctggtcatgaaggaatggagatgccccctcagagtgtgtacggcgacatataccatggatatggctatgctccatacggcccatatccttcgggttctcccgtaccaagtgctgggcatgatgtccagtcatatggctctcagcaatatcagtacccgactcaatattatcagccaccaacctctgcaaatgcaacccatggtgtaaatggtgccagttctcaacctgagctgccttctgttgttaatcaacagacacgtgttttggtagatgcaacaaaagcaagtccaaacggtatgccgactgctaacaacagctcgctgccacgtaagcagacccacctgaatgtaccagtagcgagcaatggttcatatggaagaggacctatgcaaggtggcggaccttctgcaagcaattatggtcacagtggtcttcgttctccagctcaatggtacgatgggccagtttactcaaatgggcatcaaagaccaactgccagttccacatcttaccgttccaattcatcttctgcgaaaaatcagagccagcatccaacaacaaacctcatgggtatgcatgcgcagatgccctcgtctgggatgggtctgacctcacctagctatccttctaggatataccccgacaacagattatttggacagtatggtcagtacggaaacacgctgaaaggtgggcttggttttggatcaaatgtgtataactcaagaaacaatggaaggtggggagtcgtggatacaaaatacaagcctagagggcgtgcaccttttggttttggtggtgagaatcaagatggctttaccgagctgaacagaggaccaaggtctggtggtttcaagcaccagaaacagtttgggcctactgtcactattgccgtgaagggccaggccctcccttcagctggaaaacagaacagtgctcttccagacaaaggacaatataaccaggaaggatttcctgtagcctacaaggatgcaaaattcttcgttatcaaatcatatagtgaagatgatgtgcacaagagtattaaatacaatgtgtgggctagcacccctaatggaaataagaagctggatgctggataccgagaggctcaggagaaatccagtgactgcccagtgttcttgtttttctctgtgaacacaagtggtcagtttgtcggtgttgctgaaatggttggccctgttgactttgataagactgtggagtattggcaacaagacaagtggaatggttgttttccactcaagtggcacatagtcaaggatgtgcccaacaacatcttgaagcatattacgctggataacaatgataataagcctgttacaaacagccgtgacacacaagaggttaagcttgagcaaggtcttgaaatgttgaagattttcaaagaacatgttagcaaaacctcaattttggacgattttggtttttacgagaatcgccaaaaattgatgcaggaaaagagagcaaatcagcaatcacttcaagggcagacgagcgatgtttctcaagagaaagacaaggatgctactgatgacaaaccaggggcacagaaacatgtattgagcaaggaaggcgctcttgctgaggaagcggcgaatgcctccaaacctgtagctgaaagtggtgtatcaaatggcaactaatcgtcacatgtcacctacccgttgccttggctggcaaacgatcttgcaaatgctgcaggttttgtggtatctgcaaattattaagatatattaattactgcctgaatcatggacctggtttggtactggagttcgttggctggggctcatcctgggagtgagtcagttttacttcaattttctgttatagttgtgtgaccggtttttcgtgttccgctacctgtgctaggtcttttacaaccctgtgacattgggtttgttgtaacccttgcttttcttttttgccctttctcttagctctattattgttagtgaagcagcgatttctatacttctggaaaacattaaggtagtttttttggcgtgttgtggtactgctagagagtaataaaacaagactctgtagatgcct

SEQ ID NO: 26224 - protein, 656 aa, Panicum virgatum
  misc_feature: Ceres CLONE 1868345
  misc_feature (483)..(573): Pfam Name: YTH Pfam Description: YT521-B-like family
MATVAPAPTVADQATNLMQKLSLESKKDGSSAAKKPSGLPYGSANAGDAQSAASQVDRSITPLLQEAMDPNFFYQPSGYASPAYYYPSGYDGSANEWDSRYAGHEGMEMPPQSVYGDIYHGYGYAPYGPYPSGSPVPSAGHDVQSYGSQQYQYPTQYYQPPTSANATHGVNGASSQPELPSVVNQQTRVLVDATKASPNGMPTANNSSLPRKQTHLNVPVASNGSYGRGPMQGGGPSASNYGHSGLRSPAQWYDGPVYSNGHQRPTASSTSYRSNSSSAKNQSQHPTTNLMGMHAQMPSSGMGLTSPSYPSRIYPDNRLFGQYGQYGNTLKGGLGFGSNVYNSRNNGRWGVVDTKYKPRGRAPFGFGGENQDGFTELNRGPRSGGFKHQKQFGPTVTIAVKGQALPSAGKQNSALPDKGQYNQEGFPVAYKDAKFFVIKSYSEDDVHKSIKYNVWASTPNGNKKLDAGYREAQEKSSDCPVFLFFSVNTSGQFVGVAEMVGPVDFDKTVEYWQQDKWNGCFPLKWHIVKDVPNNILKHITLDNNDNKPVTNSRDTQEVKLEQGLEMLKIFKEHVSKTSILDDFGFYENRQKLMQEKRANQQSLQGQTSDVSQEKDKDATDDKPGAQKHVLSKEGALAEEAANASKPVAESGVSNGN

SEQ ID NO: 26225 - DNA, 2606 bp, Panicum virgatum
  misc_feature: Ceres CLONE 1868352
  misc_feature: Encodes the peptide sequence at SEQ ID NO. 26226
aatatttcaaaggccctaggcctggctctcgcctgcgccctactcggcttctccccaccacttcccctcccctcccccgcctacaacccaaccagccagccagccaccccagccattcatggccatcaccaccatgtgtcgccgccccacctgcgcctccgcctccactccccacccactcctccccccgcgccattaagccccgggtcgcgctccgtccgtcgacgcatcgggcgcttctgctggttgctcgttccgtagagccgaccggggcggggcgctgctagctgcggcctgcgggcggccatggcgggcatcgacctcaacaccgtcgagggggaggaggacgaggaggaggcggaggcgccgccagcggagagggcgggcggcgcggtgtgcctggacctgtggcacgcgtgcgcggggcccgtcgcgccgctgccgcggaagggcagcgccgtcgtgtacctgccgcagggccacctcgagcacgtcggcgccgacgcggcgccgcctgcggcggtgccgccgcacgtcttctgccgcgtcgtcgacgtcaacctccacgtgagtggttcgcgtgcgcgcgcgcgcgcggcttcggtcgcgcggcacggtgcccgcgagcgcaatgtgctcgaggtattgactgacagagagagagagagcttcgttttcgtgcaggcggacggcgcgacggacgaggtgtacgcgcgggtgtcgctgctgcccgaggacgaggaggcggagaggcgtgcgcgggcgcgggtccgggaggacgaggacgcggctcgcgacggcgagggcgggggcgccacgaagccgctcgcgcggacgccgcacatgttctgcaagacgctcacggcctccgacaccagcacgcacggcggcttctccgtgccgcgccgcgccgccgaggactgcttcccgccgctggactacagcctgcagaggccgtctcaggagctcgtggccaaggatctgcacggcacggagtggaagttccgtcatatctatcgaggccaaccacgaaggcatctcttaaccactggatggagcgcatttgttaataagaagaagctggtctctggagatgctgttctattccttcgtggtgaagatggagtgcttcgattgggagttcgccgagcagcacagcttaaaaacgtaaatcttattcctgcgctgcataaccagtgctcaaatcataggaatctgggaaatgtcacacaagctgtggccttgaggactgtttttcacatctgctacaatcccaggctaagccaatctgaattcattgtaccctattggaagttcatgagaagcttcaatcaaccattttctgttggaatgagatgcagaatgagatatgaaagcgacgatgcttctgaaagaaggtgcactgggataataattggaagcagagaggcagagcgtatgtggcatggttcaaaatggaaatccttggtggtcagatgggatgatgatatagagtgccgtcggtccaatagggtttctccttgggagattgagcttacaggatcagtttcaggatctcaatcccatctgtgcgctccaaattcaaaacgtctgaaaccatgcctcccccaagttaacacggagatcatgcttccatatggaagcgtttcttcagattttgcgggatctgccagattccacaaggtcttgcaaggtcaagaatttttgggtttcaaaacccatgatgatactgctatttcagcttcgcaggcaactgaagcaagaaatttgcagtatagtgatgatcatagtagctctatcaacaagagtaacaatatcttaggggttccaagatttggtgttagatctccaactggaacccctgggtttccctaccattgctcaggctttggagaatcacaaagattccaaaaggtcttgcaaggtcaagaagtgtttcgtcctttccgaggagatttggctgatgtccatataaggactgctggcatgtatcaacctgactgtatgcatgcaactggtgcagcttataaatggcctacactgcaagggtgtgactttcgacagccaacaaaaccagttctgttgcaagcatcctccccatcatctgtgctgatgttttcacaaactagttctaaggtacctcacttggagtatgagtacagctgcctgggtaaggatgaggatggtagaaatgatagggctgtccctactcaagacatgggaagaagcaaccaagcattatccctttggcctcatcttgtttcaggcgaagccatagatgaatgtactggaactgagaagatgcactcccctgtcagtgatgcagagcatgaatcaaacaatgagagtaccgttgaaaatggatgcaaaatctttggtatctcattggctgaacaggtccgatcatgtgatgaagcagactcttgcaatgcaaattgtaattctcggctccagccttcacagccacaaatatcaaaatcactaggcagctgttgggccactgttcatgagcaaaggcctgttgttggcagggtggttgacgtctcgctggtggatatggtttgatccatccggcttatccatgtagaagatgcagaaaggattac

SEQ ID NO: 26226 - protein, 752 aa, Panicum virgatum
  misc_feature: Ceres CLONE 1868352
  misc_feature (307)..(388): Pfam Name: Auxin_resp Pfam Description: Auxin response factor
  misc_feature (180)..(285): Pfam Name: B3 Pfam Description: B3 DNA binding domain
MAGIDLNTVEGEEDEEEAEAPPAERAGGAVCLDLWHACAGPVAPLPRKGSAVVYLPQGHLEHVGADAAPPAAVPPHVFCRVVDVNLHVSGSRARARAASVARHGARERNVLEVLTDRERESFVFVQADGATDEVYARVSLLPEDEEAERRARARVREDEDAARDGEGGGATKPLARTPHMFCKTLTASDTSTHGGFSVPRRAAEDCFPPLDYSLQRPSQELVAKDLHGTEWKFRHIYRGQPRRHLLTTGWSAFVNKKKLVSGDAVLFLRGEDGVLRLGVRRAAQLKNVNLIPALHNQCSNHRNLGNVTQAVALRTVFHICYNPRLSQSEFIVPYWKFMRSFNQPFSVGMRCRMRYESDDASERRCTGIIIGSREAERMWHGSKWKSLVVRWDDDIECRRSNRVSPWEIELTGSVSGSQSHLCAPNSKRLKPCLPQVNTEIMLPYGSVSSDFAGSARFHKVLQGQEFLGFKTHDDTAISASQATEARNLQYSDDHSSSINKSNNILGVPRFGVRSPTGTPGFPYHCSGFGESQRFQKVLQGQEVFRPFRGDLADVHIRTAGMYQPDCMHATGAAYKWPTLQGCDFRQPTKPVLLQASSPSSVLMFSQTSSKVPHLEYEYSCLGKDEDGRNDRAVPTQDMGRSNQALSLWPHLVSGEAIDECTGTEKMHSPVSDAEHESNNESTVENGCKIFGISLAEQVRSCDEADSCNANCNSRLQPSQPQISKSLGSCWATVHEQRPVVGRVVDVSLVDMV

SEQ ID NO: 26227 - DNA, 632 bp, Panicum virgatum
  misc_feature: Ceres CLONE 1868367
  misc_feature: Encodes the peptide sequence at SEQ ID NO. 26228
agccagctcccagctctcctctcacactgctccactccctcacctagaagagaccacagaaccggatccagagcagagcgtgttgcgccggcctagctcttgggtcgtcaagtctccgttcgttctttctttctccaaccggcagctgatctcctgtgttaatcccgaccggagctgcctgcgatgggcatcgtcgacgtcgtctccgtgttctgcaccctgccgaggactcgccggcacctcaagaagaggaagcagttccagacggtggagatgaagatgcggatcgactgcgaggggtgcgagcgcaaggtgagcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggagtagctagtagccggggaggagtagtagatagagtagcaagttgctgctggtgtttgttgctgttggatcattttttttcctactttatattctctgcg

SEQ ID NO: 26228 - protein, 115 aa, Panicum virgatum
  misc_feature: Ceres CLONE 1868367
  misc_feature: Useful for biocontainment applications
MGIVDVVSVFCTLPRTRRHLKKRKQFQTVEMKMRIDCEGCERKVSKRVEPWPYVPYDVVAHPYAPGAYDKKAPPGYVRNVVADPAAAPLARASSTEVRYTAAFSDENPNAACAVM

SEQ ID NO: 26229 - DNA, 2081 bp, Panicum virgatum
  misc_feature: Ceres CLONE 1868370
  misc_feature: Encodes the peptide sequence at SEQ ID NO. 26230
actcgcccctcgtctttattccccacgccgcgccgcgctgctcgaaacaattccaaatctccatcccatcctgttgctccttgtgcttgagctcaactgctactaccagtagaaatagaagtatacgaccagaacccagcgatccacaaataaatttgtattgctggcctcgatcgagtcgtcggccaattggttattggtgggggcagagcatcgcccacgcccaatcatccgcccccaatccccaaaagcacccacccctctcacggacgcgcgagatcccacgcgcaccaccatcccccggcggattccctccttccgcggtggtggtggcctccggtggaggctggcgcgggcgagcgagcgagcgatggacgcggcggcgaagaagatgacgcggggcatctcgcggcagctctcgtcgggggcggcgcggctatggcgccagctgtcgctggaccagcacaccccgcggcgcggcgggccgggcgcgggggccgggccgacgcggttcgcgatcgcgaggcagtcgtcgctcgacccgacgccgcggggcgggccggaccggtcgtcggcgcaccagcagctcgcggtgccggagaacctggacgccacgatgcgcctgctcttcgcggcgtgccagggggacgccgccggggtggaggagctgctcaggggcggggtggacgtcgacagcatcgacctcgacggccgcacggcgctgcacatcgccgcctgcgagggccagggggaggtcgtgcggctgttgctcgactggaaggccaacatcaacgcccgcgaccgatggggaagcacgccagcagcagatgcgaaacattatggccactttgaagtatataaccttctgagagcaagaggagcaaaagttccgaaaaccaaaaagactccaatggccgtgtcaaatcctaaagaggttccagagtatgaactgaacccacttgaacttgagttccgaagaggggaggaggtcacaaagggtacctatctggcgaaatggtatggctcaaaagtgtttgttaagatacttgacaaagacagcttctcggatgcagatagcataaatgcattcaaacacgagcttaccttacttgaaaaagcacgacacccaaatttggtccaatttgtgggagctgtcacacaaaatgtaccaatgatgattgtttccgagtatcatcaaaagggtgatttagcaagttatcttgagatcaaaggtcgcctgaagtctcacaaagctataagatttgctcttgacattgcgaggggactgaattatctccacaagtgcaaacctgagccaatcattcatggaaatttgtcaccaaaaaacattgtgcgggacgatgaaggacaacttaagttggccggttatggatcactgaatttgattaaagtctccgaagataaactacaaatggctcagccagtgacacaattagacaatatctacactgctccagagatctacaggcacgaaccatttgacagaagtgtagatgtatttgcattcggtctcattctttatgagatgatcgaaggaaatcatgctttccacccgaagtcacaagaggaagcagctaagatgatttgtttggagggactgagaccaccattcaagaataaacccaaaaactatcccagtgatgtgaaagagctgattcaagaatgctgggatctggtgccttccgtgaggccaaccttcgcggagataattgtgcggctgaataagatacacgcgagctgcgctaagcaggctcgttggagagacaccttcaaacttccatggaaacatgctggagatagatagctgtaaagacataaagttctgcgaggccgtccgccgtagtcaaagatttcctcccttccgtttagcaaaagcaaatgtgagtaaactcgagtgagaaatcgcaccgagttacgaagtagaagtagaagtagttccttctcaggttctttacgctcccaaaaggagaatacagtttgtgtagcctgtatgactgtctaggcttatgcctccggcccaatttctcttgagctgtcttcatccaaactggaacaccccg

SEQ ID NO: 26230 - protein, 484 aa, Panicum virgatum
  misc_feature: Ceres CLONE 1868370
  misc_feature (201)..(457): Pfam Name: Pkinase Pfam Description: Protein kinase domain
  misc_feature (113)..(145): Pfam Name: Ank Pfam Description: Ankyrin repeat
  misc_feature: SWISSPROT Homolog: EC 2.7.10.2 Non-specific protein-tyrosine kinase
MDAAAKKMTRGISRQLSSGAARLWRQLSLDQHTPRRGGPGAGAGPTRFAIARQSSLDPTPRGGPDRSSAHQQLAVPENLDATMRLLFAACQGDAAGVEELLRGGVDVDSIDLDGRTALHIAACEGQGEVVRLLLDWKANINARDRWGSTPAADAKHYGHFEVYNLLRARGAKVPKTKKTPMAVSNPKEVPEYELNPLELEFRRGEEVTKGTYLAKWYGSKVFVKILDKDSFSDADSINAFKHELTLLEKARHPNLVQFVGAVTQNVPMMIVSEYHQKGDLASYLEIKGRLKSHKAIRFALDIARGLNYLHKCKPEPIIHGNLSPKNIVRDDEGQLKLAGYGSLNLIKVSEDKLQMAQPVTQLDNIYTAPEIYRHEPFDRSVDVFAFGLILYEMIEGNHAFHPKSQEEAAKMICLEGLRPPFKNKPKNYPSDVKELIQECWDLVPSVRPTFAEIIVRLNKIHASCAKQARWRDTFKLPWKHAGDR

SEQ ID NO: 26231 - DNA, 1673 bp, Panicum virgatum
  misc_feature: Ceres CLONE 1868378
  misc_feature: Encodes the peptide sequence at SEQ ID NO. 26232
aaaaatcctcctccctcccatttcaaaacctcctccccttcccccatttccgcagaggcctgcttgtcaccttcccaatccctcctcccccacccccggaccccagcagcaggagtgctcgccaccatgtctcccaccaccaccccgtcccccgcgcccgcggcggcgccgtcctccaagggcgccaagcgcagcctcatgtcctcgctcatggacgccaccgcgctgctccgctccgcctccttcaaggaggactcgtacgtcgccgccgcgctcccgccctcggagctccgcgcgctcgccgacctcaaggcgctgctcgccaggcacccggaccccatcgccatctggggcgtcccgctcaacagccctcccgcggcggccgacggcgctgccgcagccgcctctcctccggtggacgagcgcgccgacgtggtgctcctcaagttcctccgcgcgcgcgacttccgcgtccgcgacgcgcacgccatgctgctgcgctgcgcggcgtggcgcgccgagttcggcgccgacgcggtgctggacgaggacctgggcttcaaggacctggagggcgtcgtcgcctacatgcacggctgggaccgcgagggccaccccgtctgctacaacgcctacggcgtcttcaaggaccgcgccatgtacgagcgcgtcttcggcgacggcgaccgcctcgcgcgcttcctccgctggcgcgtccaggtcatggagcgcggcgtccgggcgctcagcctcaggccgggcggcgtcaacgccatcatccaggtcaccgacctcaaggacatgcccaagcgagagctcagggccgccagcaaccagatcctctcgctcttccaggacaactacccggagatggtggcgcgcaaggtgttcatcaacgtgccgtggtacttctccgtgctcttctccatgatctctccattcctcacggagcgcaccaagagcaagttcgtcatcgcgcgcgagggcaacgtcgccgagacgctctacaagttcatccggccggagctggttcccgtgcagtacggcgggctgagccgcgccggcgacctcgagaacggcccgcccaagccggcgtccgagttcaccatcaagggcggcgagaaggtcttcctggagatcgacggcatcgaggccggcgcgacaataacgtgggacctggtggtcggcggctgggacctggagtacggcgcggagtacgtgccggcggccgaggggagctacacgctgtgcgtggagaagacgaggatggttccggccgccgccgaggagcctctaaacaatgccttcacggcgagggaggccggcaagatggtgctgtccatcgacaactccggctcccggaagcggaaggtcgccgcgtaccggtacttcgtgcgcaagccgtcggcgtagtgctcggtgttccagtggcggtggctggcagcttgccggccggcggtggcgacgggagttcgacatgggacggacggagaactgcttgcttgcatgctggggctttgttgtggtcttgttggaggggagaagttaaggttagggctacttaattactagtgctataatgacatgcatgtattatgccatatgtagaatataatgtaagagctgttgaacttttgtcatcaccaccgttataaagctaatgagttcatttt

SEQ ID NO: 26232 - protein, 428 aa, Panicum virgatum
  misc_feature: Ceres CLONE 1868378
  misc_feature (152)..(336): Pfam Name: CRAL_TRIO Pfam Description: CRAL/TRIO domain
  misc_feature (76)..(138): Pfam Name: CRAL_TRIO_N Pfam Description: CRAL/TRIO, N-terminus
MSPTTTPSPAPAAAPSSKGAKRSLMSSLMDATALLRSASFKEDSYVAAALPPSELRALADLKALLARHPDPIAIWGVPLNSPPAAADGAAAAASPPVDERADVVLLKFLRARDFRVRDAHAMLLRCAAWRAEFGADAVLDEDLGFKDLEGVVAYMHGWDREGHPVCYNAYGVFKDRAMYERVFGDGDRLARFLRWRVQVMERGVRALSLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRAGDLENGPPKPASEFTIKGGEKVFLEIDGIEAGATITWDLVVGGWDLEYGAEYVPAAEGSYTLCVEKTRMVPAAAEEPLNNAFTAREAGKMVLSIDNSGSRKRKVAAYRYFVRKPSA

SEQ ID NO: 26233 - DNA, 630 bp, Panicum virgatum
  misc_feature: Ceres CLONE 1868383
  misc_feature: Encodes the peptide sequence at SEQ ID NO. 26234
aatctagcccctcgtctctatgtccactcctaacagtcccctacccggcccgtgagcgagcctcccccaccgcatctatcgtctccttctttggagatcccactcaccctggcggcgatgaccggcgatgtgtctaagctggcggcgccccggacggtggcggcactgctcccgccggtgtccctccgctccgccgccctcgccttcgccccctcctcgcgtcggttctgcgtctccatcgccggccgcggcaggagccccgtcattgcgatgggttctgccacaggaagggaatggtgctccgaccaagaaaaccgcacttcactatttctatgagctccagggcctgtcaccatggtacgacatcctctgcaggcctgtcaccgacttgctgccccttatcggcagtggtgttcgcggagtcaccagcaaccctacgattttccagaaagccatttgatcatcaagcgcatatgatgatcaattcaagcacctcattacagttggaaaggatgctgagagtgcttactgggaactcgttataaaggatataccacatgcgtgtaaactttttgagcctatctacaacaagacagatgctgctgatgggtatgtctctgtggaggtgtc

SEQ ID NO: 26234 - protein, 110 aa, Panicum virgatum
  misc_feature: Ceres CLONE 1868383
  misc_feature: SWISSPROT Homolog: EC 2.2.1.2 Transaldolase
MCLSWRRPGRWRHCSRRCPSAPPPSPSPPPRVGSASPSPAAAGAPSLRWVLPQEGNGAPTKKTALHYFYELQGLSPWYDILCRPVTDLLPLIGSGVRGVTSNPTIFQKAI

SEQ ID NO: 26235 - DNA, 631 bp, Panicum virgatum
  misc_feature: Ceres CLONE 1868386-R
  misc_feature: Encodes the peptide sequence at SEQ ID NO. 26236
tacaaaataggaatatgccagacgatgctgcaaggatatacaagaagatgatcaagaagggacttgagcccacaatcaatacttacaacatgatgatgaagtcatatttccttggtggtaggaactacgcaatgggttgtgtggtgtgggaggagatgcaccggaagggtatctgtcctgatgtgaactcctacacggtgttcattaatgggcatatacggcatggcaggccagagacggcatgtaaatatatcgaggagatgatcaacaaagggatgaaggctccgcagatagactataataagtttgctgcagatttctccaaggctgggaatccagacatattgtatgagttggttcagaaagtaaaatttgccgggaaatttgatgcttctaatgtgttccatgagtgggcagagagaatgaagagtcgggtcaagagaactatcccaaatcagaccggtaacagaatgttctaagattactatgttgtcagcaggaatgtggtattgtcatggtgcttttaaatttgattatttaggatagctcatagctgctaccttttttttctctctctggtgtatagtaatgtgccatttaagatacattcttgaatatttgttagaacgac

SEQ ID NO: 26236 - protein, 158 aa, Panicum virgatum
  misc_feature: Ceres CLONE 1868386-R
  misc_feature (62)..(96): Pfam Name: PPR Pfam Description: PPR repeat
QNRNMPDDAARIYKKMIKKGLEPTINTYNMMMKSYFLGGRNYAMGCVVWEEMHRKGICPDVNSYTVFINGHIRHGRPETACKYIEEMINKGMKAPQIDYNKFAADFSKAGNPDILYELVQKVKFAGKFDASNVFHEWAERMKSRVKRTIPNQTGNRMF

SEQ ID NO: 26237 - DNA, 715 bp, Panicum virgatum
  misc_feature: Ceres CLONE 1868386
atggccgttaaactcgtaccaaccgccgccgccgccgccctccatggagaccagcaagtcgccaccgctttactcgccgccgcgggagccctccgcggcgacggtgatgctgtgcccgtgcctggtgttctttcttctcgtcctcatcatcgtctccatcgccctcactgtccacttccgcctctactgccacacacctctcgcccacctcatctccccccaccgctgcccccaccgcatctgacctccggctcctcctgtggcggccgccaccgcggcgctggcgtggtcccgcttgcttactgcgcgatccctcagctgtcggcgagatcccgctccctctcaggttcccctctccttgcgccgccggcaagccgggctaccgacccgctcttgggctttcccgccgcaaggtgcctctcctcctcggctgcctccgacgtcgacgacaacgagggcgcttcgtcggagcaggatgtggtggcagcgtcgtgccaccaggaacacgtgagacgcgtgtgcgcggccatcgcggacgtggtcgccgccggggccgacgcgaacctggaggcggcgctgtccgccctctcgccgccgctctccgaggcgctcgtgctcgcggtgctcgaccgcttcaagcacgctcacaagccgtcccaccgcttcttccggtgggccgccgcgtccggcggcttcgctcacccaccatcaccta

SEQ ID NO: 26238 - DNA, 742 bp, Panicum virgatum
  misc_feature: Ceres CLONE 1868397
  misc_feature: Encodes the peptide sequence at SEQ ID NO. 26239
gtttttttcgctgcagattttggctgcggcgccgcgtcctctgcggttctgtcccccatgcttcaccaccaacccaacccaagagctgatctttgcggataacaggggaggctgataccctgtccggcggctcggttctgagctggactgaactgaactggagagagagcacagtccggaatatgtttggtttctcgcggcgccgggtgaaacttggaaggttgaagggtgaccataatgattctttgaatagctccaggagtcttggtggccccacgaaacagctcagcctacctaatggggatgacgctgctacaacatcagtgagcggccgtgcagatgatctttcctaccgctgctcttcagatactttcaatctcgacagtcgttctttcaatatttctgaaaactggactgtgttgtccacagagggagacaaacctattcctcgtttctatcatgcagcggccattgtaagtagcaagatggtagtgtttggtggtgattctggtcgtcacttattaaatgatacaaagatactgaatttagagaagcttagctgggattctgcaccgcctaaagttcggccatcaccaagtggacgttctaccaagttgccagcctgcagaggtcattgtctggttccatgggaaaatagtgtcattcttgttggaggtaaaactgagcctgcttctgatcgtttatcagtatggattttcaatactgaaacagaacttttggt

SEQ ID NO: 26239 - protein, 186 aa, Panicum virgatum
  misc_feature: Ceres CLONE 1868397
  misc_feature (89)..(134): Pfam Name: Kelch_2 Pfam Description: Kelch motif
MFGFSRRRVKLGRLKGDHNDSLNSSRSLGGPTKQLSLPNGDDAATTSVSGRADDLSYRCSSDTFNLDSRSFNISENWTVLSTEGDKPIPRFYHAAAIVSSKMVVFGGDSGRHLLNDTKILNLEKLSWDSAPPKVRPSPSGRSTKLPACRGHCLVPWENSVILVGGKTEPASDRLSVWIFNTETELL

SEQ ID NO: 26240 - DNA, 364 bp, Panicum virgatum
  misc_feature: Ceres CLONE 1868408
  misc_feature: Encodes the peptide sequence at SEQ ID NO. 26241
ctcatcactccaccatccaagtacccacatcaatccttccattccatttccatcaccaccagccatctgccggctgcgctcttatcgccccatcccctatacgctatgagcgtacgtcttgatggattttccaccatgggcggattttctcggcgcggcgctcgccaccgtgatgtttctctaggccgtcctcgcgcccgccgcgggcgccgcgtgtacaacctcccgccggggcccaagtcgtggtcgatcatcggcaacctcgacctgatgggggcgctctcgcaccgctccttccacaagctgtcaaggaactcccgaccgctgataccgctcccgttcgaggtccttccccgtgttcctc

SEQ ID NO: 26241 - protein, 76 aa, Panicum virgatum
  misc_feature: Ceres CLONE 1868408
  misc_feature (30)..(59): SWISSPROT Homolog: EC 1.14.13.88 Flavonoid 3',5'-hydroxylase
  misc_feature (30)..(75): SWISSPROT Homolog: EC 1.14.13.68 4-hydroxyphenylacetaldehyde oxime monooxygenase
  misc_feature (29)..(59): SWISSPROT Homolog: EC 1.14.13.71 N-methylcoclaurine 3'-monooxygenase
MGGFSRRGARHRDVSLGRPRARRGRRVYNLPPGPKSWSIIGNLDLMGALSHRSFHKLSRNSRPLIPLPFEVLPRVP

SEQ ID NO: 26242 - DNA, 1910 bp, Panicum virgatum
  misc_feature: Ceres CLONE 1868410
  misc_feature: Encodes the peptide sequence at SEQ ID NO. 26243
aacctccagatccaatcgaccatcgccgccgcaaccatgggcttcgacgtgggcgtcgtcccttccaaccccgacggatggggccctcctgacgtgcccgcgattccgcagtccctgggcggcggcgcctccatccccttcgcgcccttctcccgctccgacaagctggggcgcatcgccgactggacgcgcaaccccgctggccccgccgccttcgccgcggcttcacgcgactccgtcttcgacttcacctccgccgacgactcgctcgtcgccggggccgaggactcctcgttccgcctcgtcgacgccaagccgccgccgcgccagcctcggttcggccccaagtggcgcttcaaccagcgcccgcagctcccccagcgccaggacgaggaggtggaggcgcgccgccgcctggccgagaaggagcgcgcccgccgggaccgccacttccagaacaaccgctcacaccaccaccccggcttccggggcaaccagtcctcgtcgtcggccaagccctccgtcgacatccagcccgactggaccatgcgtgagcagatccccttcgccaacttcaccaagctctccttctccgtcaccgaccagcccgaggacctcctcctctgcggcgctgtcgagttctacgaccgcgcctatgaccgcgtcaaccccaaggccccgcgccgtctcgagcggttcaagtcccgcaacttcttcaaggtcaccaccaccgacgatcctgtcatccgccgcctcgccgaggaggacaaagccacggtgttcgccactgatgccatcctcgccgcgctcatgtgcacgccgcgcagcatccaatcatgggacattgtcgtccagcgcgtgggcaacaagctcttctttgacaagcgtgatggctcccagcttgacctgctcacagtcaatgagactgcacaggagcagctccctgagaacaaggaggacatcaactcagcgcactcactcgctgttgaggccacctacatcaaccagaacttctcgcagcaggtgttgcaccgtgaaggtgagaaggttacctttgatgagcctaacccttttgcttctgcgggtgaggaagcagcatctgttggctaccgatatcgccgctggaagctggatgatgagatcagccttgttgctcgttgtgaggtgcatgctgtcaatgctgatccaagtgggggtcgccagttccttacgctcaatgctctcaatgagtttgatcctaagattactggtgttgactggaggcagaagcttgagacccagcgtggggctgtccttgctacagagctcaagaacaatgcgaacaaacttgctcgctggactgcccaggctttgctttctggtgctgacatgatgaagttgggctatgtgtcacgtgtgcatccacgcgatcactacaaccattctgtactcactgtaatggggtacaagccaagggattttgctgcacagatcaacctcaatactgctaacatgtggggaatcgtcaagtcaattgtggacatttgcatgaagtttgaagagggcaagtatgtgtttgtgaaagatccagcaaagccacaggttaggatctatgaggtgccctctgatgcattcgagaatgattatgttgaagagccacttccagaggaggagcaggttcgcccgcttgcagatgttgatgccacggcacaagaaatggatgcagccgctgaggcagaggccaatggtgcattggttgctaacagtggtgaggatgataaggttgcagaggctactactgcttgaagggcataaaaggcttccctgtttccttcgcaagataggtctttcttttggctaattatctgttttgatggataccttgatgagttgaacttccggttattgataccattgtctcgttttggtca

SEQ ID NO: 26243 - protein, 582 aa, Panicum virgatum
  misc_feature: Ceres CLONE 1868410
  misc_feature (2)..(539): Pfam Name: eIF-3_zeta Pfam Description: Eukaryotic translation initiation factor 3 subunit 7 (eIF-3)
MGFDVGVVPSNPDGWGPPDVPAIPQSLGGGASIPFAPFSRSDKLGRIADWTRNPAGPAAFAAASRDSVFDFTSADDSLVAGAEDSSFRLVDAKPPPRQPRFGPKWRFNQRPQLPQRQDEEVEARRRLAEKERARRDRHFQNNRSHHHPGFRGNQSSSSAKPSVDIQPDWTMREQIPFANFTKLSFSVTDQPEDLLLCGAVEFYDRAYDRVNPKAPRRLERFKSRNFFKVTTTDDPVIRRLAEEDKATVFATDAILAALMCTPRSIQSWDIVVQRVGNKLFFDKRDGSQLDLLTVNETAQEQLPENKEDINSAHSLAVEATYINQNFSQQVLHREGEKVTFDEPNPFASAGEEAASVGYRYRRWKLDDEISLVARCEVHAVNADPSGGRQFLTLNALNEFDPKITGVDWRQKLETQRGAVLATELKNNANKLARWTAQALLSGADMMKLGYVSRVHPRDHYNHSVLTVMGYKPRDFAAQINLNTANMWGIVKSIVDICMKFEEGKYVFVKDPAKPQVRIYEVPSDAFENDYVEEPLPEEEQVRPLADVDATAQEMDAAAEAEANGALVANSGEDDKVAEATTA

SEQ ID NO: 26244 - DNA, 764 bp, Panicum virgatum
  misc_feature: Ceres CLONE 1868415
  misc_feature: Encodes the peptide sequence at SEQ ID NO. 26245
ggcgcaaaccattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgccgccgcgggtgccaacgaggacctcgtctacatgctgcagttcgggaacccctccgccgccgccgacgccgacgacggcgggcccaaggactgcggcgcgccgcccagcgcgcccgcctacggcgtcgctgtctacaacgtgaccacgggcgagtggctccgggagcgcggcgcgccccccgtgctgcccgtgttcgcgcagtgcgccgcggtgggcacccgcgtcgcggtgctcgggggctgggacccgcgcaccttcgagcccgtcgccgacgtgcacgtcctcgacgccgccaagggcgcgtggcgccgcgccgcgccgatgcgctcggcgcggtccttcttcgcctgcgccgaggccggcggtaagatctacgtcgccggcgggcacgacaagcacaagaacgcgctcaagacggccgaggcctacgacgccgttgccgacgcctgggacccgctcccggacatgtcggaggagcgcgacgagtgcgacggc

SEQ ID NO: 26245 - protein, 225 aa, Panicum virgatum
  misc_feature: Ceres CLONE 1868415
  misc_feature (172)..(218): Pfam Name: Kelch_1 Pfam Description: Kelch motif
  misc_feature (15)..(62): Pfam Name: F-box Pfam Description: F-box domain
MRSPRGGGRAHEHVDLIPGIPDDVAVDCLARVPHASHRALRRVCRGWRSAAAAPAFAAARAAAGANEDLVYMLQFGNPSAAADADDGGPKDCGAPPSAPAYGVAVYNVTTGEWLRERGAPPVLPVFAQCAAVGTRVAVLGGWDPRTFEPVADVHVLDAAKGAWRRAAPMRSARSFFACAEAGGKIYVAGGHDKHKNALKTAEAYDAVADAWDPLPDMSEERDECD

SEQ ID NO: 26246 - DNA, 1861 bp, Panicum virgatum
  misc_feature: Ceres CLONE 1868425
  misc_feature: Encodes the peptide sequence at SEQ ID NO. 26247
cttccccaattcggcctcttccacccccagggctccagcggttttccccttgatttctaccccgccgcaggccttcgggccgcgtgcggcgtgtcacatcccggtggttccatgcccgcctccgactgctagttcctgatcgtttcccctcctgcatggcctgaaaatccttgccttgtctgtctcttcgtcgctgcttcttgctgtaattttgctgctgagctctagcctgacttctgttagtagatgggttgtttgtcacacgccaatggagtcttcttgattccactcattatcctcaccggcaactctgctcccacatcatttatgtatcactcggattaaccctgcaactttttccctcagcgcgtctgaaattttaccgcttcattcagaggagccgagcaggcgagcacgtcgcaaccttccatttaagcgcagttcctgagtgcccaactgcagagcacagtgaagctgcgtccgtttccccatcactgtcatcaatgagctcgccatgcctgcctggtccttgcccctcctattaatggcgtaactgtacgcgcatatcccgcacctgctaatgtgcatcgtcgtcctcctcccgcctcattcctccactgctggcgtaaatgggataacagctacagctcatcttcttcgcccttttctatgcgaggtttaatgcccgtttggtggcgactgctagcttctccaccccttgaaaaaccttacttcattcttccccgcaaagagaaagacctgatcttcttttccgtccggtggcggtgttgatttggattcttgcaagacatccttgcgcggttctgcggtaggatcaggaggttggtggtcgccggcgcagagtccgcgaagcggcctccgagggttgcactgcacggcttccccggtggcgccgaggcgttcgagctcgtcgcgaggtggtgttacgccgacgccgaaagcggctgcggcggcgcggtgaccgcggccaacgcttgcgtgctccgctgcgcggcggagttcttggatatggcggcggacgcgcccgaggcggcgtccacggccgcgccgagcctggtgaggatgacggagaaggcgctcgaggagatgccgcactggccgtggcacaccgtcgtggacgccgtgaagcagtgccagcgcctgctccctctcgccgacaccaccggcgcattcgacgcggccgtggccgcgctggtgtgccacatgacggtgcccccgcctgccggggacgccacgccgacgagctcctcgccggagagctcggcgttccggttctcttgcgacaccaagagcagcagcctcagcctgcgggggtcctgcatcagccgcacctggtggttcgacgacctcgtgtcgctccgccccggcacggtggagcgcgtcgccgcggcactcctggccaggggcaccgaccaccgcgtcgtcgcccggttcctcttctactacctcaagtgccgcatcgccggcgcgagcgccgaggacaagaaggagatgctggaggcgtcggtcaccgtcatgtccggcctcgaccggagcgcggtctcctgcaagggcctcttcggcatcctccggatcgccgcgccgctgaagctgaccgacgcgtgccagcaacggctcgtcgccatgattggccgcaagctggaccacgccacgctagacaacctcctcgtcccggcgccggcgggtacgggcagcctgtacgacgtgagcctggtgctcaggttcttggaggccttcctccgcggcagcgcccccgacgagccggcgaggctgaagaaggtgggcaggctcatcgacctctacctggccgaggtcgccccggacccgtctctgcgcccgg

SEQ ID NO: 26247 - protein, 277 aa, Panicum virgatum
  misc_feature: Ceres CLONE 1868425
  misc_feature (107)..(277): Pfam Name: NPH3 Pfam Description: NPH3 family
MAADAPEAASTAAPSLVRMTEKALEEMPHWPWHTVVDAVKQCQRLLPLADTTGAFDAAVAALVCHMTVPPPAGDATPTSSSPESSAFRFSCDTKSSSLSLRGSCISRTWWFDDLVSLRPGTVERVAAALLARGTDHRVVARFLFYYLKCRIAGASAEDKKEMLEASVTVMSGLDRSAVSCKGLFGILRIAAPLKLTDACQQRLVAMIGRKLDHATLDNLLVPAPAGTGSLYDVSLVLRFLEAFLRGSAPDEPARLKKVGRLIDLYLAEVAPDPSLRP

SEQ ID NO: 26248 - DNA, 667 bp, Panicum virgatum
  misc_feature: Ceres CLONE 1868425-R
tgaagatctgcaggggcctgagttacgagaagctgtcgccggagtgctgcaagcacctggcgaggaacggcgggttcccgacgagggcggcggtgcaggcgctggcgtcgcagcacacggtgctcaagagtctggtcctgcgcgacccgtccgagctgaagccggtggcgccgtcccctcccccgtccaccgtgaagcgccgcgagacctgctacgacgacggcggccgcggcggcggcgagaacgacgggcaggtgatcctgtacgcggggcggctggacctgacgctggagaaccagaacctgcggtcgctcctggacgggatgcactggcgtgtgatggagctggagaaggtgtgcagccggatgaagacgcagatgaccaagatgaaggccaggagggccgccagccgcaccgccaggtcgctccccaggatgtgttcttgatccaccccactctgctgccatctggggtgatcactgatcataaacacactgtgccatagtgatgtacatagtgttagaatcaatcaagtgcaggttttagcatatctgcgtattgtcttgcttctattttttttggcttcatttttgccatgtttcctctgtgtatgatgtgctatcagttcttggtgattcgaaagaagagccggtttgagtggtccatc

SEQ ID NO: 26249 - DNA, 2744 bp, Panicum virgatum
  misc_feature: Ceres CLONE 1868433
  misc_feature: Encodes the peptide sequence at SEQ ID NO. 26250
gcagctgaagccccatcattaaatccgctctcgcaggaacccgcccggcccggccgtcgcttgcttccccgcagctcccgccgccgccgcaggagcagcagctcagttgacctgaccccgccagccaccaccaccacctcctcctccggcgccgccgttcctgcaaccccccgcgcgcggatggatgaaggttcagcctcgccggcctcggtggccggcgggggcggggggccccggccccaggtcgcggtggccgtgcgaggggacggccgcggcagccgccgagccgcgcggtgggcggccgccaccatggtccccgccggcggccgcctcgcgctcgtccacgtcatcccgcccgtctccttcgtcccgtctccatcgggggagagggtgcccgtggagaagatggagccggaggtggtggagatgtacgcgcaggaccgccgggcgcgcgcgcaggaggtcttcctccccttccgccgcctctgcgcccgcagagccgtggagacggtggttctggaaggggacagcgtcgcggaggcgctggcaagctacgcggcggagtccggcatccgcagcctcgtgctcgggaacgcctccctcacctggctccggaggatgctacggctccgagatgtgccttttatggttttgaaaactgtgccaagttcatgcaatgtatttgttgtgtcccggcgcagagtaacaataaaatttgcaaatctggctcgtacgagcaagtcaaacaatgtaaggattcagtcaataagtcataaaggattcagtcaaatacagaaggactggttgcaggataaacagtcatttaataatctggttgatgatggaatactgaaatattctggaaattctagatcagactcgcaatctcaagtctgcagttctcttagcacttcttcgaatgctgttaaaagttcagaaaatcaaagaagaggtctcttaggaagcttaggtcgaaagacaccaagaagagaagggaacaaagatattgatgctataggccaatggaaggaagtttgttatgttgccttaagctcagtcgaagagtctcaacctgtagacgaagtagcaacactgagaaaggagttgaaagatactttgatgatgtacgacagagcttgtgagaatctcgtccatgctaaggaaaagattcagatactttctggtgagtgccgtgaagatgtgaataaggtgcaagacgcactacaaagagaggaagagttgaaacaggctgttgcagatgagaaaacgaaacatttacaagcaattggagcaattgagatggcaaaagaatcatttgctcacgaggcctattccaaacacaaggctgaatttgtagctaacatggtgtctactgagaaggttaaggttgtggatgctcttttgtcaacaggcaaaagttgcaggcggtattcaagacatgaaatagagcttgccacagattacttttctgatgcaaagaagattggtgagggaggctatgggaatgtatacaggtgtacccttgatcacactgaagtagctgtcaaggttattcaacaagattctagtgacaagatcgatgaatttttaagagaggtggagattcttagcaaacttcaccatcccaacttggttttactgcttggtttttgtcctgaaatcggatgccttgtgtatgaatatatggagaatgggagtctagaagaccaacttatcaacaataaggggcaaccactccattggtttctgcgattccaaattatttttgacgtatcttgtgggcttgctttcttgcatggaacaaaaccagaacctatcgtccatcgtgacctaaagcctggaaatatcttgctggacaagaattatgtaagcaaaattggtgacgttggtttcgctaagcttatatcagacctcgttcccgaaggacttacagagtacagagacactgtcatcgccggcacattgttttacatggaccctgagtaccaattaacaggaacagtgcggccaaaatcagatctttttgcattggggatcatcattcttcaactactaaccggcaaacgtccacatgggctggtatgcagcatagaagaggcgattgaaaagggggctttgcctgatgttcttgacaagtctcaaactgattggccaattgctgaggcagagatgctggcaaaacttgggttgcggtgtacagccttaaaatgcagggacagacccaatcttgagtcggaggtgcttccagagctggaaaatatcctaagcagggtaactgcttctctgaagcttgaaaacattgtcgcgccaagccacttcatctgccctatattgcaggaggtgatggaagatccttacgttgctgctgatggccacacctgtgagcacagggcaattgaagcttggctcaagaaacacaaggtatccccggtcaccaatcagaggcttccacatctatccataattcccaaccattcgttgcatgcggcgattcagcaatggaaatcgcggacatctttctgaagtcatgagatgactagtgtttttgtgtctatatttaatttgattgatcattatgccttttgagttcagctgtaaataaatagcagatagatgtataacgtactagtggtaaaggttagtgttgtaggaataagttgtttttctggcttgagattggcgagtgggtatagcctaaactggcttcctgttactgaaagattttaaaaaaaattattagactc

SEQ ID NO: 26250 - protein, 780 aa, Panicum virgatum
  misc_feature: Ceres CLONE 1868433
  misc_feature (429)..(688): Pfam Name: Pkinase Pfam Description: Protein kinase domain
  misc_feature (709)..(779): Pfam Name: U-box Pfam Description: U-box domain
  misc_feature (18)..(171): Pfam Name: Usp Pfam Description: Universal stress protein family
  misc_feature: SWISSPROT Homolog: EC 2.7.11.1 Non-specific serine/threonine protein kinase
MDEGSASPASVAGGGGGPRPQVAVAVRGDGRGSRRAARWAAATMVPAGGRLALVHVIPPVSFVPSPSGERVPVEKMEPEVVEMYAQDRRARAQEVFLPFRRLCARRAVETVVLEGDSVAEALASYAAESGIRSLVLGNASLTWLRRMLRLRDVPFMVLKTVPSSCNVFVVSRRRVTIKFANLARTSKSNNVRIQSISHKGFSQIQKDWLQDKQSFNNLVDDGILKYSGNSRSDSQSQVCSSLSTSSNAVKSSENQRRGLLGSLGRKTPRREGNKDIDAIGQWKEVCYVALSSVEESQPVDEVATLRKELKDTLMMYDRACENLVHAKEKIQILSGECREDVNKVQDALQREEELKQAVADEKTKHLQAIGAIEMAKESFAHEAYSKHKAEFVANMVSTEKVKVVDALLSTGKSCRRYSRHEIELATDYFSDAKKIGEGGYGNVYRCTLDHTEVAVKVIQQDSSDKIDEFLREVEILSKLHHPNLVLLLGFCPEIGCLVYEYMENGSLEDQLINNKGQPLHWFLRFQIIFDVSCGLAFLHGTKPEPIVHRDLKPGNILLDKNYVSKIGDVGFAKLISDLVPEGLTEYRDTVIAGTLFYMDPEYQLTGTVRPKSDLFALGIIILQLLTGKRPHGLVCSIEEAIEKGALPDVLDKSQTDWPIAEAEMLAKLGLRCTALKCRDRPNLESEVLPELENILSRVTASLKLENIVAPSHFICPILQEVMEDPYVAADGHTCEHRAIEAWLKKHKVSPVTNQRLPHLSIIPNHSLHAAIQQWKSRTSF

SEQ ID NO: 26251 - DNA, 687 bp, Panicum virgatum
  misc_feature: Ceres CLONE 1868438
  misc_feature: Encodes the peptide sequence at SEQ ID NO. 26252
aaacctgattgtgagggcagctaattactagtgctaagctcgctagcgtaattagcacgactggtagcttgtttgtcgccgcgctaattagtaattagcgtgtgacagaggaggtaaatattgtgcagtaattccggtggcggttctctgatctcggcggagagatgacggtgacgccgaagatcacggtgggggatgggcggctggtggcgcacgggcggaccatcctgaccggcgtgccggagaacatcgtgctcacgcacgcctccggggcggggctcgttgatggcgccttcgtcggcgccacggccggcgaggccaggagcatgcacgtcttcagcttcggcaccctcagggacctgcggttcatgtgctgcttccggttcaagctgtggtggatgacccagcgcatgggcacctccggccgcgacgtcccgctggagacgcagttcatgctcctggagagccgcccgggcgccggcgccggcgccgacgacgacagcggcgagccggtgtacctggtgatgctgccgctgctggagggccagttccgcgccgcgctgcagggcaacgaccgcgacgagctggagatcaccctcgagagcggggacaaggaggttcagacggcgcaggggagctacatggtgtacgtgcacgccgggaccaaccccttcgacaccatcactc

SEQ ID NO: 26252 - protein, 174 aa, Panicum virgatum
  misc_feature: Ceres CLONE 1868438
  misc_feature: SWISSPROT Homolog: EC 2.4.1.67 Galactinol--raffinose galactosyltransferase
MTVTPKITVGDGRLVAHGRTILTGVPENIVLTHASGAGLVDGAFVGATAGEARSMHVFSFGTLRDLRFMCCFRFKLWWMTQRMGTSGRDVPLETQFMLLESRPGAGAGADDDSGEPVYLVMLPLLEGQFRAALQGNDRDELEITLESGDKEVQTAQGSYMVYVHAGTNPFDTIT

SEQ ID NO: 26253 - DNA, 775 bp, Panicum virgatum
  misc_feature: Ceres CLONE 1868441
  misc_feature: Encodes the peptide sequence at SEQ ID NO. 26254
aaaaaaataccgcggcttccccttccacccgatctctccccctctctctctctccccacccggacgtgttgagctggttcccagtcctccgtctccttgcttcagctcagcggcatcagcagcttcccccctctacccgttcctccctcctcttcttcataagctcactcgcaaacggaagtggagctgcagagtagtaagtagaagtctagaagtagcaagcattgggatttcgtgtgaaggggatagctgggtgcgccaaaggaaaaaggagacccaggattagcgtgtggcggattgggtggctattttgggagtggggaggacgagaggcgtggccttggccgggggaggcggcggcttcttggaccggccattgatggcgccgtggagcggcttgtggggcggcaaggccggcggcgacgcctaccggggcacgccggtggtggtcaagatggagaaccccaactggtccatctccgagatctcctcgccggaggatgacgacgaggacatcttggccgccggcggccgccgcaaggggggccgctccaagaacgccaagcagatcaggtgggtgctgctgctcaaggcgcaccgcgccgccggctgcctcgcctcgctcgcctccgccgccgtcgcgctgggcggcgccgccaggcgaagggtcgccgcggggaggaccgacgcggaggccggcgtcgtggccgccacgggcgagagccccgttgtgcgctccagatctacgccttcatcagggccgtcctcgtcgtct

SEQ ID NO: 26254 - protein, 131 aa, Panicum virgatum
  misc_feature: Ceres CLONE 1868441
  misc_feature: Useful for making plants with altered carbohydrate content
  misc_feature: Useful for making plants with altered cell wall content and/or composition
MAPWSGLWGGKAGGDAYRGTPVVVKMENPNWSISEISSPEDDDEDILAAGGRRKGGRSKNAKQIRWVLLLKAHRAAGCLASLASAAVALGGAARRRVAAGRTDAEAGVVAATGESPVVRSRSTPSSGPSSS

SEQ ID NO: 26255 - DNA, 1400 bp, Panicum virgatum
  misc_feature: Ceres CLONE 1868480
  misc_feature: Encodes the peptide sequence at SEQ ID NO. 26256
caaactgcgaccaccctgatccgtctccctctcgtcttcctctgcccgctcgcaccccggagcccccgagcgagaacggagcgcgagctgccgccgccagcagccgcggcgggcaccatggaggacggcggcaacgcacggcgcgcggagcggtgggaggggtacgtggactggcggaaccggccggcgaccaggggccggcacggcggcatgcttgcggcgtccttcgtgctcgtggtggaggtgctggagaacctggcgttcctggcgaacgcgagcaacctggtgaggtacctgatggggttcatgcactactcgccgtcgcagtcggcgacgacggtgaccaacttcatgggcacggcgttcctgctcgcgctcctcggcggcttcctctccgacgccttcttcaccacctacaccatctacatcgtcagcgccttcatcgagttcatggggctggtgatcctgacggtccaggcgcggacgccgcacctgatgccgccgccgtgcgccaccaccgccacgggggctccggcgccgtgcgcgcccgtgtctgggccccggaaggcgatgctcttcgcggggctgtacctcacggcgctgggcgtgggcgggatcaagggctccctgccctcccacggcgccgagcagttcgacgagcacgcgccgcggggccgcaaggcccgctccaccttcttcaactacttcgtcttctgcctctcctgcggcgcgctcgtcgccgtcaccttcgccgtctgggtcgaggacaacaggggctggcagtggggcttcggcatcgccaccatcgccatcctgctctccgtcccggtcttcgccgcgggctccggcctctaccggaacaaggtgcccacggggagcccgctcaccaccatcgccagggtcctcgccgccgccgccctcgcgcgccgcgccggcgcgcagagcgccagcaacggcgctgtcatcgaccgcgcgcccagccccacggggagcaccgacatgaaggactactgcaagcccggcgacatggtggccaacatcgccgccggcgccgggccggccgagccgtcgcgggagctcgcgttcctcaaccgcgccgtgcggtgccaggaggagcagccggggcaacagaacgggcgcctcgcgtgcacggtgcaggaggtggaggacgtcaagatcgtgctcatggtgctgcccattttcttctccactatcatgctcaactgctgcctggcgcagctgtccaccttctccgtcgagcaggcggccaccatggacacgcgcgtcggcaggctcaccgtgccgcccgcctcgctccccgtgttcccggtcacgttcatcatcctcctcgcgcccgtctacgaccacgtgatcatcccgttcgcgcgccgcctcacggg

SEQ ID NO: 26256 - protein, 427 aa, Panicum virgatum
  misc_feature: Ceres CLONE 1868480
  misc_feature (100)..(427): Pfam Name: PTR2 Pfam Description: POT family
MEDGGNARRAERWEGYVDWRNRPATRGRHGGMLAASFVLVVEVLENLAFLANASNLVRYLMGFMHYSPSQSATTVTNFMGTAFLLALLGGFLSDAFFTTYTIYIVSAFIEFMGLVILTVQARTPHLMPPPCATTATGAPAPCAPVSGPRKAMLFAGLYLTALGVGGIKGSLPSHGAEQFDEHAPRGRKARSTFFNYFVFCLSCGALVAVTFAVWVEDNRGWQWGFGIATIAILLSVPVFAAGSGLYRNKVPTGSPLTTIARVLAAAALARRAGAQSASNGAVIDRAPSPTGSTDMKDYCKPGDMVANIAAGAGPAEPSRELAFLNRAVRCQEEQPGQQNGRLACTVQEVEDVKIVLMVLPIFFSTIMLNCCLAQLSTFSVEQAATMDTRVGRLTVPPASLPVFPVTFIILLAPVYDHVIIPFARRLT

SEQ ID NO: 26257 - DNA, 721 bp, Panicum virgatum
  misc_feature: Ceres CLONE 1868480-R
  misc_feature: Encodes the peptide sequence at SEQ ID NO. 26258
ggcatcagccacctccagcgcatcgggaccgggctcatcctctccatcgtcgccatggcggtggcggccgtcgtcgaggtgaagcgcaagaacgtggccgccgacagcggcatgctggactcgccgaagccgctgcccatcagcttcttctggatcgcgttccagtacctgttcctggggtcggcggacctgttcacgctggcggggctcctcgagttcttcttcagcgaggcgccgtcgcggatgcgctcgctggcgacgtcgctgtcgtgggcgtcgctggcgctgggctactacctcagctccgtgctcgtgtccatcgtgaacagcgcgacggggcgcggcggccaccggccgtggctgcggggtgccagcctgaaccactaccatctcgaaaggttctactgggtcatgtgcgtgctcagcactctcaactacctcttcttcctgttctgggcgatcaggtacaaatacagaaacgcaggggtcatcaaagggtaatgccatagccaatcggcattgccgttgatcgccacggtagcgagaactgctgggtgttactgtttatattggtggcaagcagagagtaaaaaaaaaggtactaggttaacttctgcaggatgtggggattatattggtggtggtggtttatcaggttgtcatgaatttggttgattggttcaacaagtgaatcaagaggtggctcagttaatccaatatc

SEQ ID NO: 26258 - protein, 166 aa, Panicum virgatum
  misc_feature: Ceres CLONE 1868480-R
  misc_feature: Useful for making plants with modulated nitrogen use efficiency
GISHLQRIGTGLILSIVAMAVAAVVEVKRKNVAADSGMLDSPKPLPISFFWIAFQYLFLGSADLFTLAGLLEFFFSEAPSRMRSLATSLSWASLALGYYLSSVLVSIVNSATGRGGHRPWLRGASLNHYHLERFYWVMCVLSTLNYLFFLFWAIRYKYRNAGVIKG

SEQ ID NO: 26259 - DNA, 705 bp, Panicum virgatum
  misc_feature: Ceres CLONE 1868482
  misc_feature: Encodes the peptide sequence at SEQ ID NO. 26260
aacagaatcgctagctttttgccaacgaccaagaggtagcgagctcctgctcctcacgtttgtagtgtgagccatcctactctacggcagcaataaccaaagagccaaagcaaagctccaagtgatcgacctgcaactactcgagctaattaactggcttattggtagctcagacagaagccgggtggcggcggcgggcgatcggcggcgagcgcatgggcaacgccctggggtgcgccggactcggcgagcggctggcggccgccgcgagggacggcgacgcggcggaggtgcggcggctgctggaggcgaacccggggcacgcgcggtgcgccgccttcggcagcctcaactcgccgctccacctcgccgccgccaaaggacaccacgagatcgctgcgttgctgctgcagaacggagctgacgcgaacgcccgaaacatttacggacaagtaagaaatctcatctcatccaatccaacagcattttaactctcctacgattcattgtggaagattgcacggctcaggcttgagtcgtacaatcttccacggtgagaagctatgccaaaccggacctctgtttatatgtttgttttgtaccgtcaacgtcaatttctcaaccgacacgtctccggcgctgatccgttgaggttgaatccattaatgatacgatgctcgcgtttttcacatgtggtttattgaa

SEQ ID NO: 26260 - protein, 91 aa, Panicum virgatum
  misc_feature: Ceres CLONE 1868482
  misc_feature (44)..(76): Pfam Name: Ank Pfam Description: Ankyrin repeat
  misc_feature: SWISSPROT Homolog: EC 2.7.11.1 Non-specific serine/threonine protein kinase
MGNALGCAGLGERLAAAARDGDAAEVRRLLEANPGHARCAAFGSLNSPLHLAAAKGHHEIAALLLQNGADANARNIYGQVRNLISSNPTAF

SEQ ID NO: 26261 - DNA, 633 bp, Panicum virgatum
  misc_feature: Ceres CLONE 1868489
  misc_feature: Encodes the peptide sequence at SEQ ID NO. 26262
tttacgtggatgatattatctttggtggctcctctcactctcttgtttctagtttttctgatgacatgagcagagagtttgagatgtcgatgatgggtgagcttcagtttttcctcgggttgcacatcaagcaaacccgggatggcaccttcgtccaccaggccaagtacactaaggacatgctcaagaagttcgacttcggagacctcagtcccatgccgactcctatgggcacttctacggcgctggatgaggacactgaaggtgttgctgtggaccagaaggagtacaggagcatgatcggctcgctcctgtacttgacggccaccagacccgacatccagttcgcggtctgtctctgcgcgaggttccaggcttctccgcgcacttctcacaggaactctgtgaagaggattttcagcaagtccaattctgttgatgttatcgtgatcagcgatgactctggctgtggaaattcttttgaaatcggcgacacttcaagttcaaatccaaacagaaagaaaaggcgaataaatctcccatataaagaaccccattccaatcatccggtacatcagtatcaagcatcacattctgcatcaaacttatcgcaagagtcaggctgcctggtcc

SEQ ID NO: 26262 - protein, 210 aa, Panicum virgatum
  misc_feature: Ceres CLONE 1868489
  misc_feature (1)..(79): Pfam Name: RVT_2 Pfam Description: Reverse transcriptase (RNA-dependent DNA polymerase)
  misc_feature: SWISSPROT Homolog: EC 2.7.7.49 RNA-directed DNA polymerase
YVDDIIFGGSSHSLVSSFSDDMSREFEMSMMGELQFFLGLHIKQTRDGTFVHQAKYTKDMLKKFDFGDLSPMPTPMGTSTALDEDTEGVAVDQKEYRSMIGSLLYLTATRPDIQFAVCLCARFQASPRTSHRNSVKRIFSKSNSVDVIVISDDSGCGNSFEIGDTSSSNPNRKKRRINLPYKEPHSNHPVHQYQASHSASNLSQESGCLV

SEQ ID NO: 26263 - DNA, 746 bp, Panicum virgatum
  misc_feature: Ceres CLONE 1868502
  misc_feature: Encodes the peptide sequence at SEQ ID NO. 26264
agacgcgcgagggtttcccttccacaaccccccacccgcgagaagtcggctgcgctccgcttccgccgccggccctcgctcttcggttaactaatcatccagacccagtcaatatgtctgacagccatgagactgataggaacattgagatttggaagattaagaagctgatcaaggcattggagtccgctagaggcaatggcacaagcatgatctctcttatcatgcctccacgcgatcagattgctcgagtggctaagatgttaggtgatgaatatggtactgcttcaaacatcaagagtagagtcaatcgtcaatctgtgttggctgctatcacctcagctcaacagaggttgaagctctacaacaaagtgcccccgaatggattggttctctacactggaaccattgttactgaagatggaaaagaaaagaaagttactattgattttgagcccttcaagcctattaatgtgtcgctatacctttgtgacaacaagttccacaccgaggctctaaatgagctcttagaatccgatgacaagtttgggttcattgtcatggatggtaatggtactcttttcggtacactaagtggcaatacccgtgaagtgcatcacaagttcactgttgatctcccaaagaagcatggtagaggaggacagtctgctttgcgttttgctcggcttcggatggagaaacgccacaactatgtccgcaaaacagctgagcttgctacacagttt

SEQ ID NO: 26264 - protein, 210 aa, Panicum virgatum
  misc_feature: Ceres CLONE 1868502
  misc_feature (6)..(140): Pfam Name: eRF1_1 Pfam Description: eRF1 domain 1
  misc_feature (144)..(210): Pfam Name: eRF1_2 Pfam Description: eRF1 domain 2
MSDSHETDRNIEIWKIKKLIKALESARGNGTSMISLIMPPRDQIARVAKMLGDEYGTASNIKSRVNRQSVLAAITSAQQRLKLYNKVPPNGLVLYTGTIVTEDGKEKKVTIDFEPFKPINVSLYLCDNKFHTEALNELLESDDKFGFIVMDGNGTLFGTLSGNTREVHHKFTVDLPKKHGRGGQSALRFARLRMEKRHNYVRKTAELATQ

SEQ ID NO: 26265 - DNA, 705 bp, Panicum virgatum
  misc_feature: Ceres CLONE 1868509
  misc_feature: Encodes the peptide sequence at SEQ ID NO. 26266
acacaagttgcccacgatcgctgccagtgccagggcagctttgcctctgcttcgtcttcctccctcctctgactctgctgcactctgctcgacctttcattccacccatggtgcggcttctgctggcgctcgcgcttctcctcgtcggacggttggccgatgcggcgacggtgaaatacaccttcacggtggggagcatgcaaatcaaccagctctgcagcaccaccagtattatcgcagttaacggtcaactgccaggcccgtcgatagaagtgaacgaaggtgacgcggttgaggtcaaagtcatcaacaattcaccatacaacgtaaccatccactggcatggtgtgctccagctcatgaccccctgggccgacgggccgagcctggtgtcgcagtgccccatccagcccagcggctcctacacgtaccggttcggcgtgccggggcaggagggcacgctgtggtggcacgcgcactcctccttcctccgcgccaccgtgtacggcgccttcatcgtccgcccgcgcgccggcaacgcctaccccttcccggcgccggacatggaggtccccatcgtgctcggcgagtggtggaaccggaatgtggtcgacgtcgagagcgacgccctcttggccggccagctccccgcccagtccgacgccttcacggtgaacggcaagaccggcctgctctacccgtgcg

SEQ ID NO: 26266 - protein, 199 aa, Panicum virgatum
  misc_feature: Ceres CLONE 1868509
  misc_feature (27)..(143): Pfam Name: Cu-oxidase_3 Pfam Description: Multicopper oxidase
  misc_feature: SWISSPROT Homolog: EC 1.10.3.2 Laccase
  misc_feature: Useful for making plants with altered cell wall content and/or composition
  misc_feature: Useful for making plants with altered carbohydrate content
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MVRLLLALALLLVGRLADAATVKYTFTVGSMQINQLCSTTSIIAVNGQLPGPSIEVNEGDAVEVKVINNSPYNVTIHWHGVLQLMTPWADGPSLVSQCPIQPSGSYTYRFGVPGQEGTLWWHAHSSFLRATVYGAFIVRPRAGNAYPFPAPDMEVPIVLGEWWNRNVVDVESDALLAGQLPAQSDAFTVNGKTGLLYPC

SEQ ID NO: 26267 - DNA, 1420 bp, Panicum virgatum
  misc_feature: Ceres CLONE 1868516
  misc_feature: Encodes the peptide sequence at SEQ ID NO. 26268
atcttattttgacttgattattgcatatgttttctgtgtctgtcactctcgattcatcgtatcgccggtgctgattgatgagtagtgttattaccagcagcaggctagtagcgccatggatcactgctagctgctctctgctgctggtacttgagctcagtactaactgcctccctcctcttcttcttctgcttctctctatcttctagttatgtcaggaaagatttggtcggccaggctctccctctgaaggactgagacggtagccactttaatttgcacgacaaaagtgagttctgcctttcgttgttcctactctttgttttcctgtatgtcgtgctttggcggccctcagctagctacccgtgctttgctgattgccgccttaattgtgtgcgcctgtgctttttaagggaggaagccttgctttcggtgtgccgccgatcgagcctgacggagatggcgcacgatcccagcctgggcttcgcggattacttctcggcggcggcggacgccacggcgatggaggagggggcgcccgagctgtacggcttgcacgccgacatggagttcctggccatgcgaggaggcctggccgccatgccggccgcgacgcacggccacggtcacggtcacaacaaggccgtgctcgacgatgacgcggggccagacggcggctccgccacggacgcggccaccatgcagttcctgagcgccggcggccaccagcagcagcagccgagccaggcgccgctgtcgctgtcgctgtgccggcccgatggcgccggcggcgtgggcgtgacgttgcacgagcacctcggcggctcctcccggcaccatcagcagcagccgccccccgcggcgtggatggagcacgactactcggcggccacgcaggggacgcagcacgcggcggcggcgtggcacctgcgcagctcgaggttcctcctcccggcgcagcagctcctgcaggagttctgcagcctccccgtcgacagcgccgcgaaaaacaagcagcgcgccaagcaggcatcatcaacggcaaagccgccgcagcagcaagaagacggcggcgagggttcgtcgtcgtcggcctgctgggccccgtcgccgcagatccaggccatggaggcgctggagctgcagcggctcaaggacaagctctacatcatgctggaagaggtggaccggagatacaggaggtactgcgagcagatgcgttcgctggctggcgggttcgaggcggtggccggggagcgcgcggcggcggcgtacacggcgctggcgtcgcgcaccatctcgcggcacttccggagcctgcgggacgggatggtggcgcagctgcaggcggcgcgcaaggcgctcggggagaaggcggacgtgtccgtgcccgggatgacgcgcggggacacgccacgcc

SEQ ID NO: 26268 - protein, 320 aa, Panicum virgatum
  misc_feature: Ceres CLONE 1868516
  misc_feature (155)..(293): Pfam Name: POX Pfam Description: Associated with HOX
MAHDPSLGFADYFSAAADATAMEEGAPELYGLHADMEFLAMRGGLAAMPAATHGHGHGHNKAVLDDDAGPDGGSATDAATMQFLSAGGHQQQQPSQAPLSLSLCRPDGAGGVGVTLHEHLGGSSRHHQQQPPPAAWMEHDYSAATQGTQHAAAAWHLRSSRFLLPAQQLLQEFCSLPVDSAAKNKQRAKQASSTAKPPQQQEDGGEGSSSSACWAPSPQIQAMEALELQRLKDKLYIMLEEVDRRYRRYCEQMRSLAGGFEAVAGERAAAAYTALASRTISRHFRSLRDGMVAQLQAARKALGEKADVSVPGMTRGDTPR

SEQ ID NO: 26269 - DNA, 683 bp, Panicum virgatum
  misc_feature: Ceres CLONE 1868516-R
tgcagcagcacgactctcacgacggcggcgtgaacatcgcgttcggcgcgccgacgccgccgtccgcgcaccaccacggcggcgccgcggggtatctgttcgcgacggtgggcggtcagcagcagatggacagcggcgtgcacccggggccgcacggccaccacgcccagttcggcgcggcggccggcatcgaaagcggcgaggcgcaggagcactaccggagcctgggcgccgggttccaccttctgcgtgacctggccgggtgatagagatcgagagcgagcgagctcgctgcgggcggatgatgagttgtgaccgatggggatgtcgtaccggcgcctagcgtgcgtccggtccagtgccgcaattgttgggctccgactccgatcgatcccccggccggccggcgcgcggcaggtgatgatcgaggtctccatcgatcgatcgccaccgcgcgcgcgcgccgagttggcctactgccgcctgctgtgctgtgttattatgtagtagcatgggagaatgatggagcagtagcagtttggacgcgcgcaggcgcagctaaccggccggccggaggtagctagtggacgacacacgcatgcatgcagctagtttaattgtttgtcgatcaaattggtgaagggctgaaggcattcaaaaactcaatttatgccaggcgatac

SEQ ID NO: 26270 - DNA, 3407 bp, Panicum virgatum
  misc_feature: Ceres CLONE 1868533
  misc_feature: Encodes the peptide sequence at SEQ ID NO. 26271
gaggaagccgaagccggaaagcccctttccaccgccgcgaggcgtagggttagggaggaatggctggaggagggggaggaggctggcgcggcgattcctcgccggcgatcaagcccataagcaaggccgtggtgcaccgcatctgctccggccaggtcatcttcaacctctcctccgccgtgaaggagctcgtcgagaacagcctcgacgccggcgccacgtccgtcgaggtcagcctcaaggcctacggcgaggagtggttcaaggtcgccgacaacggcttcggcatctcgcccgccaacttccaggcgcttgcacttaagcaccacacttccaagatatcggatttctccgaccttggatccgtggtcacattcggattccggggtgaagcgctgagctcgctctgcgcgctggggaaactgacggttgagacgaggaccaaggatgagcccgtcgggacgcatttggagtttgagcactccggcgtggtggccaaccagacgaaaatcgcacggcaggttggaaccacggtgacagtcgagaagttgttctccaccttgccggtccggagcaaggagtttagcaggaacattcggaaagagtatgggaaagtgatctccctgttgaatgcttacgccttgattgccaaaggggtcagattgctttgcactaataccgtcggaaaaaattctaaaatggtggtgcttaggactcaaggaagcagttcaatgaaagacaatatcattaccatatttggtctgaacactttcaagtgtcttgagccctttagtgttaccatctcagatggctgccaagtagaaggctatctctcaaaacctggacctggtaccggtcgcaattcaggagatagacaattcttctatgtcaatggcagacctatcgatatgccaaagatcactaaacttgtcaatgagctatacagaagctcaaatgcaaagcaatatcctgtggctatcctggatttccgtattccaactacatcctatgatgtgaatgtagcacctgacaagagaaaaattttcttctcctctgagagtatgattctgcgatcattacgggaagctgttgaaaatatgtactcccctcaacaatgcagtttcttgatcaatcatgttgaagaacctgaaaaggaagaggatactactgatggccataatgaagacacaaatttgatagcagcagacaatgtttcatctcctgacaatagtgatgacaatgaagaaacagacattgaggatcagatttcaccagagaaccagaaagagccttcttcagcgacaaaggtagcaattgaagccacatctagagatttgagccccctgtctagaggcacagctgcccaggctgatagatctgtttggcttccatccttctcatatgaacaaccaaaaagattgcctaaagaaggaaaagattatgcatcaggaacaaatcattttagaactggtcttgctgcaaaatctacccaatcacctactgttcaatcttctattatgaactttgtatcactaaacaagcgcaagcatgaagatgattgcaatcttatttcggaagctccagtgctgaggagagggacatgcatagaacaagtgagggaaacaagtttagaagccaactttgtatcaccaaacaagcagaacaacatagatgattgcagtcttatttctgaagctccggtgctgagaagaggtacttgcttagaacaggtgaggagaacaagtttagaaggaaactttgcttcatcaaataagcagaagcacgaagataaatgcagtattatctctgaaactccagtgttgagaagaaaagcatgctcagaacaagtggggagaacagtagaagcaaattcaccagctgcattgagatcatgcacatctaatatttctgagttcaatttgcctctggaaacaaactctttaaaacatcattctccacaatcatttgtatctgtgagggcagatgtttcaccacagcattcaaaaccgcctaatactgtgacccatggtgcacaagtatcaagtccatgtgatgttcacactacagaacctgatgtggatgtgcagcatgatcgatgccttccaatttctggtgctcccaataaatattcagaagttgaacatcagaatacaatgagcgatagtccttcgcttgatgctcatgattatgatgcaggcgatgcagtatgttctgcatctgtacagtatcccagtatgcaatttactgttgctgagcttaggagaagaagaaagaatggttttaggatatcacatgcaaataaagcaaatagtcttgagaaagctacaaggtgctataaagccgcaacactggatatttatgtaccctcaggtgacgaggcaaaatctaattcattagctgcagccaccaatgaattggacaggcttttcagtaaagatgattttggagaaatggaggttgttgggcaatttaatcttggttttatcatcggaaagcttaaccaggatctgtttattgtagatcagcatgctgctgatgagaagtacaactttgagggcctatcacaatcgacaactttgaacatacagccttttctccagccactgaggcttgatctatcaccagaggaagaagtagttgtttctatgaacatgagcactatcagaaaaaatgggtttgtcttggaagaagatttgcatgcttctcctggtaaccattatcttttgaagactgtgcctttcagcaaaaatattacatttggtgttcaagatgtaaaggagttgatctccatgcttgctgatagtcaaggagattgttcaataatcagtagctacaagctcgataaaagtgattctgtttgcccatcgagggttcgtgctatgttggcttcgagggcttgccgaatgtctactatgatcggcgatccactaacaaaagtcgagatgagaaagatacttaaaaacctaacaggattaaggtccccttggaattgtccacatgggaggccaacaatgcgtcacctggctgatctgcatgctataagaaacaaagattctgcaggagtagatgtggcgttgtgatggcagcccagctgattggcggaggggcttgtgctgttccattttcgccagtctcagctcccatgtgccactggaagaacgtttctatctggggctactgtaaattatggcctgcgcacatatgcgccgcctgtaaattttgacgcactatgcaactcctctgaggactgaggtgtttggctggctccactcagctctaggctggagtttgcagttggaaccatgccaaacagggcctaaatctctggcgctgcttatttattttgtatccaaggatgtatgtacatatggcgttttctatctgcaatgagagtttgcgaactctgc

SEQ ID NO: 26271 - protein, 1006 aa, Panicum virgatum
  misc_feature: Ceres CLONE 1868533
  misc_feature (800)..(957): Pfam Name: MutL_C Pfam Description: MutL C terminal dimerisation domain
  misc_feature (234)..(349): Pfam Name: DNA_mis_repair Pfam Description: DNA mismatch repair protein, C-terminal domain
  misc_feature (32)..(166): Pfam Name: HATPase_c Pfam Description: Histidine kinase-, DNA gyrase B-, and HSP90-like ATPase
MAGGGGGGWRGDSSPAIKPISKAVVHRICSGQVIFNLSSAVKELVENSLDAGATSVEVSLKAYGEEWFKVADNGFGISPANFQALALKHHTSKISDFSDLGSVVTFGFRGEALSSLCALGKLTVETRTKDEPVGTHLEFEHSGVVANQTKIARQVGTTVTVEKLFSTLPVRSKEFSRNIRKEYGKVISLLNAYALIAKGVRLLCTNTVGKNSKMVVLRTQGSSSMKDNIITIFGLNTFKCLEPFSVTISDGCQVEGYLSKPGPGTGRNSGDRQFFYVNGRPIDMPKITKLVNELYRSSNAKQYPVAILDFRIPTTSYDVNVAPDKRKIFFSSESMILRSLREAVENMYSPQQCSFLINHVEEPEKEEDTTDGHNEDTNLIAADNVSSPDNSDDNEETDIEDQISPENQKEPSSATKVAIEATSRDLSPLSRGTAAQADRSVWLPSFSYEQPKRLPKEGKDYASGTNHFRTGLAAKSTQSPTVQSSIMNFVSLNKRKHEDDCNLISEAPVLRRGTCIEQVRETSLEANFVSPNKQNNIDDCSLISEAPVLRRGTCLEQVRRTSLEGNFASSNKQKHEDKCSIISETPVLRRKACSEQVGRTVEANSPAALRSCTSNISEFNLPLETNSLKHHSPQSFVSVRADVSPQHSKPPNTVTHGAQVSSPCDVHTTEPDVDVQHDRCLPISGAPNKYSEVEHQNTMSDSPSLDAHDYDAGDAVCSASVQYPSMQFTVAELRRRRKNGFRISHANKANSLEKATRCYKAATLDIYVPSGDEAKSNSLAAATNELDRLFSKDDFGEMEVVGQFNLGFIIGKLNQDLFIVDQHAADEKYNFEGLSQSTTLNIQPFLQPLRLDLSPEEEVVVSMNMSTIRKNGFVLEEDLHASPGNHYLLKTVPFSKNITFGVQDVKELISMLADSQGDCSIISSYKLDKSDSVCPSRVRAMLASRACRMSTMIGDPLTKVEMRKILKNLTGLRSPWNCPHGRPTMRHLADLHAIRNKDSAGVDVAL

SEQ ID NO: 26272 - DNA, 352 bp, Panicum virgatum
  misc_feature: Ceres CLONE 1868539
  misc_feature: Encodes the peptide sequence at SEQ ID NO. 26273
accgacgctgccgccgccgctggctcgcatttccctcctcgtcgtcttcctcttcttcggcggcgtgcgcggagcctggtgggaaccgcgcggacgaggatcggctctcttagagagaggagccagtgtcctgcgccagcgtccgccgccgtggcggcggagggggaggaggaggaggagatggacgccagcgccgggctggtggccggctcccacaaccgcaacgagctcgtcgtcatccgccgcgacggtgatcccgggccgaagcctctgcggccggccaacgggcaggtgtgccagatttgcggcgacgacgtctgactcggctccggcagggagcccttcgtggcct

SEQ ID NO: 26273 - protein, 46 aa, Panicum virgatum
  misc_feature: Ceres CLONE 1868539
  misc_feature: SWISSPROT Homolog: EC 2.4.1.12 Cellulose synthase (UDP-forming)
  misc_feature: Useful for making plants with altered cell wall content and/or composition
  misc_feature: Useful for making plants with modulated biomass
  misc_feature: The sequence is a functional homolog of SEQ ID NO 26 in US patent 7312377
MDASAGLVAGSHNRNELVVIRRDGDPGPKPLRPANGQVCQICGDDV

SEQ ID NO: 26274 - DNA, 753 bp, Panicum virgatum
  misc_feature: Ceres CLONE 1868548
  misc_feature: Encodes the peptide sequence at SEQ ID NO. 26275
acgccacgagcgcccaacatcccggcctctgcggcgcgtccccgcacccgcaccctccgtattgtgagatctttgcgcagagagagagagagagggagagagagatagccatggcgctgagggcgtcgtctcccgtgtcgcacgtggcggcgccgctgccgccgtgcgggcggaggaggagggtgagcggggtggtggtggccatggcgtccaccatcaacagggtcaaaactgtcaaagaaccctatactccaccacgagaggtgcatcgccaagttacccattcactaccagcccaaaagaaggaaatttttgattcacttcaaccttgggccaaggataacttgttgaacctcctgaagccggttgagaagtcatggcagccacaagacttcctaccagagccttcttctgatgggttttacgatgaagttaaagaactgagggagcgggcaaaggaaatacctgatgagtattttgtttgtttagttggtgacatggttactgaggaagcactacctacctatcaaacaatgctcaacacccttgatggagttcgagatgaaactggtgcaagtccaaccacttgggctgtttggacgagggcgtggacagctgaagagaacaggcatggtgatctccttaataagtacatgtaccttactggacgggttgacatgaaaacaattgagaagaccatacagtatctgattggggtccggaatggatccaggtactgagaacaatccctac

SEQ ID NO: 26275 - protein, 209 aa, Panicum virgatum
  misc_feature: Ceres CLONE 1868548
  misc_feature (61)..(209): Pfam Name: FA_desaturase_2 Pfam Description: Fatty acid desaturase
  misc_feature: SWISSPROT Homolog: EC 1.14.19.2 Acyl-[acyl-carrier-protein] desaturase
MALRASSPVSHVAAPLPPCGRRRRVSGVVVAMASTINRVKTVKEPYTPPREVHRQVTHSLPAQKKEIFDSLQPWAKDNLLNLLKPVEKSWQPQDFLPEPSSDGFYDEVKELRERAKEIPDEYFVCLVGDMVTEEALPTYQTMLNTLDGVRDETGASPTTWAVWTRAWTAEENRHGDLLNKYMYLTGRVDMKTIEKTIQYLIGVRNGSRY

SEQ ID NO: 26276 - DNA, 1715 bp, Panicum virgatum
  misc_feature: Ceres CLONE 1868555
  misc_feature: Encodes the peptide sequence at SEQ ID NO. 26277
aaaacaccatctcggttctgcagggaaaggtcaagtggtccaccgaaacgcatcctctgcgcaatcgcgtcacctcccacccgccagccgcgtgcacctccggcgaccaccgccaccgacccacccgtctcccccgccggccggcggcgatggcgccccgcggcggccagtcctacgggttcccgatctactgcgcggcctggctgcccctcgcccacatcctcaaacccgacccgcccgccgccgacgcggacgcggacgcctccccctcctctccaccgcccccgatggccgcgctcggcggcggcggcggggagggccggagcggcgtgcccaacaagctcgtcgtggccgcgctgggcccggcgggggaagaggcggccctctcccccgaggcggtggtcgaggtgaagaccaaggaggaggtgccgtacaggatggccgtccacccgcgcggcgacggcgtgctctgcgccttccccaacggatgcaggttgtatcgatgggaatcacaggaaggagatgaaccacgtaagctagctttggagcctgatcaggaagcattaacagatctaaaagatgccggtttgcaattggccgtatcattcagtggagaaggttcaatacttgcgaccggtggtgaggatggacatttaagggtcttcaaatggcctgccatggagtctgttcttacagaagctgatactaaaacatcaattaaggatcttagtttcagttccgatgagaagtttcttgctgtgaataggagcagtggcccatgtagagtgtgggatttgctgtcatctgaagttgtagctaatttgccaagagaagcaggagaaatattcggattctgcagattctctaataagattgacagcagtaacatcttatttataacagcaatgcaaggtgattatgggaaaataatatcttggaatactacctcatggacaagagttggatcaaagaaaataactcgtgaggctatttcagctttcgctgtgtcgcctgatggtgctcttcttgcaattggaacaattgaaggaaccattatcgtactagcgtcaaaagatatgcgaacactcattacagttaaaaaggctcatcttggcattgtaactacgctcgccttctcccaggattccagaacattgctgtcaacttcctttgactcaactgcaagggtgacatcagttgggtccccaaagagtaatggtacaggtgtgtggcccatgctactagttatcattctagcaattttggtatactactgtatgcagcacaaggaagagcttttggcaatgttgcagcgttgagataaatttttgttcaggcgcactgctgatatcacatttacctgcctttgtgattacctgatcctctgcatgagatatgtgcggtattctttagagattgagcaaatttggtcttaggtcaactgccattattttatctaggacagcggaacagcaaaaggtgtttacgcctttaccttgtcatgcttgtatacaaaggggcatgtactcatgtcctctaaagttttgtaagttgatgtcctcgagtgatagtcgtctgtagttatgtttcttcttgcttgattcacatacgagttatgaggagattgttccaagggtccaatatagagttcgaaaacagtttactatgtatgctcttattataaaaaaaaaattcaaagagcctcttagtgtgcc

SEQ ID NO: 26277 - protein, 389 aa, Panicum virgatum
  misc_feature: Ceres CLONE 1868555
  misc_feature (311)..(349): Pfam Name: WD40 Pfam Description: WD domain, G-beta repeat
MAPRGGQSYGFPIYCAAWLPLAHILKPDPPAADADADASPSSPPPPMAALGGGGGEGRSGVPNKLVVAALGPAGEEAALSPEAVVEVKTKEEVPYRMAVHPRGDGVLCAFPNGCRLYRWESQEGDEPRKLALEPDQEALTDLKDAGLQLAVSFSGEGSILATGGEDGHLRVFKWPAMESVLTEADTKTSIKDLSFSSDEKFLAVNRSSGPCRVWDLLSSEVVANLPREAGEIFGFCRFSNKIDSSNILFITAMQGDYGKIISWNTTSWTRVGSKKITREAISAFAVSPDGALLAIGTIEGTIIVLASKDMRTLITVKKAHLGIVTTLAFSQDSRTLLSTSFDSTARVTSVGSPKSNGTGVWPMLLVIILAILVYYCMQHKEELLAMLQR

SEQ ID NO: 26278 - DNA, 632 bp, Panicum virgatum
  misc_feature: Ceres CLONE 1868559
  misc_feature: Encodes the peptide sequence at SEQ ID NO. 26279
accaaccccccaatccatccccaatccccatccgccgggggggctgggagggcgatgcccgaaaaagggggccaccacctcctggaggcgggggggggggcccccttccgcggcctcccccttggggggctccccctctcctccccctcctccccatcctcccctttctctgccagggcctcccccgccccccccccccactcccaccgcgccctctacccccaccgcactgccgccgcggcggcgggggagctcccctccccccccccccccaggcagcccttcctcctccgggtttcccgaaggaccgcctccgggaagaccaccgggggcgacctgatcatccagcaactgcaccaccaccccctcctgctcctaaaccaagattccttccatcggggcctgactgctgaagaatccgcccctgccccaaaataccattttgacccccctgatgcctttgatacccaaccacttctggaatgcatgggaccgcctaaacctgctccacctgtaaatgttcctatatatgatttccagaagcccccaccgtgctccgaaagttttaggaaggtccacgcatccaatgtccttcttttggaaggaattttagtccttcatgatcagaaagt

SEQ ID NO: 26279 - protein, 192 aa, Panicum virgatum
  misc_feature: Ceres CLONE 1868559
  misc_feature: SWISSPROT Homolog: EC 2.7.1.48 Uridine kinase
MPEKGGHHLLEAGGGAPFRGLPLGGLPLSSPSSPSSPFSARASPAPPPHSHRALYPHRTAAAAAGELPSPPPPRQPFLLRVSRRTASGKTTGGDLIIQQLHHHPLLLLNQDSFHRGLTAEESAPAPKYHFDPPDAFDTQPLLECMGPPKPAPPVNVPIYDFQKPPPCSESFRKVHASNVLLLEGILVLHDQK

SEQ ID NO: 26280 - DNA, 658 bp, Panicum virgatum
  misc_feature: Ceres CLONE 1868561
  misc_feature: Encodes the peptide sequence at SEQ ID NO. 26281
accccaccgccttcacccgtgccccccaccccggccctgcttcgacgggcggcggcgcagatcgaaggtgagagagatctctgctcctacccctctcccgatccgaaccgcggcatttctcggaaccaggagggaatgatggatctcggggacagccagcagcggctcatcgccggcgcggcgctgctgctggccaccgtcgccttcgtcaggctcctgctgggctcccgcgcccgcggcaagcgcctcccgcccaccatcccgggggcgccggtcgtcggcgggctcatcaagttcatgcgcgggcccatccccatgatccgggaggagtacgcccgcctcggcagcgtcttcaccgtccccatcctcagccgccggatcaccttcctcattgggcccgaggtctccgcgcactacttcaagggcaacgaggccgagatgagccagcaggaggtgtacaggttcaacgtgcccacctttgggccgggggtcgtcttcgacgtcgactactccgtcaggcaggagcagttccggttcttcaccgaggccctgcgtgccagcaagctccgcagctatgtcgaccagatggttgctgaggctgaggagtacttctcaaagtggggagaaagtggtaccgtgaatttgaagtatgagttgg

SEQ ID NO: 26281 - protein, 173 aa, Panicum virgatum
  misc_feature: Ceres CLONE 1868561
  misc_feature: SWISSPROT Homolog: EC 1.14.13.70 Sterol 14-demethylase
MDLGDSQQRLIAGAALLLATVAFVRLLLGSRARGKRLPPTIPGAPVVGGLIKFMRGPIPMIREEYARLGSVFTVPILSRRITFLIGPEVSAHYFKGNEAEMSQQEVYRFNVPTFGPGVVFDVDYSVRQEQFRFFTEALRASKLRSYVDQMVAEAEEYFSKWGESGTVNLKYEL

SEQ ID NO: 26282 - DNA, 759 bp, Panicum virgatum
  misc_feature: Ceres CLONE 1868572
  misc_feature: Encodes the peptide sequence at SEQ ID NO. 26283
aaagcaaagcaccaaaactcaacacaacacgcacacaccacacacggtacaaaagaaaaaaatcaagtcgaagatgagcaacagcataatgctgtcatcactccccatctgtgctgccttccggtccaaaagcaactccaagtacctgaggtcctgtgccaaccatggcgagggggccgacggccgtgtccttcagctgaccggtgacgatgctgagaacccgctcacgaggttcttcgtcgagaaatcgtgcaagcacaatgggctctttcatatcaggtgcggctacaacaagtactgggtcgctgagaagcggcaaggtgatgaatggtggatcgctggcagtgccgacaagcccgaggaggacctgtccgagttgtcatgcacactgttccagctcaaacctgtcaaggaagatcctaagaccatcaggttttaccatgctcggcttgggaaatattttggcattctctccaattctaatggggaaaacgagaccgacaaagcccttctgcaggcagttgatgaagagcaatcagaacaatttgtgactgagttgttccaatacttgttgcctaaatacgtatgtttcaagggagataatggcaagtacctcagtgcacaatcgctacacaacccagttctggtctttgaatccgagaatatcaaagatccaactgtgatgcacactatcacgccaaatagagatggcaccatgaggataaaatctgatcatttcgacggtttctggaggaactc

SEQ ID NO: 26283 - protein, 228 aa, Panicum virgatum
  misc_feature: Ceres CLONE 1868572
  misc_feature (8)..(151): Pfam Name: Agglutinin Pfam Description: Agglutinin
MSNSIMLSSLPICAAFRSKSNSKYLRSCANHGEGADGRVLQLTGDDAENPLTRFFVEKSCKHNGLFHIRCGYNKYWVAEKRQGDEWWIAGSADKPEEDLSELSCTLFQLKPVKEDPKTIRFYHARLGKYFGILSNSNGENETDKALLQAVDEEQSEQFVTELFQYLLPKYVCFKGDNGKYLSAQSLHNPVLVFESENIKDPTVMHTITPNRDGTMRIKSDHFDGFWRN

SEQ ID NO: 26284 - DNA, 2000 bp, Panicum virgatum
  misc_feature: Ceres CLONE 1868594
  misc_feature: Encodes the peptide sequence at SEQ ID NO. 26285
ctcgatcaacagcaacagcggcggtcagaagcttccgtcgcgacaactcccgacctcgtgccggtctcccccgtctggtactccgcgcgaatccctaggcggcggcggcggaggaggaggaggagcggaggggggcgggcccatcagctatgagcctcgcgggctccgccctggaggcggcgcttcaggcggtggggcgcggcctcgacgccgctggcgaccaccgcctactctactgcaagggcgccgggaggctggtggcgctcgacgaggaccgcgcgcatgacatcccccttagcagcggcggcgtcctctccagcgtgccccgcgaagtctgggtcgagcagtggtccggcaaccccgtgcgaatccggccgcccgtcccccacggcgtgccccccgcagccccggacgagcccttcgtttgcagcttccagcagatggctgagtatttcaacaggaagtcaggcttgtcggagactgtaccgctgggctccttcaactcactgttcagcttcaccggttcatggaagaatgatgctgcggctacgaaggcccttgctattgatggctattctctgccgctgtttcgggtgataaataggagtgaagaactgactctgcttgagagcgttaagcgcgcgattccaaatgtttgggatccatcagcattggctagctttatcgagaattacggaacccatattattacctctgttacggttggtggtaaggatgaggtatacattaagcagcattcatcatcccaattgtcagagctggaattcaaaaattacgtgagggaaatcgggagggaaagattctcagatgtggaaaataagtcaaatgcaactcctatcaattacagcgagaaggatatgaccgtaatattcagaaggagaggtggttgtgatcttgttcaaagtttcagtgattggaaaggaactgttgcctcagcaccagatgtcataggcatgacctttctctcaattgtctctcttgttgatgatataccaggaaaaaagcaccttgctcgtgcagttgagctatacttgacatacaaacctccaattgaagaattgcagtacttcttagattttcaagtcccactagtttgggctccagctccaccaggtattgctggtcaccataggaaggaacctgtctgcccatcgcttcagttcagcttgatgggcccaaagctcttcattagcacagaacagatctctgttggacgtcgaccggtagttggcctcaaactgctcctggaaggagccaaacagaaccgtctggctattcatttgcagcaccttggctcattaccgaaaatattcttacctcactgggactcccatatcaccattggacctccgaaatggcaaggccctgaagagcaggacagccgatggtttgagccaatcaaatggaagaactttgctcatgtcagcacggcacccatcgagtacaccgaaacaaatattacagatctatctggtgtttatattgttacaggagcacagttgggagtgtgggattttggtgcaaagagcgttctccaccttaaactcttgttctcccgagttcctgggtgcacaattagaagatcagtgtgggaccacagcccatcaagttcttcgactcagagaacagatgaatcttcatcatcctctagtgataatgctaaacttgtgaagatcgttgacatgacagagacatcgaaaggcccacaagatgcgcctggccactggctggtcactggagctaaactgggtgtcgagaagggcaggattgttgtgcgtgcgaaatactccttattgaattattaaccaaatgttgaaaagcattcattcactcactctcctatggagcactgtgtttaaagatagcatttgttctttttttttcatgtatggctttcctttcccttgtaacttgatgtggattcgtgcttcttgttgatgccatgagtcaagtagcatgaagatgtttatgccgagttc

SEQ ID NO: 26285 - protein, 558 aa, Panicum virgatum
  misc_feature: Ceres CLONE 1868594
  misc_feature (134)..(303): Pfam Name: MACPF Pfam Description: MAC/Perforin domain
MSLAGSALEAALQAVGRGLDAAGDHRLLYCKGAGRLVALDEDRAHDIPLSSGGVLSSVPREVWVEQWSGNPVRIRPPVPHGVPPAAPDEPFVCSFQQMAEYFNRKSGLSETVPLGSFNSLFSFTGSWKNDAAATKALAIDGYSLPLFRVINRSEELTLLESVKRAIPNVWDPSALASFIENYGTHIITSVTVGGKDEVYIKQHSSSQLSELEFKNYVREIGRERFSDVENKSNATPINYSEKDMTVIFRRRGGCDLVQSFSDWKGTVASAPDVIGMTFLSIVSLVDDIPGKKHLARAVELYLTYKPPIEELQYFLDFQVPLVWAPAPPGIAGHHRKEPVCPSLQFSLMGPKLFISTEQISVGRRPVVGLKLLLEGAKQNRLAIHLQHLGSLPKIFLPHWDSHITIGPPKWQGPEEQDSRWFEPIKWKNFAHVSTAPIEYTETNITDLSGVYIVTGAQLGVWDFGAKSVLHLKLLFSRVPGCTIRRSVWDHSPSSSSTQRTDESSSSSSDNAKLVKIVDMTETSKGPQDAPGHWLVTGAKLGVEKGRIVVRAKYSLLNY

SEQ ID NO: 26286 - DNA, 658 bp, Panicum virgatum
  misc_feature: Ceres CLONE 1868637-R
  misc_feature: Encodes the peptide sequence at SEQ ID NO. 26287
catgggatccgagtgcacggcgtccctcgccaagtacctcgacaacatgagcaggtctgagatcgggtgggacgtgcggatcgggctgagcgcctaccgctccttcagtagcagggactacctcaacgcgcagcgcctccggtgccggcagatgtacttccacgagaggatcttcgaggcggccgacgcgatcgtcacgccgatgacaggggtgaccgcgtacccgctgcaggacgacgcgctgagcacgggggagctcgactacatcaacggagctgcgctggtgcggtactcgatcgcgggcaacttcctgggtctgccggcgatcaccgtgccggtggggcacgacggaggggggctccccgtggggctgcagctcgtcggccggccatggtcggaggccacgctgctgcacctcgcccatgccgtgcaggaggcctgctgggagcaccgccgcgagccgcccaaggtgcacttcgacctgctcgctcctcgccaaagactgacgacaggccttgccccttgacgacagtcaattgctcctcggttgcgattgagtgcataattgttaatttattattcttgtgccaggagagtgcgttggttaatttgagcatcaacaagatgataacgaactttatgcctctatttttcatgc

SEQ ID NO: 26287 - protein, 174 aa, Panicum virgatum
  misc_feature: Ceres CLONE 1868637-R
  misc_feature: SWISSPROT Homolog: EC 3.5.1.4 Amidase
MGSECTASLAKYLDNMSRSEIGWDVRIGLSAYRSFSSRDYLNAQRLRCRQMYFHERIFEAADAIVTPMTGVTAYPLQDDALSTGELDYINGAALVRYSIAGNFLGLPAITVPVGHDGGGLPVGLQLVGRPWSEATLLHLAHAVQEACWEHRREPPKVHFDLLAPRQRLTTGLAP

SEQ ID NO: 26288 - DNA, 1479 bp, Panicum virgatum
  misc_feature: Ceres CLONE 1868637
attgccagtaggaaggcagccacagtcaggcaaagttttcagacaacgtcaccattcttcctgctgcaacttcgcttcgctttgttcatccatcgatccatggggctcttcagctcgccggccaaggtctacaagccggcggcggaggtcgacctcggcccgggaagcgacgagcactacatcagccccaacgtcagagctcctcgcgtcgccggtctgctggtgaagttgctggcgtgggtgctggagacgcccgtcctcggctggatcgtcctgaccgtcctcaagagggacaacctcgtctacaagctcgtctcggacgccgagatcccggagccgccgctgttcaccgccacccacacctggcgagacatccccgagcagaacgtccggcggacgaagccggggtcgtcgccggcggagcgcgtccaggaggccgtcagctgcctcccggctcgcctgccggcgcccggtggtggcccggcgtcggggttcaggcgctggacggtgcgggacttccacagggcctacagctcgggacagacgacccctgccatggtggcgcggaggttcctgacggcggtgaaggaatgctcggatctgaagatggccgtgttcatcagctgcgacgccgccgacgtgatgcggcaggccgaggactccacccgcagataccagcaaggcatggattcagctccgaatccgtgctgaattaccttggctcgtatggtcctggatccctgagacgggcattcattgcggcgccatggcgacgcatgtggccagagccctcgagcgcaggggaacggacgggggaaatgaaggcggccggcgagacattgcatcttctatctcctcgtcactgcattcagatgcgttgcatcgttcgtgttagagttattggtcgatggttgtgaatgattgattggatgcttcgtcttcgtgattgctgctgctgctggtgcaggggcgccgctgtccgccatggacggagtgctggtcgccgtcaaggacgagctcgactgcctgccgtacccgaccaccggcgggacgcggtggctcggggcggcacggcggggcgcggcggacgcggcgtgcgtggcgcagctgcgggcgtgcggcgccgtgctcgccggcaaggccaacatgcacgaactcggcgccgggaccagcggcatcaacccgcaccacggcgccacgcggaacccctgcgaccccgccagggtctccggcggctcatccggcggctccgccgccgccgtctgcgccggcctctgccccgtcgccctcggcgccgacggaggcgggtccgtgcgcatgccggcggcgctctgcggcgtcgtcgggttcaagcccaccgccggccgcctctccaacgccgggctgcttcctctgaactggaccgtcggcatgccggggatccttgcagccaccgtcgaggacgcgctcatcgcttacgcggccatcgttgatcagtcc

SEQ ID NO: 26289 - DNA, 747 bp, Panicum virgatum
  misc_feature: Ceres CLONE 1868670
  misc_feature: Encodes the peptide sequence at SEQ ID NO. 26290
ctcctgctcccaacgacccaacctcggaatctccccctcccccggggcaggggcaccctatatagaccccgccgcccggcccccgatccgcacctacctccctcacccgtgccccccccaccctggccggccctgcttcgacgggcggcttcgcagatcgaaggaaccaggagggaatgatggatctcgcggacagccggcagcggctcctcgccggcgcggcgctgctgctggccaccgtcgccttcgtcaagctcctgctgggctcccgcgcccgcggcaagcgcctcccgcccaccatcccgggggcgccggtcgtcggcgggctcatcaagttcatgcgcgggcccatccccatgatccgggagcagtacgcctgcctcggcagcgtcttcaccgtccccatcctcagccgcaggatcaccttcctcatcgggcccgaggtgtcggcgcacttcttcaagggcaacgaggccgagatgagccagcaggaggtgtacaagttcaacgtgcccacgtttgggccaggggtcgtcttcgacgtcgactactcagtcaggcaggagcagttccggttcttcaccgaggccctgcgggccaacaagctccgcagctatgtcgaccagatggttgctgaggctgaggagtacttctcaaagtggggagaaagtggtaccgtggatttgaagtatgagttggagcacctcatcatactgacagctagtccatgcttgctgggaaggggag

SEQ ID NO: 26290 - protein, 189 aa, Panicum virgatum
  misc_feature: Ceres CLONE 1868670
  misc_feature: SWISSPROT Homolog: EC 1.14.13.70 Sterol 14-demethylase
MDLADSRQRLLAGAALLLATVAFVKLLLGSRARGKRLPPTIPGAPVVGGLIKFMRGPIPMIREQYACLGSVFTVPILSRRITFLIGPEVSAHFFKGNEAEMSQQEVYKFNVPTFGPGVVFDVDYSVRQEQFRFFTEALRANKLRSYVDQMVAEAEEYFSKWGESGTVDLKYELEHLIILTASPCLLGRG

SEQ ID NO: 26291 - DNA, 2020 bp, Panicum virgatum
  misc_feature: Ceres CLONE 1868690
  misc_feature: Encodes the peptide sequence at SEQ ID NO. 26292
gcatcatgccggcgccgctgcttgctcactcccactagcagcagcttctgccgccgcgccatgtgctcgcagcctccgcctcccgcgcactgaccgccgccgcaccgacacgcccacaggcaggcaggcaggcaccgccgcgagaccaccatgcgcccgccccgccggccgccgcccccgtccccggcgccgtcccccgcgccgctctctcgcgacgccagccattcgccgccttctccctacgcggcggcgttcgtgtcctccccgggccctgcgccgggtcccggcccaggtcccgcgccggagccgctcgcgggcggcgagcggcgggcgggcgggagcctgagcccgccgctcatcgcgatgctggcggtggtgggcgcggcgctgctggtggtgctgtacgcgcgcctggtgagccgggtgttccgcgcggcgcggcggcggtggcgccggcgccggctgcggctgctcatggctccgggcggcggccccttctccccctcctccgcgcgcggcggcggcggcgacggctccttcgcgtccttcaccacctacgacaactactaccacaccttctcgccctactgcggcctcgacgccgccgccatcaagtcgctgccctcggcgcagtacctggcggcggcgcgcgggtcgggggcgtccagggagtgcgccgtgtgcctgctcgagttcgcggacggcgacgagctccgcgcgctgccgctgtgcgcgcacgccttccacgccgactgcatcgacgtctggctccgcgcgcacgcctcctgcccgctctgccgcgccgccgtcgcgctcccgccgcccgtcgcgtcgccgctccaccgcgcggcgcggcgggtgcggcccagcctcgacgacctcctcttcttccacccggtcccgcccgacgccgccgcgccgcccgagatcgcgccggccagcccggaccagctccgcggcgccagggacttgctgctgctcaagcgctcctactccttcggcttcgagcgcagcctcgccgtggaggccgcgtccacggcctcccctccctggcgctaccgcgtctcctccgccgccaccggcgacggcgccacctcccgcggccgcagcttctggagcaagcgctggccgtccccgttcggcggcgggggcgggggctccgcggccgccgcccgcgtcttctccttccgctcgtaccgctccgcggcgggcaagtcctcccccttctcccgccgccgcggccacggcggggccgggagcgggttcttcatgtcgctggcgtcggagccgccctcgatcctgggcgcggcgaggcggggccgcgcggccgccgcgtccagccggctccggtgcggggaccccgaggcgctgctctcgccggaccggctccgccgctgaccccgcccgccgccgttggtgacgcgaccgcgccgcggtggtgagcggatctcggtggcgcggtgggcctggcgcccgcgtgggggcgggggcggggcagtaatggcgcgaataaatgcgaggccctgcctgccaaggttttaatggcgggaggacgcgcgcccagagcgagccgtgtcgcttcccgcagcaggcaacagtgtccctgcctcggcttgccgccggtttcaactttttgccccttcctttctcctccggcccgccagccagccgtctggcttgaccaagcgcgtggacgcggtggtggaaggccgtccgatcagaaaacgacggcggcgtccggcggttgaccggagccgtcgttttctcgccggacggtccggctcatcggaggggatcgcgtacggttccgttggtctggatggaccgttttgtccgtctcttggctccggtgtcggctttgtgtgttccgaactgtgtttcaatggtgttaattaatgttaactactaccttagtatgcttctcaaagtatttagccgatcgaaatgggaaagcgtcgttactgtgatcataggaggctacacctcatttttttaattacaaagtacaattcaaatactt

SEQ ID NO: 26292 - protein, 344 aa, Panicum virgatum
  misc_feature: Ceres CLONE 1868690
  misc_feature (104)..(145): Pfam Name: zf-C3HC4 Pfam Description: Zinc finger, C3HC4 type (RING finger)
MLAVVGAALLVVLYARLVSRVFRAARRRWRRRRLRLLMAPGGGPFSPSSARGGGGDGSFASFTTYDNYYHTFSPYCGLDAAAIKSLPSAQYLAAARGSGASRECAVCLLEFADGDELRALPLCAHAFHADCIDVWLRAHASCPLCRAAVALPPPVASPLHRAARRVRPSLDDLLFFHPVPPDAAAPPEIAPASPDQLRGARDLLLLKRSYSFGFERSLAVEAASTASPPWRYRVSSAATGDGATSRGRSFWSKRWPSPFGGGGGGSAAAARVFSFRSYRSAAGKSSPFSRRRGHGGAGSGFFMSLASEPPSILGAARRGRAAAASSRLRCGDPEALLSPDRLRR

SEQ ID NO: 26293 - DNA, 1425 bp, Panicum virgatum
  misc_feature: Ceres CLONE 1868700
  misc_feature: Encodes the peptide sequence at SEQ ID NO. 26294
aaaaccatccgccccaccggacaccgcaccaacgggctcgctcgctccagcctccgccccctcgccgcacacctccgtaaaacccacccgattccgcctaaaccccccaccgcgatcctcgacaattcagcggccgcgatgcagggtctcgccccgcccacctctgtttccatacaccggcgcctgccggccgggtccagggcgacccgggcccccagctcggtgaggttcgcgccgcgcgccgcgcccgccgagtgcctgccgccggcggcgttcaagcccgccgagctgccggcgcccaggaagcacgccgccgccattgccgcgccgaggccctccgcgccggcgccggcctcgccgccgcggacggcggggaggaagaaggagctcaacctcttccagcgcgccgcggcggcggcgctcgacgcgttcgaggaggggttcgtggcgggcgtcctcgagcgcccccacggcctgccccggacggccgacccggccgtgcagatcgccggcaacttcgcgcccgtcggggagaggccccccgcccgcgagctccccgtctccggccgcatcccgcccttcatcaacggcgtgtacgcgcgcaacggcgccaacccctgcttcgaccccgtcgccgggcaccacctcttcgacggcgacggcatggtgcacgcgctgcggatacggaacggcgtcgccgagtcctacgcctgccgcttcaccgagaccgcgcgcctgcgccaggagcgcgcgatcggccgccccgttttcccaaaggccattggcgagctgcacggccactccgggatcgcgcgccttgctctgttctacgcgcgcgccgcgtgcgggctcgtcgatccctcccacggcaccggcgtcgccaacgccggcctcgtctacttcaacgggtacctcctcgccatgtccgaggacgacctcccgtaccacgtgcgcgtcacggacggcggcgacctcgagaccgtcggcagatacgacttcgacggccagctcgggtgcgccatgatcgcgcacccgaagctcgacccggccaccggcgagctccacgcgctcagctacgacgtcatcaagaagccgtacctcaagtacttctacttcaggcccgacggcaccaagtccgacgacgtcgagatcccgctcgaccagcccaccatgatccacgacttcgccatcaccgagaacttcgtcgtcgtgcccgaccaccaggtggtgttcaagctccaggagatgctgcgcggcggctcgcccgtggtgctggacaaggagaagacgtcgcgcttcggcgtgctccccaagcacgccaaggacgcgtcggagatggcgtgggtggacgtgccggactgcttctgcttccacctgtggaacgcgtgggaggacgaggagaccggcgaggtcgtcgtcatcggc

SEQ ID NO: 26294 - protein, 428 aa, Panicum virgatum
  misc_feature: Ceres CLONE 1868700
  misc_feature (103)..(428): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature: Useful for making plants with modulated water use efficiency
  misc_feature: The sequence is a functional homolog of SEQ ID NO 6 in US patent 7049487
  misc_feature: Useful for making plants with modulated drought sensitivity
MQGLAPPTSVSIHRRLPAGSRATRAPSSVRFAPRAAPAECLPPAAFKPAELPAPRKHAAAIAAPRPSAPAPASPPRTAGRKKELNLFQRAAAAALDAFEEGFVAGVLERPHGLPRTADPAVQIAGNFAPVGERPPARELPVSGRIPPFINGVYARNGANPCFDPVAGHHLFDGDGMVHALRIRNGVAESYACRFTETARLRQERAIGRPVFPKAIGELHGHSGIARLALFYARAACGLVDPSHGTGVANAGLVYFNGYLLAMSEDDLPYHVRVTDGGDLETVGRYDFDGQLGCAMIAHPKLDPATGELHALSYDVIKKPYLKYFYFRPDGTKSDDVEIPLDQPTMIHDFAITENFVVVPDHQVVFKLQEMLRGGSPVVLDKEKTSRFGVLPKHAKDASEMAWVDVPDCFCFHLWNAWEDEETGEVVVI

SEQ ID NO: 26295 - DNA, 544 bp, Panicum virgatum
  misc_feature: Ceres CLONE 1868700-R
cttcatcacggccagcgagctcgaggcccaggcctgatcgcctgagctcccgttcgctccccacctacctccgcgtttcttggagggggcaggagggcgaggaggaacagaggagacacgagccatggatcaggggagaagtcaccagagggagcctcggccatagtaggtccccggagtcttcgccgtccccgacaccacagttacagcagttggtagttaaatttccaatttttttagtgtaattaagagtgtattttagttgggatagtggcagattagagaaaggggcccagctcgtatcttttcagctggtgcttgcttctagagagcagccagagctcagctggtgcctactgctagtatagctagcgttcggcaggctggagctggaggttattgttggagtggtgtgagagaaaacactgttacctggctggtgactggaggctagtactggagtgatatgagagagaaatattgtaggactggaggctggtgcaccagccgaacacggtgatagtctatatttttttttggttcc

SEQ ID NO: 26296 - DNA, 2201 bp, Panicum virgatum
  misc_feature: Ceres CLONE 1868703
  misc_feature: Encodes the peptide sequence at SEQ ID NO. 26297
ctctaccttagacgttagcgcagttccatcgggtgcttgagcagctccgccgaggcttgcgcggacttgaacccgtcgtgcggggagggcgagggcgtgccggcgtcggtcgccgcgctgcgcggagcgccactgtccgcgacgagccgccggacaggacgagcgtggacactctgcacgcagcagcacgagcgccgctggcagccgtccggtgtccgattgggaaggatgaaatcaaagaggcaaaaacggcgagctagctagggagggaaaccggaggcgctgccgcgagcttcgacggcggcggattggttctgacgctgcggcgtgggctcggccagcggtgcggcggcgcggcacgctcgcgctctcggtggcttggccggcgctgcgggcctgtgagctgcggcgcagttgacccttcgtagcgtgaaggccacctagaagaaccggaaggcaccattcccgctgccatttgcaaattgcaagaatcaagacaccaaacgacaagctagaacaaaccagcaaggatacggtatccaaggcacagttttttccctcaagataactgggtattcatctgactcgatgccccaagtgaaggccgcctctgcgctggtgaaccggccggtgcccgcaccttcattgttggagctcagagcccgtagactctacagtcatagccatttcccctcaacatctcgtatttcctgctcatcagagttctcagatagatgttctgccaaggagttggaagcatctgagtacactgacgatacatatgctgagaatgctgctgacagggatgaagaaggggagtgtttaggatggagcaaagaagaaattgatgccatttctgcactcttcgaccggccaatgcgtcaggagcccctgaagccgccaaaccccatgaggcagcgggcgctcccattgccactaccgcacaagacgaggctgcctatcggtccggcgcccaagcagcatgtccggcttgctgcaagagctgcgctgtcatctcgcgcttccttcagctatcaggtgtgcaaaaacccggaattcctacttgggattgctcgggagatcgctgggcttcctccagagcatggtgtctccatggtgctcaaccggtgggcgaggtttctccgaaaaggttccttgtcactgaccatccgtgagctggggcacatgggattccccgagcgcgcactgcaaacattgtgctgggctcagaggcagaaagttgtgccattgttccccgacgaccgggttcttgcttccaccattgaagttttggctcgttttgaccagcttaaagtggagtctgcattggagcaatgcgcccccacggcgagccgtgctgttcttgaagccatggttagcgggttcatcagggcagggaaagtagaccttgcgcgcaaactcctggaacttgcaaggatcaataacaggacactgcaccccagcatctatgtgaagctgatgctggaagccatccggacacctgaaggttatgggcttgcctcagcattggttgatgatcttggtgataggtcggacttggagcttcgcccgcaggactgtacggctgtcatgaaagtctgcataaagcttcgacggtacgcagccgtggagagcctgttcagttggttcaggggatctggtgggagccccaccttggttatgtacacaacagtgatccacagccgctaccgtgacggtatgcaccgcgaggctctgtccctggtgtgggaaatggagcagattggttgtctgcttgacctgccagcctaccgggtcattatcaagttgtgtgtggcgttgcatgacccagagagaggcctccggtatttatcaaggatgaaggaggctgggtttgtcccaatgggcgacatgtacaatgatctgatagaaggttatgtggctgaggggaggttggccaagtgctggcagctgatcagggaggccgagtcggtcggtttgaaactggacaggaggctgctcgcacgcttgtctgaaactggagatgtccattcttgttgactctccgagtgttgttgtcatctcacagacagagtagaacaggaacaaaaatacacacacttctgtgtaattgctcttttgtgtaaaccttgttttcagatgaattatcatctggagtataatctttgtagtacaagaaaggggtcaagcaattacgtttc

SEQ ID NO: 26297 - protein, 483 aa, Panicum virgatum
  misc_feature: Ceres CLONE 1868703
  misc_feature (364)..(398): Pfam Name: PPR Pfam Description: PPR repeat
  misc_feature (434)..(468): Pfam Name: PPR Pfam Description: PPR repeat
MPQVKAASALVNRPVPAPSLLELRARRLYSHSHFPSTSRISCSSEFSDRCSAKELEASEYTDDTYAENAADRDEEGECLGWSKEEIDAISALFDRPMRQEPLKPPNPMRQRALPLPLPHKTRLPIGPAPKQHVRLAARAALSSRASFSYQVCKNPEFLLGIAREIAGLPPEHGVSMVLNRWARFLRKGSLSLTIRELGHMGFPERALQTLCWAQRQKVVPLFPDDRVLASTIEVLARFDQLKVESALEQCAPTASRAVLEAMVSGFIRAGKVDLARKLLELARINNRTLHPSIYVKLMLEAIRTPEGYGLASALVDDLGDRSDLELRPQDCTAVMKVCIKLRRYAAVESLFSWFRGSGGSPTLVMYTTVIHSRYRDGMHREALSLVWEMEQIGCLLDLPAYRVIIKLCVALHDPERGLRYLSRMKEAGFVPMGDMYNDLIEGYVAEGRLAKCWQLIREAESVGLKLDRRLLARLSETGDVHSC

SEQ ID NO: 26298 - DNA, 2225 bp, Panicum virgatum
  misc_feature: Ceres CLONE 1868720
  misc_feature: Encodes the peptide sequence at SEQ ID NO. 26299
ctcgtcttccacttgccctcccccggctccacgcggggtggtgagctgtcgcctctccgcgtgagctgaggcggcggcgaggtggagctcggcgtcgcaatggcgacggcggaggcggcggcggagatcgtgcgggagatcgcagcggtgggcgccgccgccgagccgctgcgcgcggactgcctccgcctcgcgcggaaggtgtccctgctgtcgcacctcgtcgccgaggtcgccgaggcgggggagggcgacgcggcggccgcggcctgggtgcgcgagctggtgagggcgctcgaggccgccagaaggttcgtcgcgctggggcgaacgccgccggccgctgcgggggcgtcagatcaggatgccatctgcaacaatactgctctccagttcaagtatgtgacctggcagttgcaagctgctctagtcaaccttccacatagctgttttcagatatcagatgaagttcaagaagaggtcgacttagtgcgatctcagcttaaaagagaaatggaaaagaagggagcccttgatgtaaccgtgtttacaaaagttcatgatatcttagctcaaattgacaatgctggaccacaatctcaacaaccccatcaacaaccagagcaatcgcagatggagaaatttagtaaagatcatctggagttgcaaaatgctgttttactagtttcagaaataagcgggttatccaaatctgacatgacgaaaataacatccgagctaattgaagggcttgaaaatgttggaactcctgattctcccaaacctgccaatattgatagccaatcaagtgatgaaacaaaaagctcatctgaggaagttaagaagcctgactctgtagctattcctgaggatttccgttgcccgatatctctcgagttgatgagagatccggtaattgtttcaacaggacagacctatgagcgggctttcatccagaggtggattgactgtggaaaccggacctgcccaaaaacccaacagaaactccagaatcttacattgaccccaaactatgtactaagaagtttaataatgcagtggtgtgaggaaaaggggatcgaaccacctagtagatctaaaagtgatggttcttctcatgaggtcggtgggaacagattagcaattgaagcattggttcgcaatctctctagcagctcattagatgaacggaaatctgctgctgctgaaataagatctttggccaagaaaagtacagacaatcgtatacttctagcggagtctagtgctatcccggctctagtgaaacttctgtcgtcgaaggaccagaaaacccaagaacatgcagttacagctcttctgaatctctccatatatgatcagaacaaggaactgatagtggttgctggtgccattgtcccaatcatacaagtgctgaggacaggtagcatggaagcaagagaaaattcagctgcagctattttcagcctgtcactaatcgacgataacaagataatgataggaagcactccaggggcaattgaagcattggttgagttgttgcagagtggtagctcgaggggtaaaaaggatgcagcaacggcattgttcaatctatgcatataccaagctaataaggtcagggcagttcgagcagggatcctggtgccacttatgcggatgctacaggattcatccagaagtggcgccatcgatgaagcgctgaccattctgtcagttcttgtgagtcataatgagtgtaaaattgctatatctaaggcacacgcaataccctttttgatagatttgcttcggtcgggtcaggcccgtaacaaggagaatgctgcttccattttacttgcactttgcaagaaagatgctgagaacctcgcctgtattgggaggcttggtgctcagataccactaattgagctggcaaagaccggcacagaccgagctaagcgcaaggcaacctcactcctggagcatctcagtaagttacaggtgctctagttccactgtccaccgcacaccgttttgtgcgtgtgcatgtgcgtgtttttcaacttttcacgtgtatgtatacatacagtcatctgtcatcgagtgtgaattttagtgggttggtgattagattgtttcagtcaaaatcagacaggtgttaatcgattcgcaccataaatttgttggtgctgttgaatctgtgatgttcagttgctcatctagtttgatcagcttctagtctc

SEQ ID NO: 26299 - protein, 630 aa, Panicum virgatum
  misc_feature: Ceres CLONE 1868720
  misc_feature (378)..(418): Pfam Name: Arm Pfam Description: Armadillo/beta-catenin-like repeat
  misc_feature (460)..(501): Pfam Name: Arm Pfam Description: Armadillo/beta-catenin-like repeat
  misc_feature (544)..(584): Pfam Name: Arm Pfam Description: Armadillo/beta-catenin-like repeat
  misc_feature (254)..(328): Pfam Name: U-box Pfam Description: U-box domain
MATAEAAAEIVREIAAVGAAAEPLRADCLRLARKVSLLSHLVAEVAEAGEGDAAAAAWVRELVRALEAARRFVALGRTPPAAAGASDQDAICNNTALQFKYVTWQLQAALVNLPHSCFQISDEVQEEVDLVRSQLKREMEKKGALDVTVFTKVHDILAQIDNAGPQSQQPHQQPEQSQMEKFSKDHLELQNAVLLVSEISGLSKSDMTKITSELIEGLENVGTPDSPKPANIDSQSSDETKSSSEEVKKPDSVAIPEDFRCPISLELMRDPVIVSTGQTYERAFIQRWIDCGNRTCPKTQQKLQNLTLTPNYVLRSLIMQWCEEKGIEPPSRSKSDGSSHEVGGNRLAIEALVRNLSSSSLDERKSAAAEIRSLAKKSTDNRILLAESSAIPALVKLLSSKDQKTQEHAVTALLNLSIYDQNKELIVVAGAIVPIIQVLRTGSMEARENSAAAIFSLSLIDDNKIMIGSTPGAIEALVELLQSGSSRGKKDAATALFNLCIYQANKVRAVRAGILVPLMRMLQDSSRSGAIDEALTILSVLVSHNECKIAISKAHAIPFLIDLLRSGQARNKENAASILLALCKKDAENLACIGRLGAQIPLIELAKTGTDRAKRKATSLLEHLSKLQVL

SEQ ID NO: 26300 - DNA, 2227 bp, Panicum virgatum
  misc_feature: Ceres CLONE 1868729
  misc_feature: Encodes the peptide sequence at SEQ ID NO. 26301
ccaacccaagctccgatcctcttcactcgaggtcgcccccaagttccaccgccactactcacgtccgtccccaccgccagaccagctggctccgtcgaccccaattctcagttctcatcagctcctgaccgatttgattagctcccttccgaccggcaatggcgtcgtccgtcactgctcccccggcggcggctccggccgccgtgcaagcgccggcgaaggccaagaagccgacgcagctcagccccggcaccggcaaggccaggaccgcggcccccgcgcggccaatgcgcgccgctaccttcgggcccaagtggaacccgctccagcggctcgcggcggcggcgctggacgcggtggaggaggggctcgtggcggggatcctcgagcgcgcgcacccgctcccgcggacggcggacccggccgtgcagatcgccggcaactacgcgcccgtcggggagcgcccgccccgccgcggcgagccgctccccgtcgccggccgcgtcccggcgtgcctggacgtggtctacgtccgcaacggcgccaacccgctccatgcgccgcgcgccgggcaccacctcttcgacggcgacggcatgctgcacgccgtgcggctccgcggcggccgcgccgagtcctacgcctgccgcttcacggagacggcccggctccggcaggagcgcgccatcggccggcccgtctttcccaaggccatcggcgagctccacggccactcgggcgtggcgcgcctgctcctcttcggcgcccgctccctctgcggcgtgctcgacgcctcgcaggggatcggcgtcgccaacgccggcctcgtctaccacaacaaccgcctcctcgccatgtccgaggacgacctcccgtaccacgtgcgcgtcgccgccgacggcgacctcgagaccgtcggccgctacgacttcggcggccagctcgacggcgccatgatcgcgcaccccaagctcgaccaggccaccggcgagctcttcgcgctcagctacaatgtcgtctccaagccgtacctcaaatacttctacttcgccgccgacggccgcaagtcccccgacgtcgagatccccgtcgacgcgcccaccatgatgcacgacttcgccatcaccgagaaccacgccatcatccccgaccagcagatcgtcttcaagctccaggagatggtgctcggcggctcccccgtggtgtacgaccggagcaagaccgcgcggttcggggtgctgccgaagcgcgccgccgacgcgtcggagctccggtgggtggaggtccccgactgcttctgcttccacctctggaacgcgtgggaggacgaggccaccggcgagatcgtcgtgatcgggtcctgcatgacccccgccgacgccgtgttcaacgagtccgccgccggcgaggagagcttccgcagcgtgctctcggagatccggctggacccgcgcgccggcacgtcccggcggcgcgcggtgctgagcgacgccgaccaggtgaacctcgaggccggcatggtgaaccggcagctgctgggccgcaagacacgctacgcctacctcgccatcgccgagccgtggcccaaggtgtcgggcttcgccaaggtggacctggaggccggcaccgtcgagaagttcttctacggcgagggccggtacggcggcgagccctgcttcgtgccgcgcccggacgccggcgccgccgaggacgacgggtacgtgctgggctacgtgcacgacgaggcgcgcggagcgtcggagatgctcgtcgtgaacgcccgcgacatgcgggcggaggccgccgtcaagctgccggggcgcgtgccgtacgggctgcacggcacgttcatcgccggcgacgagctgcagcggcaggcctagcgggcgacgcgagagctgcctcggcgatcacgaactctcgaccacctcgcgtacatacagagacttattacagtgcacagtatgtagctagtagcaggctgctagtgacgtggcaactaaattattcacagctagttgttgcttagcttagtacagggaatttaatatgttttttcattagagcagtagataggatgctgattacggccgtgtggtactgatttttggggcagacgtacgccggccgtatatgtgtatagcacctagttattacctgtgtgatgtatataggaattacaaacttgtagaattttctgtgcagaaataaagggatttatgtacag

SEQ ID NO: 26301 - protein, 574 aa, Panicum virgatum
  misc_feature: Ceres CLONE 1868729
  misc_feature (72)..(567): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature: Useful for making plants with modulated water use efficiency
  misc_feature: The sequence is a functional homolog of SEQ ID NO 6 in US patent 7049487
  misc_feature: Useful for making plants with modulated drought sensitivity
MASSVTAPPAAAPAAVQAPAKAKKPTQLSPGTGKARTAAPARPMRAATFGPKWNPLQRLAAAALDAVEEGLVAGILERAHPLPRTADPAVQIAGNYAPVGERPPRRGEPLPVAGRVPACLDVVYVRNGANPLHAPRAGHHLFDGDGMLHAVRLRGGRAESYACRFTETARLRQERAIGRPVFPKAIGELHGHSGVARLLLFGARSLCGVLDASQGIGVANAGLVYHNNRLLAMSEDDLPYHVRVAADGDLETVGRYDFGGQLDGAMIAHPKLDQATGELFALSYNVVSKPYLKYFYFAADGRKSPDVEIPVDAPTMMHDFAITENHAIIPDQQIVFKLQEMVLGGSPVVYDRSKTARFGVLPKRAADASELRWVEVPDCFCFHLWNAWEDEATGEIVVIGSCMTPADAVFNESAAGEESFRSVLSEIRLDPRAGTSRRRAVLSDADQVNLEAGMVNRQLLGRKTRYAYLAIAEPWPKVSGFAKVDLEAGTVEKFFYGEGRYGGEPCFVPRPDAGAAEDDGYVLGYVHDEARGASEMLVVNARDMRAEAAVKLPGRVPYGLHGTFIAGDELQRQA

SEQ ID NO: 26302 - DNA, 697 bp, Panicum virgatum
  misc_feature: Ceres CLONE 1868745
  misc_feature: Encodes the peptide sequence at SEQ ID NO. 26303
aaaataacaaggcgcagaggcaaccttgattcgacgtgcgcttcctcctcgctcgcgggtacctttccgtcatcgtctcgtctttcagctagatctctcctgctcgatctgctcagaccgcgctgcaattttttctgcgacccgatctaatctattcacggagatgtctgacgttgaggagtaccgttgcttcatcgggaacctgtcatggtcgacaactgatgagagcctcaaggatgcattcggcaaatttggaaacctcactgaggcaaaggtggttcttgacaaattttctggccgctctcgtggtttcggctttgtaacatttgatgagaagaaagctatggaagatgctattgaaggaatgaatgggctggacttggacgggaggaacattactgtcgataaagctcagccacaagggcttggtagagatcgtaatggtgaccgtgattatgaccgtggatctcgttatgaccgtggccgtgactatggtggtggtggacgtgcaccacgtggcggcggcggcggcggggactgcttcaagtgtggaaaacctggtcattttgctagggagtgcccatctggggatggtgggagaggggatagatatggtggcagagatgacaggtatggcggcggcggcagtcattatggatctgaccgtggtggtggtggtgaccgatactctggccgt

SEQ ID NO: 26303 - protein, 177 aa, Panicum virgatum
  misc_feature: Ceres CLONE 1868745
  misc_feature (9)..(80): Pfam Name: RRM_1 Pfam Description: RNA recognition motif. (a.k.a. RRM, RBD, or RNP domain)
  misc_feature (124)..(141): Pfam Name: zf-CCHC Pfam Description: Zinc knuckle
  misc_feature: SWISSPROT Homolog: EC 5.2.1.8 Peptidylprolyl isomerase
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Useful for making plants with altered lignin content
  misc_feature: Useful for making plants with modulated biomass
  misc_feature: Useful for making plants with modulated nitrogen use efficiency
  misc_feature: Useful for making plants with modulated flowering time
MSDVEEYRCFIGNLSWSTTDESLKDAFGKFGNLTEAKVVLDKFSGRSRGFGFVTFDEKKAMEDAIEGMNGLDLDGRNITVDKAQPQGLGRDRNGDRDYDRGSRYDRGRDYGGGGRAPRGGGGGGDCFKCGKPGHFARECPSGDGGRGDRYGGRDDRYGGGGSHYGSDRGGGGDRYSG

SEQ ID NO: 26304 - DNA, 2713 bp, Panicum virgatum
  misc_feature: Ceres CLONE 1868746
  misc_feature: Encodes the peptide sequence at SEQ ID NO. 26305
cccgcccccgcgcgtcccagtcagtagagacgccaccgacgaagttcctgctgtcccaccacaccgacgacggcatcgtctccgaccccatgtccgagctcagtcaaggtttatttgattagggtatcggggtaggtgcagaacagcagaacccttgaacaagaggcaccatctttcacactcttggttgggttgatggttcaacacttcaaccggtgatacaaagcttgcgaggtctgacattagcatcaatatttggttgctgctaccacgcaacaaacacacaaggtgagacagagaggacagcaatggctgacctagtgcttggggtagccaagtcgctggtggagggtaccctgaccaaggctcagtcagccattgatgaggagtcaaagctgcggcagagcgcacagcgtgacctggtgttcatcgctggagagtttcagatgatgcagtctttccttagggtcaccaccgaagagcaagtcaggaccaatgttgtcagcatcacatgggtgattcaggtccgtgacctggcctatgatgtagaagattgcatcgagttcgtcatccatctggacacaaagtccgactggtggcgccgcttgatcccatcattcatgcgccgggcgctacccctggatgtggccgtcaacatgatagatcagttgaaggcaagagtccatgatgtgagccagaggaacgagcggtacaaacttatcagcgaccctggtcccaagcctgtcatggaagcgagacaattgggtatctctggtgcctctggcgtgctcgcgacagcaagggacactgcatggaagcaacaagaatgggaaaacttcgtcaagctgatcatcaagaaggacagcaagcttcaggatccccttgttgggcgcatgtctgaagtaaatcaactttctgcatatcttgctaaagcacgttcgaatgctttgcaagtgatgtctgtgtgggggatagctggtgctgggaaatctgctcttgttagaactttgtaccacaacaagatgagtaagcatagagaatatgaaaagtatatctgggtggatgtatactacccgtttaatttaatggacttctgtaagagcctacttatgcaattccattcacattctcttgagacaaatgaagaccctgtcaaacagtgtcacggccttctgaaagatccccaatgccttctggttattgataatcttcagtcaacagaagaatgggacttgatacatgatgcattggcatttagaccttctggaagtgctattgttgttattacaaatgaagaaagaattgcgttacactgtgcagatagaaaagatcttgtttttaacatcaaggctctggaaattggggcagccattgatctcttcaagaaggagatcgaagggagtcaatatttgcatgcaggggatattgaaaaggactcggtgctccaacaacttatttcaaagagtggtgggcttccaaaagtaattgttgctatagctgactatttaggccacatgttcaactgggtagaaagggccaatctcttgaatgatcaatttataactaccatggagactaggcaagattttgctcgtttacaagatctgtttggttggatacattcctactttcgttcttgcccagatttcctgaagccttgcatcttttatctatctattttccctaagtccgagatcattcggcgccggcggttggtgatgaggtgggttgcagagggttactctaaggacaaggagagtgatagcgcggaggagaatgcagaggaactcttcgcgaagatcgtggagctgagcatgatccagccaccagaacggacattgagcacaaacaggagaatggtttggtgccaagtcagtgcttttttccacgagtatatcatttcaagaccaaaagaagagaacgttacatttgcgctggaggtctttgcactgaatggatgttgccgccaaacctccgggcgcacaggacgacaccttatcatagagaaaagctgggagcgagataggattgtgttcgagagcatcgacttgtctcggctacgttccctcactgtgtttggtgactggaaatcgttcttcatttctgaaagtatgaaagtgcttcgggtgcttgatctagagaatacaacaggcgttacagataaagacctccgagagatgctcaaggtgctgccacgcctcaagttcctttcactcagaggatgcagtaagatcagcaatttgccgagttcagtggataacctaaggcagctccaaattcttgatgtcagatacacctccatagtcaccatgccagcatccattaccaagttagagaagctacagtacatccgtgcaggcactatcactacacctgtggatcgcaaaggtcttcagctagttggcgtcaaggtgggatcaggtgttaaaaaactgactctattgcatacacttggaattgtaaatgtcagtgctgctagggggaaagccatcctaaaagaactcaggaatctcactcaattgcgcaagcttggtgtgtccgggatcagcaagaaaaacagcaaggagttctgttctgccatcacaggtcactcccatctagaatccttgtcagtgtcccttcacaaggataaccaagattgtttggatggcatgtccgttgggaccaccaatgaaacttttaggcctccaaagaaacttcagagcctttagct

SEQ ID NO: 26305 - protein, 800 aa, Panicum virgatum
  misc_feature: Ceres CLONE 1868746
  misc_feature (177)..(482): Pfam Name: NB-ARC Pfam Description: NB-ARC domain
MADLVLGVAKSLVEGTLTKAQSAIDEESKLRQSAQRDLVFIAGEFQMMQSFLRVTTEEQVRTNVVSITWVIQVRDLAYDVEDCIEFVIHLDTKSDWWRRLIPSFMRRALPLDVAVNMIDQLKARVHDVSQRNERYKLISDPGPKPVMEARQLGISGASGVLATARDTAWKQQEWENFVKLIIKKDSKLQDPLVGRMSEVNQLSAYLAKARSNALQVMSVWGIAGAGKSALVRTLYHNKMSKHREYEKYIWVDVYYPFNLMDFCKSLLMQFHSHSLETNEDPVKQCHGLLKDPQCLLVIDNLQSTEEWDLIHDALAFRPSGSAIVVITNEERIALHCADRKDLVFNIKALEIGAAIDLFKKEIEGSQYLHAGDIEKDSVLQQLISKSGGLPKVIVAIADYLGHMFNWVERANLLNDQFITTMETRQDFARLQDLFGWIHSYFRSCPDFLKPCIFYLSIFPKSEIIRRRRLVMRWVAEGYSKDKESDSAEENAEELFAKIVELSMIQPPERTLSTNRRMVWCQVSAFFHEYIISRPKEENVTFALEVFALNGCCRQTSGRTGRHLIIEKSWERDRIVFESIDLSRLRSLTVFGDWKSFFISESMKVLRVLDLENTTGVTDKDLREMLKVLPRLKFLSLRGCSKISNLPSSVDNLRQLQILDVRYTSIVTMPASITKLEKLQYIRAGTITTPVDRKGLQLVGVKVGSGVKKLTLLHTLGIVNVSAARGKAILKELRNLTQLRKLGVSGISKKNSKEFCSAITGHSHLESLSVSLHKDNQDCLDGMSVGTTNETFRPPKKLQSL

SEQ ID NO: 26306 - DNA, 447 bp, Panicum virgatum
  misc_feature: Ceres CLONE 1868746-R
ccatgatgaagaccagaagagaaatttggagacccaatttgcggaccatccaagcaaacctgctttgacattaagggaagtcaacccatcgtcgcaggcttcaactgcaggaaactacgagcgatgttcatttccctttacatcatcatccagtccagcaatatgaccatgcccattagtgaaacatgagcctccttttcctgtcatgtattattttactaattaaaaatgctgcttgtaattaatctctcaggattgagaatccgcatgttctggatgtgttggcaactggtaatcagtcggttttcggagttgagatgcatgtaatttccaggcacattcttatttgtcgtgttattgttaatggaaaaatagcaaaatgaaacctcaagagttggagggttcgaaaaccatctgtaactttatgtggttttatttatcttgttc

SEQ ID NO: 26307 - DNA, 721 bp, Panicum virgatum
  misc_feature: Ceres CLONE 1868796
  misc_feature: Encodes the peptide sequence at SEQ ID NO. 26308
acaccaaatgatcgtcgcacgctcgcaccgcgcccacatggctcccgttcagctcgaccctgacctgctcctcctcaccgtcgttttcgtggtttcctgtttcgtcatcgccagatgcctccggtcaggccgcaaggacggcggccgggtgctgctgctgcctccttcccctccgccgctgcccatcaccggcaacctccaccagctcgggcggagccactaccaccggcggctgcgggagctggcgcgccgccacggcccgctcttcctcctccgcctcggctccgtgcccaccgtcgtggtctcctcggccgccgtggccgaggaggtgctccggacccaggaccacgtcttctgcagccgcccgccgcagcgcacggcccgcggcctcctctacggctgccgcgacgtcgccttcagcccctacggcgagcggtggcgccagctgcgccgcatcgccgccctccgcctgctcagcgcgaggcgggtcgactccttccgcgcgctccgggaggagaaggtcgcgtccttcctggaccggatccgcgccgcgggtgctcaccgtgaggacgggcgccgagccggggtcaacctgagcgagctgctcgtcggcctgacctacgccgtcatctccaaggcggtgttcgggaacaggctcggcgggatggaacccggggcggtccgagcgatgatggaggagacgagcgagttgctggagacg

SEQ ID NO: 26308 - protein, 227 aa, Panicum virgatum
  misc_feature: Ceres CLONE 1868796
  misc_feature: SWISSPROT Homolog: EC 1.14.13.68 4-hydroxyphenylacetaldehyde oxime monooxygenase
MAPVQLDPDLLLLTVVFVVSCFVIARCLRSGRKDGGRVLLLPPSPPPLPITGNLHQLGRSHYHRRLRELARRHGPLFLLRLGSVPTVVVSSAAVAEEVLRTQDHVFCSRPPQRTARGLLYGCRDVAFSPYGERWRQLRRIAALRLLSARRVDSFRALREEKVASFLDRIRAAGAHREDGRRAGVNLSELLVGLTYAVISKAVFGNRLGGMEPGAVRAMMEETSELLE

SEQ ID NO: 26309 - DNA, 639 bp, Panicum virgatum
  misc_feature: Ceres CLONE 1868798
  misc_feature: Encodes the peptide sequence at SEQ ID NO. 26310
atccacatcactcatccccctcctccgggctccggcctcccctcatcccactccgccgccgccgccgccgccgccagcttacctcaccatggcggcgactgcccacgcctcctccatgtctttcctgctctcccacccccagccacgctccgccgccccaggcatccatctcccgctccgcccggccgcccggcgcgtccgttgcgccaccgatgcccccgtccccacggcccagcccgccgccgccgccgccgcccccagcaccaagcaccggcgcgcggcggatgagaacatccgcgaggaggcggcgcggcaccccgccccgaagcagggcctctccgcgtggtacaagaccttcccgcccgcccccaacggcgaccccaacgagcgctactccctggatgacatcttctaccgctccagctcggggggcctcctcgacgtgcgccacgacatggaggcgctggcccgcttctcgggcgcctagtggagggacctcttcaactcccgcgtcggccgcaccacctggccctacagctccggcgtctggtccaagaaggagttcgtcccccccgagatcgaccccgaccacatcctctccctcttcgagggcaactccaacctcttctgggccgagcg

SEQ ID NO: 26310 - protein, 132 aa, Panicum virgatum
  misc_feature: Ceres CLONE 1868798
  misc_feature: SWISSPROT Homolog: EC 4.2.3.1 Threonine synthase
MAATAHASSMSFLLSHPQPRSAAPGIHLPLRPAARRVRCATDAPVPTAQPAAAAAAPSTKHRRAADENIREEAARHPAPKQGLSAWYKTFPPAPNGDPNERYSLDDIFYRSSSGGLLDVRHDMEALARFSGA

SEQ ID NO: 26311 - DNA, 648 bp, Panicum virgatum
  misc_feature: Ceres CLONE 1868809
  misc_feature: Encodes the peptide sequence at SEQ ID NO. 26312
aagcgatagcttacagacagccccgccgcgacaggcgatggcttacagacagccccgccgccgccgcctagttgccgatggcggctgccgcggccgcccggctcctccgtctggccccgcgccggctccaggttaagacctccccgctcgccgcactctcgttccccctcccgcgtacggcgccgctcgccgccgcctcggggcggcggcagagcttctgcgccgcggcgcaggcctccgctgacgcccccgctgccgctgtggccgcggcgaccgggccggtgggggaggccgtgggagagttcaggaagcggctgcgggtggcggacgtcaagggcggggaggacgagggcgccgcgttggtgggcaaggagctcgccgtgcgcgggtgggtgcgcacttgccgcgcccagaggaccgtcaccttcgttgaggtcaatgatggctcttgcttgtccaatatgcaatgtgtattgactcctgatacagaaggttatgaccagatagactcagtgactaccggagcatctgtactagttgagggagttgttgcaagcagccaaggtggtaagcaaaaagtggagttgaaggtttcaaagatcactgtgattgggaaaagtgatcccacatcttttcctatacagaaga

SEQ ID NO: 26312 - protein, 190 aa, Panicum virgatum
  misc_feature: Ceres CLONE 1868809
  misc_feature (100)..(178): Pfam Name: tRNA_anti Pfam Description: OB-fold nucleic acid binding domain
  misc_feature: SWISSPROT Homolog: EC 6.1.1.22 Asparagine--tRNA ligase
MAAAAAARLLRLAPRRLQVKTSPLAALSFPLPRTAPLAAASGRRQSFCAAAQASADAPAAAVAAATGPVGEAVGEFRKRLRVADVKGGEDEGAALVGKELAVRGWVRTCRAQRTVTFVEVNDGSCLSNMQCVLTPDTEGYDQIDSVTTGASVLVEGVVASSQGGKQKVELKVSKITVIGKSDPTSFPIQK

SEQ ID NO: 26313 - DNA, 609 bp, Panicum virgatum
  misc_feature: Ceres CLONE 1868822
  misc_feature: Encodes the peptide sequence at SEQ ID NO. 26314
gcgtgtccagtcaccaggctccgctgcttgccaccgctcgcgcgccgcgccctcccgtccgcccgcgccatggccgcgaccgcgtccaccgcggccacgctgctgccgcggcccgttgccggctcgccgcgccccggctccgcggcgtcggccccaaccacgcctcgcaggaggcgcctcctcgcgctcaggtgccagtccaccagcgtcgacaaggagcagcagcagccgcccaagccgaagcagcggaacctgctcgacaacgccagtaacctgctaaccaacttcctcagcgggggcagcgtcgggaccatgcctgtcgccgagggagccgtcaccgacctcttcggcaagcccctcttcttctcgctgtacgattggttcctcgagcatggctctgtctacaagcttgcttttggacccaaatcattcgtagttgtctctgaccctatcgtcgctagacacatcctccgggagaatgctttctgttacgataagggagttctcgctgaaattttaaaaccaataatggggaagggtcttatacctgccgaccttgatacctggaagcagaggagaaaagttataacacctgggttccatgcctta

SEQ ID NO: 26314 - protein, 179 aa, Panicum virgatum
  misc_feature: Ceres CLONE 1868822
  misc_feature: SWISSPROT Homolog: EC 1.14.14.1 Unspecific monooxygenase
MAATASTAATLLPRPVAGSPRPGSAASAPTTPRRRRLLALRCQSTSVDKEQQQPPKPKQRNLLDNASNLLTNFLSGGSVGTMPVAEGAVTDLFGKPLFFSLYDWFLEHGSVYKLAFGPKSFVVVSDPIVARHILRENAFCYDKGVLAEILKPIMGKGLIPADLDTWKQRRKVITPGFHA

SEQ ID NO: 26315 - DNA, 1411 bp, Panicum virgatum
  misc_feature: Ceres CLONE 1868827
  misc_feature: Encodes the peptide sequence at SEQ ID NO. 26316
aattttcaaaaaaaaaaccccttcttcctccgattcgatctcccctcgtgcctgaagggaatcgcagatacagggcggatttggtatccgcgaaacgcaagggcaaaggccgttcggttcagcaaggagtctgcctagtgggagcgtggtgcccggcgagatgaggcacctgaccggtggccggagcggcggggcgggccaatccgtgccgcggttcaggtgccaggagtgccacggcgcgcttgccgtcgtcggggacgccgacaggctcccggcctccggtttgcatgcatctgctgttcagggttgtaatatggctgcaagcaggatggacaattcttatgtagtattatcgaagaagaacagatctaaaggtcttggaattcccccatgcccacgaagtgctgcatccccactaacaagaccaatagaggactcatatattatgcttccacctcctactgcttccatatacaagacttcttcctctgaaggagatggtgcgcagctgctgccaccaagttgctcctcgccaggaaataattctggttttttctctagtgttactgtattaaaaagagcattcgagattgcgacctcacaaactcaggttgagcagccactttgtgttgaatgtatgagaattctttctgataagatggattttgagattgaagatattaattctgatatcaaagcttatgaggcttgtcttcaacaactggagcaagaatcctacagcatcctcagtgaaacagattttcaggaggagaaccgaaagattgaggaagaagaacagaaacttaaagctgatattgaagaagctgaaaagcaatattcagaagttagttctgagatgaaagatcttgaaacaaaatataaacaatttgaggaattggaagagcggtattggcaagaattcaacagctttcagcttcagctgacatctaatcagggagaaagagatgccatttcagcaaaaatagaagattctcaagcccatctggaaatgttagagcatacagatattctgaatgatgtattctatatttcacactatggaatattcggaacaataaatagcctccgacttggacacactcatgtggttgagtgggatgagataaatgctgcttggggtcaggctgcacttctgttgcataccatggctcagtattacaccccgaaatttcagtatccttggcacatataatgacagtttctttaagtttatgtagctgttattcattgagaagtatatcgaaatgattggcctatatgccacctgcttcagtgcattttactaggttgaccatgttgaccgtgtttggttttttctggtcattttgatgtatatacctgactatactttggctcagagaagctatgtccagcagccatcttctctgtt

SEQ ID NO: 26316 - protein, 350 aa, Panicum virgatum
  misc_feature: Ceres CLONE 1868827
  misc_feature (134)..(350): Pfam Name: APG6 Pfam Description: Autophagy protein Apg6
MRHLTGGRSGGAGQSVPRFRCQECHGALAVVGDADRLPASGLHASAVQGCNMAASRMDNSYVVLSKKNRSKGLGIPPCPRSAASPLTRPIEDSYIMLPPPTASIYKTSSSEGDGAQLLPPSCSSPGNNSGFFSSVTVLKRAFEIATSQTQVEQPLCVECMRILSDKMDFEIEDINSDIKAYEACLQQLEQESYSILSETDFQEENRKIEEEEQKLKADIEEAEKQYSEVSSEMKDLETKYKQFEELEERYWQEFNSFQLQLTSNQGERDAISAKIEDSQAHLEMLEHTDILNDVFYISHYGIFGTINSLRLGHTHVVEWDEINAAWGQAALLLHTMAQYYTPKFQYPWHI

SEQ ID NO: 26317 - DNA, 661 bp, Panicum virgatum
  misc_feature: Ceres CLONE 1868827-R
ttttaagtaataatgaagtggtgtagtacacttaaaattttaacttgatatgaaaactatgttagaaggaaccaagtattccttctatttgccacaaaattgctttggtctttttctgcattttctgttcaccttgaatgggcatgcaaatttgtcatgctttgggtgtgaatgatgttcaggtttggtccggcaaatgtgttattcagcacccaatatgataatgccatgacattgtttctgacgtgcctgcaagagtttgctgagtttgctgtaagtttggataaggagaagaatgttccacctgacaagtcattcaagctcccctataagattgatggtgataaagtagggggctacagagttgtcctaagtgatttcaatacgagggagaactcgacgaaggcgctgaagaacatgctgtgcaatttgaaatgggttctcttctggtttatacgcaccacgagttagtgccctcctgatcattgcgcacgtagagctgaagctttgtttagcttgaacagttagattagatggtttcagtacaggctgaattactgagccctaggagctgattgtagccccacatagcgacaaaaagacgcatttgtacataactatagcatttttttaataaaaaaaatctgtcacttgttgcttg

SEQ ID NO: 26318 - DNA, 605 bp, Panicum virgatum
  misc_feature: Ceres CLONE 1868843
  misc_feature: Encodes the peptide sequence at SEQ ID NO. 26319
caaatttttacacgaacaactcgggcgcaagcagcgcaacgcgaccgagcaagagacaatggccggcacggcggcgccagcgccggccgcgggctacggcgcggacggcgtgtaccactccccgcgcccggccgtgcgcatcgagtccgacccggggctctccctcaccgacctcctcttccgccgcgccgaggcgtgcccctccgcgctcgcgctggccgacgccgccaccggccaagccctcaccttctccgccctccgctccgccatcctcaccacggccgtcgcactcgcctcgcgcgcgggcgtccgaccgggcgacgtcgtcctcctcctcgcccccaactgcgtcctttaccccgtctgcttcttcgccgtcaccgccctcggcgccgtcgccaccacggccaaccccctctataccccaagggaaatcgccaagcaggtcaccgactcccgcgccaagctcgccatcacagtgtctgagctgctccccaaaatcgaggagctccgcctcccaaacatactgctcgacggcgatgcagccagcgccaccgcttccatgcctccaggcgccagcgtcacgctctactctgacctcattg

SEQ ID NO: 26319 - protein, 182 aa, Panicum virgatum
  misc_feature: Ceres CLONE 1868843
  misc_feature: SWISSPROT Homolog: EC 6.2.1.12 4-coumarate--CoA ligase
MAGTAAPAPAAGYGADGVYHSPRPAVRIESDPGLSLTDLLFRRAEACPSALALADAATGQALTFSALRSAILTTAVALASRAGVRPGDVVLLLAPNCVLYPVCFFAVTALGAVATTANPLYTPREIAKQVTDSRAKLAITVSELLPKIEELRLPNILLDGDAASATASMPPGASVTLYSDLI

SEQ ID NO: 26320 - DNA, 303 bp, Panicum virgatum
  misc_feature: Ceres CLONE 1868861
  misc_feature: Encodes the peptide sequence at SEQ ID NO. 26321
gaatgattcgtctcgctcctcccttcttctgtttgcttgattgattgcccagcaaccacccccaccaccgtcgcagcgatgtcctccccctctccgcgtcgtggaataccctcgccattgcctaggaggaggcgccgtcgccgctgcgcgaggttgttctggatctcggatggcgtcggcgaaggcgtcgcgggcgcgggcggcgggccactcgggggagttcccggggggcaggaccgcggcgggggggagcggctggggcagaggcgggggtggaggcggcggatacggcggagtgcagct

SEQ ID NO: 26321 - protein, 44 aa, Panicum virgatum
  misc_feature: Ceres CLONE 1868861
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MASAKASRARAAGHSGEFPGGRTAAGGSGWGRGGGGGGGYGGVQ

SEQ ID NO: 26322 - DNA, 666 bp, Panicum virgatum
  misc_feature: Ceres CLONE 1868864
  misc_feature: Encodes the peptide sequence at SEQ ID NO. 26323
cggaagggcatagtattgtatactaccactatataaccagccgccgccgcggtcgtcgtcgtcggccagtcctccccccccccccccccccgcctcgccgcgccgcgcctccgtcgccgggagtagggagggagaggggcccggagatcgatcggggaggggcgggggggctcggcgggcggttggtggtatgggggaaggggtgggggggctgcgcgcgagcttctcgggggggcggaagcggccgggggaataacgggcggcgcacctccgggggctggtgcggatgatcgaagaacgggaaggcgaaatcaccgccgcgctccaagacgacctcgccgagccgcacatggagtcctacctccaccagatattgctcgcgaaatcctcctgcaagttcgcgctcaaagggctcaagaaatggatgaaaccccagaaggtacctgcgggcataacttcctttccctcctcttcgcaaatagtgcctgaaccccttcgggtggtgctcgtcatctccgcctggaactacccatttctgctctctattgattcggtaattggagcaatagctgctggaaatgctgttgttcttaaatcatcacaaatagcgccggctacctcctccatgttcgcgaagctgctgtctgaagatgttgacatgacatg

SEQ ID NO: 26323 - protein, 126 aa, Panicum virgatum
  misc_feature: Ceres CLONE 1868864
  misc_feature: SWISSPROT Homolog: EC 1.2.1.3 Aldehyde dehydrogenase (NAD(+))
MIEEREGEITAALQDDLAEPHMESYLHQILLAKSSCKFALKGLKKWMKPQKVPAGITSFPSSSQIVPEPLRVVLVISAWNYPFLLSIDSVIGAIAAGNAVVLKSSQIAPATSSMFAKLLSEDVDMT

SEQ ID NO: 26324 - DNA, 2603 bp, Panicum virgatum
  misc_feature: Ceres CLONE 1868867
  misc_feature: Encodes the peptide sequence at SEQ ID NO. 26325
tacaattggggtagaatttctcgacaggtaactggtaggaagcaggctaaacttctgcaccataaaaaccttgtgttccaggattttgggtgcagtgacaggaccaacacaccagggatcgatgctagttaggttaggtaactgcaaccttgtcctccatctgcatgcacacacaagaagcatggccgtatttgggataacaaaaaggagggtcaaccggccggccgggccaacaacgcggattttattctaaagtaactgcctggacagtaaaagtttgttactcctcattcagtatttttctttacaaaagttaaagtaggaacacctaattaacatgtaaactctaaactagtaacaacatgctagaatagaacaagcagcatccaactccggcgacatgcagtggcagcttgctgccggcctgccgatccctttgctgcgcttgcttggtgccttgccgccgacatgcatgccacgccggcgacaagatcgatgcaccggtcctactttttttaataaaaaaacataaaatttctgtttttgtaaataaaatttttaaaatttatgtaggagagcaggcaacgtcaatccaggccgggggagcaaactttaattaaacaggcgtatgaacggggggtgaggctaagcttttgcttgatggatttggacgtaggtgtcacgaggtgccacacaaatggctgtctggctgatgatgatcgtgcgagttctcgatctcactcacatggccagcttccagattttgacagcaacctttttgtagcagttctttttttcccctgatactacgtactctagtttggttagttgacagttgctgtgctcactgcacacaggagctaactggctagctagctgcttcctagttcattcccaatttcccatgcatctctgttcagtcttaccaacaacggagaggaataggattccaaacccagccaagcacggttggcttctttctgtagaagctgacgtgacatgcagcggttggccgcgcgcgcccacaggccagatcgattagcacctgacacctgcatcagtaactccctgcagattaattaacctagctaggagattaaccgtttggttaatttgacctgtcgctagctgtatggagaaattaaagaagaagggtagctgacatgacatgccttgacgtccgtgcgctggcggcgtcgccgtcgccgacgtcgggtggcgcgcgcgtggttgttccgttgtgtggctgctggttttcaattaatttcttgcatgccgcgctcaataatacaggcgacaagtcgatgatccggaagcgctacatgcacctgacggaggagttcctggcggagaaccccaacatgtgcgcctacatggcgccgtcgctggacgcgcggcaggacatcgtggtggtggaggtgcccaagctcggcaaggcggcggcgcagaaggcgctcaaggagtggggccagccgcggtcccgcatcacgcacctcgtcttctgcaccacctccggcgtcgacatgcccggcgccgactaccaactcaccaagctgctgggcctgcgcccctccgtgaaccgcctcatgatgtaccagcagggctgcttcgccggcggcacggtgctgcgcgtcgccaaggacctcgccgagaacaaccgcggcgcgcgggtgctggtggtgtgctccgagatcaccgccgtcaccttccgggggccctccgagtcccacctcgactcgctggtggggcaggcgctgttcggcgacggcgccgccgcggtgatcgtcggcgccgaccccgacgagcgcgcggagcggccgctgttccagctggtgtcggcggcgcagacgctgctgccggactcggagggcgccatcgacgggcacctccgcgaggtcgggctcacgttccacctgctcaaggacgtgccggggctcatctccaagaacatcgagcgcgcgctggaggcggcgttcgcgccgctgggcatctccgactggaactccatcttctgggtggcgcacccggggggcccggccatcctggaccaggtggaggccaaggtgagcctggacaaggcccggatgcgcgccacccggcacgtcctcgccgagtacggcaacatgtccagcgcctgcgtgctcttcatcctcgacgagatgcgcaagcgctccgccgaggacggctgcgccaccaccggcgagggcctcgactggggcgtcctcttcggcttcggccccggcctcaccgtcgagaccgtcgtcctccacagcgtccccatcaccgccggcgccgccgccgcatgatcgtccccatcaccggcaacattatttgccgcctccgcctccgatcgacgacccgtcacgcgaataacgtcgttctttctgcatcattcgtcatctactagacgctacgacctattactctttattttgcatgcttgtactgtaagtaagccctggaacctgatgaattttaagggcgagctagatcaagggtaaaaccgtaagatcgatcgagtgccatttagtagtattaattaattacggatggtgaggtattgtatacctgtgtaagacaagcttggctggattctattttat

SEQ ID NO: 26325 - protein, 380 aa, Panicum virgatum
  misc_feature: Ceres CLONE 1868867
  misc_feature (6)..(212): Pfam Name: Chal_sti_synt_N Pfam Description: Chalcone and stilbene synthases, N-terminal domain
  misc_feature (222)..(372): Pfam Name: Chal_sti_synt_C Pfam Description: Chalcone and stilbene synthases, C-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MTCLDVRALAASPSPTSGGARVVVPLCGCWFSINFLHAALNNTGDKSMIRKRYMHLTEEFLAENPNMCAYMAPSLDARQDIVVVEVPKLGKAAAQKALKEWGQPRSRITHLVFCTTSGVDMPGADYQLTKLLGLRPSVNRLMMYQQGCFAGGTVLRVAKDLAENNRGARVLVVCSEITAVTFRGPSESHLDSLVGQALFGDGAAAVIVGADPDERAERPLFQLVSAAQTLLPDSEGAIDGHLREVGLTFHLLKDVPGLISKNIERALEAAFAPLGISDWNSIFWVAHPGGPAILDQVEAKVSLDKARMRATRHVLAEYGNMSSACVLFILDEMRKRSAEDGCATTGEGLDWGVLFGFGPGLTVETVVLHSVPITAGAAAA

SEQ ID NO: 26326 - DNA, 704 bp, Panicum virgatum
  misc_feature: Ceres CLONE 1868868
  misc_feature: Encodes the peptide sequence at SEQ ID NO. 26327
gggaagagagagaaaggggagcagctgcgaggaattgttttcgcaggaggcgtctgagctgccggccgcaccacctaatcgccgccgcgcttgttttcccaccgcccgatggcggccgccacgccgccgccgcctaaggcggaggcggggcgcccggccccgtccgccgccgccgcggccaagcgaggagcgggcggcgccggggggctgctgatggggaagtacgagctggggcgcctgctggggcacggcaccttcgccaaggtgtacctcgcgcggcacgtcgggacgggggagagcgttgccatcaaggtgctcgacaaggagaaggccgtcaagagcgggctcgtctcgcacatcaagcgcgagatcgctgtgctccgccgcgtgcgccaccccaacatcgtgcacctgttcgaggtcatggccaccaagtcgaagatctacttcgtcatggagctcgtccgcggcggcgagctcttctcccgcgtctccaagggccgcctcagggaggacaccgcccgccgctacttccagcagctcgtctctgccgtggccttctgccacgcccgcggcgtcttccaccgggacctcaagcccgagaacctcctcgtcgacgagcacggcaacctcaaggtgtccgactttgggctttccgccgtcgccgagcagttccgccccgacggcctgctccacaccttctg

SEQ ID NO: 26327 - protein, 198 aa, Panicum virgatum
  misc_feature: Ceres CLONE 1868868
  misc_feature (39)..(198): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MAAATPPPPKAEAGRPAPSAAAAAKRGAGGAGGLLMGKYELGRLLGHGTFAKVYLARHVGTGESVAIKVLDKEKAVKSGLVSHIKREIAVLRRVRHPNIVHLFEVMATKSKIYFVMELVRGGELFSRVSKGRLREDTARRYFQQLVSAVAFCHARGVFHRDLKPENLLVDEHGNLKVSDFGLSAVAEQFRPDGLLHTF

SEQ ID NO: 26328 - DNA, 2282 bp, Panicum virgatum
  misc_feature: Ceres CLONE 1868875
  misc_feature: Encodes the peptide sequence at SEQ ID NO. 26329
gaagctagctcatccattcattcatcatcagctcctccgatcccccttccgcgcgagcagctgctctcccgatctccatcactactgcatgtcctagctagctagagctcagccacctagctagctagtacttgcagcagcagcagcagatcaagcatagcgtagccgccgccatgccgaccaagaaagcccgcgccggcggctgcgacatccaggccaccggcatcaactaccgcatcgccgtctccacccagccccctctcaaggtctggagcaggtcagacgacgacgcccaagaccaccacctcatcagcggcgtccgccacgtgctccgcaacgtcacctgccgcgcgcgccccggcgagctgctcgccatcgtcggccccagcggcgccggcaagtccacccttctcgagatcctcgccggccgcctctccccctccccggcgcccgacctgctcctcctcgacggcgccgccgccgccagcgccgacctccgccgcgtctccggctacgtcacccagcgggacgtcctcttcccgctgctcaccgtgcgcgagacgctgctcttcagcgctcgcctccgcctcggcgcgaccctgcccgccaaggacatggacgcccgcgtcgacgcgctcctcgacgacctcaccctgcgccgcgtcgccgccacgaggatcaaggacctctccggcggggagcggaggcgcgtctccatcggcgtcgaggccgtccacgaccccgcggtgctcatcctcgacgagcccacctccggcctcgacagcgcctccgcgctccagatcgtcggcgcgctccgcgccatggccgagacgcgaggccgcaccgtgctgctcagcatccaccagccgggcgcgcgcatcgtcaagatgttcgactccgtcctcctgctggccgccggctccgtcctccaccacggcaccgtcgatcagctgcgctgcctgctcgctgacgcgggcctccttctgcccccgcacgtcgacgccgtcgagttctccatcgactcggtcgacgcgctccgcacccaccgccgccgcctcacgcagcagccgcaggcgccggcgtcctcccggcgcacgctgcagcagctgttccagctgcacagcaagcagcaggtggccgacgaggtggctgaatgtgtccccaccaccaattcgtacgccaactcgcgggcgcgcgaggtggcggtgctgacgcagcgcttcttcaagaacgtggcgcgcacgcggcagctcttcgcgtgccgcaccgtgtgcatgctggtggcggggctggcgctgggctccatcttctacgacctcggcgaggacaaggtggcggagcgcgtgggcctcttcgccttcctgctcaccttcctgctgtcgtccacgacggaggcgctgccaatcttcctgcaggagcgcgagatcctggccaaggagacgtcgtcgggcgcgtaccgcgtgtcgtcgtacgcggtggccaacgcgctggtgttcctgcccttccagctggcgctcgccgtggtgttcgcggcgccggtgtactggctggcggggctgcggcgcacggcggcggcgttcggctacttcctgctggtggtgtggctcatcctgtacacggccaactcggtggtggtgtgcttcgcggcggcggcgccggacttcgtggtgggcaacgcggcgatccagggggtcatgggctccttcttcctcttctcgggctacttcatcgccaggtcggccatgccggggtgctgggtgttcatgcactacctgtcgctcttcaagtggccgttcgaggcgctgctggtgaacgagttcgccggcggcgggaggtgcgcggtgcggctgctgggcgcctgcgtggcgacgggggacgaggtgttgcggcgcgaggggctcggcgaggagtgcaggtggcgcaacgtgggggtcatggtggccttcatggcggtctacagggtgctgggctacgccgtgctcagggtcaggtgcaagtgaagcagagccagagggggcatggtcaattcaaaagccgcagtgtgactgactgatcaaattcaaatgtgctagcccggccagacgatgtataacagtggaaagcacaaacaagctctggcaactgaaacacttggaggggaacagcagtcaccaccaagctagctcatgtagagcagcagaaccgtatagtagacgactacaagtttgacataccacaacacctaataaatgtaacatgtttacatgccaaagaattgtgttaatcaacgacagtaaatcagc

SEQ ID NO: 26329 - protein, 608 aa, Panicum virgatum
  misc_feature: Ceres CLONE 1868875
  misc_feature (341)..(549): Pfam Name: ABC2_membrane Pfam Description: ABC-2 type transporter
  misc_feature (63)..(249): Pfam Name: ABC_tran Pfam Description: ABC transporter
  misc_feature: SWISSPROT Homolog: EC 3.6.3.25 Sulfate-transporting ATPase
MPTKKARAGGCDIQATGINYRIAVSTQPPLKVWSRSDDDAQDHHLISGVRHVLRNVTCRARPGELLAIVGPSGAGKSTLLEILAGRLSPSPAPDLLLLDGAAAASADLRRVSGYVTQRDVLFPLLTVRETLLFSARLRLGATLPAKDMDARVDALLDDLTLRRVAATRIKDLSGGERRRVSIGVEAVHDPAVLILDEPTSGLDSASALQIVGALRAMAETRGRTVLLSIHQPGARIVKMFDSVLLLAAGSVLHHGTVDQLRCLLADAGLLLPPHVDAVEFSIDSVDALRTHRRRLTQQPQAPASSRRTLQQLFQLHSKQQVADEVAECVPTTNSYANSRAREVAVLTQRFFKNVARTRQLFACRTVCMLVAGLALGSIFYDLGEDKVAERVGLFAFLLTFLLSSTTEALPIFLQEREILAKETSSGAYRVSSYAVANALVFLPFQLALAVVFAAPVYWLAGLRRTAAAFGYFLLVVWLILYTANSVVVCFAAAAPDFVVGNAAIQGVMGSFFLFSGYFIARSAMPGCWVFMHYLSLFKWPFEALLVNEFAGGGRCAVRLLGACVATGDEVLRREGLGEECRWRNVGVMVAFMAVYRVLGYAVLRVRCK

SEQ ID NO: 26330 - DNA, 699 bp, Panicum virgatum
  misc_feature: Ceres CLONE 1868886
  misc_feature: Encodes the peptide sequence at SEQ ID NO. 26331
gccctgcagtccgcactcccgccagcccgcttcgccttcctcccgcggctgcagccagtgctcagcagctcaagaggcggagttaggttctcaagcaatcattcccaatccatgcgaagtaagacacagctgtccaaaagaagagccacaaatcgtccaaagactaccaggtctcaggcacctattgtatgttccactggaatgaccataatttttgttgcaactgaagtacacccatggtgcaaaactggtggcctcggtgatgttgtaggaggactgcccccagctctggctgccatgggacaccgagtcatgacgatagctcctcgctatgatcaatacaaggatgcatgggatacaaatgtccttgttgaggtaaatgttggtgacacagtagaaactgttcgcttcttccactgctacaaaagaggagttgatcgtgtttttgttgatcaccctatgtttcttgaaaaggtatggggcaagactggtgcaaaattgtatggtcctactaccggaactgactatagagataaccagttgaggttctgccttttgtgccttgctgcattggaggctccaagagttctcaatctcagcaattctgaatacttctctggaccttatggtgaagatgttgtcttcgtagcgaatgattggcacactgcagttctgccctgctatctgaagagcatgtat

SEQ ID NO: 26331 - protein, 232 aa, Panicum virgatum
  misc_feature: Ceres CLONE 1868886
  misc_feature (69)..(232): Pfam Name: Glyco_transf_5 Pfam Description: Starch synthase catalytic domain
  misc_feature: SWISSPROT Homolog: EC 2.4.1.242 NDP-glucose--starch glucosyltransferase
  misc_feature: The sequence is a functional homolog of SEQ ID NO 4 in US patent 7169982
ALQSALPPARFAFLPRLQPVLSSSRGGVRFSSNHSQSMRSKTQLSKRRATNRPKTTRSQAPIVCSTGMTIIFVATEVHPWCKTGGLGDVVGGLPPALAAMGHRVMTIAPRYDQYKDAWDTNVLVEVNVGDTVETVRFFHCYKRGVDRVFVDHPMFLEKVWGKTGAKLYGPTTGTDYRDNQLRFCLLCLAALEAPRVLNLSNSEYFSGPYGEDVVFVANDWHTAVLPCYLKSM

SEQ ID NO: 26332 - DNA, 350 bp, Panicum virgatum
  misc_feature: Ceres CLONE 1868887
  misc_feature: Encodes the peptide sequence at SEQ ID NO. 26333
attgctgtagccctgtaggggagggcctgagggagagggagagggagagaggcgaggcggtgcagctatggcgagagcggcctgggccgcatggttgctcgtcctcctgtgctgcggcgcttggaccccgcggcgaatcttggtctccgcggccaccgacgcgaatgatgttactgccctcaacacgctgtttaccagcatgaattcaccagggcagctgcagggctggaaggcaagcggcggtgacccctgcagcgaatcatggcagggaatcagctgctctggatcctcactcactgcgattaaactgcccggattggggctccctggaactctgggctacgacccga

SEQ ID NO: 26333 - protein, 94 aa, Panicum virgatum
  misc_feature: Ceres CLONE 1868887
  misc_feature (31)..(72): Pfam Name: LRRNT_2 Pfam Description: Leucine rich repeat N-terminal domain
MARAAWAAWLLVLLCCGAWTPRRILVSAATDANDVTALNTLFTSMNSPGQLQGWKASGGDPCSESWQGISCSGSSLTAIKLPGLGLPGTLGYDP

SEQ ID NO: 26334 - DNA, 1906 bp, Panicum virgatum
  misc_feature: Ceres CLONE 1868894
  misc_feature: Encodes the peptide sequence at SEQ ID NO. 26335
accctgacacacaactagtccccttcaccgttcgttcgcgccccccgcgctccgatccgcaaccgcagagggtttggtaccaggcggagaccggcgcggccgcgcctgccccctcgacccgtcgcccgcccggcgatccatggcgctcggcgagggcggggaccgcggggccgccgcgcccctcatcgcggacgccgggaagcatgccggcggcgtcgtgcgcagcgggagcatgtggacggcggcggcgcacttgatcacggcggtgatcgggtccggcgtgctgtcgctggcgtggagcatcgcgcagctggggtgggtggccgggccggccgccatgctcgtcttcgccggcgtcacggcgctgcagtccacgctcttcgccgactgctaccggtcgccggaccccgagcacggcccgcaccgcaaccgcacctacgccggcgccgtcgaccggaacctaggtagcagcagctcgtgggtgtgcatgctgctgcagcacacggccctgttcggctacggcatcgcctacaccatcacggcctccatcagctgcagggcgatcctgaaggccaactgctaccacaagcacgggcacaatgcgccctgcagctacgacggcagctactacatgatcgtcttcggcgccgcgcagctcttcctctccttcataccggacttccacgacatggcgtggctctccgtcgtcgccgccgtcatgtccttctcctacgccttcatcggcctcgggctcggcctcgccaccaccattagtaacgggacgatcaaaggaagcataacaggtgttccgatgaggacgcctgtgcagaagatttggcgcgtctcgcaggccatcggcgacatcgcgttcgcatacccgtactccctaatcctcctggaaatacaggacaccctgaagtcgccgccagccgagaacaagacgatgaagagggcgtcgatgatctcgatcctcgtcacgacgttcttctacctctgctgcggctgcttcggctacgccgccttcgggagcgacgcgccgggcaacctcctcaccggcttcggcttctacgagccctactggctcatcgactttgccaacgcctgcatcatcctccacctcctgggcgggtatcaggtgtacagccagcccatcttccagttcgcggacaggttcttcgcggagcggttcccggacagcgggttcgtgaacgacttccacaccgtgcgggtcccgtgcctgccgccgtggcggctgaacctgctccgggtgtgcttccggacgctgtacgtggcgtccacgacggcggtggccgtggccttcccctacttcaacgaggtgctggccctgctgggcgcgctcaacttctggccactggccatctacttccccgtggagatgtacttcatccagaggaacgtggcccgctggtctgcccggtggctcgtcctgcaggccttcagcgtcgtctgcctcctcgtcagcgccttcgcgctcgtcggctccatcgaggggctcgtcacccagaagctgggataggagcactcgtgtgtgcgcccttccttcgtctgtgttttgctttggattgcttctcttcctgctgtagcggtgatggagaacgcagtgagtgagtgatgatgatgatgagcagtagcagcagcagcggcagcataccagtagcaggtcatctgcattctgcaggaccagggagtaccaggttgcgcagtgttctttgatgccttcctgcagcattagagacatgtacacagtgtcgcattgcatccatgtcgtattgcccaggatacttcagaagttcagaagaactaatgtgaggaaccgtgctgccgtcgatgcatgtggtctgagattttgatgaagctgtggactgatcagcagtctgttctcgtc

SEQ ID NO: 26335 - protein, 465 aa, Panicum virgatum
  misc_feature: Ceres CLONE 1868894
  misc_feature (28)..(461): Pfam Name: Aa_trans Pfam Description: Transmembrane amino acid transporter protein
MALGEGGDRGAAAPLIADAGKHAGGVVRSGSMWTAAAHLITAVIGSGVLSLAWSIAQLGWVAGPAAMLVFAGVTALQSTLFADCYRSPDPEHGPHRNRTYAGAVDRNLGSSSSWVCMLLQHTALFGYGIAYTITASISCRAILKANCYHKHGHNAPCSYDGSYYMIVFGAAQLFLSFIPDFHDMAWLSVVAAVMSFSYAFIGLGLGLATTISNGTIKGSITGVPMRTPVQKIWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQFADRFFAERFPDSGFVNDFHTVRVPCLPPWRLNLLRVCFRTLYVASTTAVAVAFPYFNEVLALLGALNFWPLAIYFPVEMYFIQRNVARWSARWLVLQAFSVVCLLVSAFALVGSIEGLVTQKLG

SEQ ID NO: 26336 - DNA, 2384 bp, Panicum virgatum
  misc_feature: Ceres CLONE 1868896
  misc_feature: Encodes the peptide sequence at SEQ ID NO. 26337
cggccattacttaacgcggagggaagggaagcgcccgcccggccgctcccccagcccagtggttgcctcctctccagtcctgcggcctctgagctccgaaccgagcagagccgcccacgagtcccccgcccccgcgcatctcggcacgagccccacgaccgcctccgcccccgcaccggaccgagatccccaaccgccgcgcgcgggcgcgcgacctgcacggcatgccggccgagcccctctccggttaaaccccccgagaagctccccattttatggcgctctcccgcgggcgcgcgcgcactgcccccgccgccgtccccagcgcctgcttcctccttctcctcgtgctcctcctcacctcctcctccctccccgccgccccggggcgcgacggcgactcctccacctccacctccaccggcccggttctccgtttcaccacgtcgtcgtcgtcctccgggaaggggcagggggacgactgcgcggagctgcagtccatcgacggcggggcggcccggtgcgcctacctccgcgcgcactccccctgctccccggcggggtacgtggactacctccgcctcttctattgcggcttcgccggcgcgccgccggcggcgtgcgccgcgctcgcgctgtggctagcggtgctcttctacctgctgggcgacaccgcgtccgagtacttctgcgcgtcgctcgagggcctctccgcggcgctgcgcctgccccccgccgtcgcgggcgtcacgctgctctcgctcggcaacggcgcgcccgacgtgttcgccagcgtcgtctcgttcgccgcgggcgacggcggcggggtcgggctcagcagcgcgctcggcggggcgctgttcgtgtccaccgtcgtcgcgggcgccgtcgcgctcgccgtgggcgcgcgcggcggggtcgtcgtcgagtggcgcggcttcgtgcgcgacctctgcttcctcctcctcgcgctctgctacctgctcgccgtgctggtgaacggcgcggtcaccgtctgggtggccgtgtcgttcgtctcgctctacgtcggctacgtcgtcatcgtctggacctcccactgctgcgccgagcagggcaagccgctggccgccgggctcgccgcgccgctcctcctcgatgaggactacggcgacgacgtcccgtccctgccgtcccactccaagacagggtcggcggcatctggtgccgcgtcaaggggaagagcctggctgcattgcatcgcgcgcgcgctctgcatgcctctgtacctcccgcgccgcctcaccatcccggacatcgccgcgcaccgctggtcccgcccctacgccgtctcctccgccgcgctggcgccggtcctcctcgccttcacctggatctcgcagcgccaccacctggtgtcctcctcgcaccggcacagcctcccggtgctcctcggcggcgccatcgtcggcctcctgctcgcggcgctcgccgcggccaccacggacgccggctcccctccccgcggccgcaagcgccgcgtgccgtggctcgccgcggggttcctgatgagcgtgctgtgggcctacaccctggcgcgcgagctcgtggcgctcctggtggccatggggtacgtggtgggcatcaagccgagcgtgctgggcgtgacggtgctggcgtggggcgactccctgggcgacctggtgtcgaacgtggcgatggcggtgcacggcggccccggtggcgcgcagacggcggtgtcggcgtgctacgcgggcccgctgttcaacacggtggtggggctgggcctgtcgctggcgctggcggcgggcgcgcagcacccggcgccgttcgtggtgcccgcggacgcggcggcgtacgaggcggtggggttcctgggcgcggcgctggcgtgggcgctgttcgtgttgcccgtccgcgggatgcgcatcgaccgcgtctacggcgtcgggctcgtcgccatctacctctgcttcttcgccgtgcgcgtcttcgagacgctggggctctgggcctagaggagagccgagagcacctcgcgccatcagcgactgacgcccgcccctccccctgcccgcgttcgtttgtttcttgctaatgatcgtcgttgtagagaagcatcaggctgggtaatggtagttctagattggtagtaaattatagtaaacaaaggtcaaggataggaaaacttgtatatatcactgtagcatacagtactaggcgctagcactactccacacgtaggtgttggttagtgttgtgtccgagaacttgttcctttccccctcctctgcttatgttttgggaggggttctgactggagaatggcaggcaattgtctgttactgttcaaaatccctggtaaataacagggcttgtttgac

SEQ ID NO: 26337 - protein, 580 aa, Panicum virgatum
  misc_feature: Ceres CLONE 1868896
  misc_feature (129)..(264): Pfam Name: Na_Ca_ex Pfam Description: Sodium/calcium exchanger protein
  misc_feature (428)..(571): Pfam Name: Na_Ca_ex Pfam Description: Sodium/calcium exchanger protein
MALSRGRARTAPAAVPSACFLLLLVLLLTSSSLPAAPGRDGDSSTSTSTGPVLRFTTSSSSSGKGQGDDCAELQSIDGGAARCAYLRAHSPCSPAGYVDYLRLFYCGFAGAPPAACAALALWLAVLFYLLGDTASEYFCASLEGLSAALRLPPAVAGVTLLSLGNGAPDVFASVVSFAAGDGGGVGLSSALGGALFVSTVVAGAVALAVGARGGVVVEWRGFVRDLCFLLLALCYLLAVLVNGAVTVWVAVSFVSLYVGYVVIVWTSHCCAEQGKPLAAGLAAPLLLDEDYGDDVPSLPSHSKTGSAASGAASRGRAWLHCIARALCMPLYLPRRLTIPDIAAHRWSRPYAVSSAALAPVLLAFTWISQRHHLVSSSHRHSLPVLLGGAIVGLLLAALAAATTDAGSPPRGRKRRVPWLAAGFLMSVLWAYTLARELVALLVAMGYVVGIKPSVLGVTVLAWGDSLGDLVSNVAMAVHGGPGGAQTAVSACYAGPLFNTVVGLGLSLALAAGAQHPAPFVVPADAAAYEAVGFLGAALAWALFVLPVRGMRIDRVYGVGLVAIYLCFFAVRVFETLGLWA

SEQ ID NO: 26338 - DNA, 1668 bp, Panicum virgatum
  misc_feature: Ceres CLONE 1868915
  misc_feature: Encodes the peptide sequence at SEQ ID NO. 26339
agagcctcagtaccaagaagagaacgcagcgcgcgtgagggcggcggccgagatcggagcccaccaacccaccggctctagcgccgatggcggaggtgaccctccgccgcttcgagctctccgacgtggacgccatgatggcgtgggcgtcggacccgcaggtggccgccttctgccggtgggagccctacgagtccagggaggccctgctggcgttcctgcgcgacaccgcgctcccgcacccgtggttccgcgccgtctgcgcccccggctccggcgaggtcgtcggcgcggtgtccgtggcgccgacggcggaacggtgccgcggggagctcggctacgtgctggcccgcgcgcactggggcaagggcgtggcgacctcggccgtgcggcgcgcgctgcgggacgtgttcgcggaggtggaggggctgcggcgcgtggaggcgctggtggacgtggacaacccggcgtcgcagcgcgtggcggagaaggccgggctccgacgcgagggcgtcctgcggcggcactactggcacaagggccacgccagggacatggtcatgtacagcttcctcgcctccgatcccctccccggctgattccgcatcgggtggtggtgttcggaggatgaagatggctgcaatcaggtaggtggaccgtgccgggatgttcttttggatggtgtctttggacgatgcagctctcgggctcggctgtcacttgtcagttccatggatttcactggttgtttggtaccgcgcgtggtgccccgatagcacctgcttcgccgcttggcgcttggccattttgataatgtttcttagcttaaacctcacactaccaatcccaacacgtcactctgttgctaatccagatttaagtgaagcctggtcctttctcttctcagtgacgagtgcgtgctggcgtgggtgggcccgacactttgattgctctgcctgaaaccagcaatcaagcagagactgcactagtgagtagtgtgaccgatctgagcatcggaggctcagaggatggaccaagaagaggcgcctgcccagccggcggggtccgcgcgcgcggacgcggtcacgctccggccgttcgacctcgccgacgtcgacgccatgatggcctgggcgtcggaccccgtcgtcacggcgttcatgacgtgggacgcctacacgtcccgggacgccctgctcgcgttcatgcgcgacgccgtgctgccgcacccctggttccgcgccgtctgcctcggcggcagcgaggggtccctctcccgccctgtgcccgtgggcgcggtgtccgtgacgccgacggacgaccggtgccgcgccgagctctgcgtcgtggtggcgcgcgcgcgctgggggaagggcgtggccacggcggcgctgaagcgcgcggtcgccgcggtgttcggcgacctcgagggcgtggagcgcgtcgaggcgctcgtggacgccgacaacgcggcgtcgcagcgggcgctcgagaaggccgggttccagcgggaggccgtgctgcggagctactgcgtggtcaagggaaggctcagggacatggtggtctacagcttcatctccactgaccctctcgtagactgatctagaaaaggttatctgctcatgtaattgtacttagagatttcacaacatggttggatggccc

SEQ ID NO: 26339 - protein, 170 aa, Panicum virgatum
  misc_feature: Ceres CLONE 1868915
  misc_feature (58)..(139): Pfam Name: Acetyltransf_1 Pfam Description: Acetyltransferase (GNAT) family
MAEVTLRRFELSDVDAMMAWASDPQVAAFCRWEPYESREALLAFLRDTALPHPWFRAVCAPGSGEVVGAVSVAPTAERCRGELGYVLARAHWGKGVATSAVRRALRDVFAEVEGLRRVEALVDVDNPASQRVAEKAGLRREGVLRRHYWHKGHARDMVMYSFLASDPLPG

SEQ ID NO: 26340 - DNA, 528 bp, Panicum virgatum
  misc_feature: Ceres CLONE 1868935
  misc_feature: Encodes the peptide sequence at SEQ ID NO. 26341
gagaactcccttctccgccgctacccaagcctcgcccctgtacccccacccgccgccgctgctgctagggagcttccacccgcgcgcctacaacaagagctagcagcagcaagcggtcgctatcgggtgccgctccggccgtgccagtgtgctcgcgaaccctaacccccgatgccgtatatggtgggggccgccgaccagatcgccggcggctcggcggccgagcggccggcgggccagcggaggagcggctcgcccagccgcctcaactcgcacgcgccggagttcgtgccccggggcccgccgtcgccggcacacgcggccgtcttgcccccgcaccgcaccgacgtcatcggagtgtatgccgagatccctcaccccacgaacatcctcatgctcgtcgcggcccagcacaggttgaccaagtgcatcgagtgcgagggcatgatccctctgtacgacaacaacgacgagaacttgcccgacatgcaggacggtgtgtaccacatcgtgctctacgacaccgag

SEQ ID NO: 26341 - protein, 118 aa, Panicum virgatum
  misc_feature: Ceres CLONE 1868935
  misc_feature (27)..(44): Pfam Name: PAM2 Pfam Description: Ataxin-2 C-terminal region
MPYMVGAADQIAGGSAAERPAGQRRSGSPSRLNSHAPEFVPRGPPSPAHAAVLPPHRTDVIGVYAEIPHPTNILMLVAAQHRLTKCIECEGMIPLYDNNDENLPDMQDGVYHIVLYDT

SEQ ID NO: 26342 - DNA, 590 bp, Panicum virgatum
  misc_feature: Ceres CLONE 1868948
  misc_feature: Encodes the peptide sequence at SEQ ID NO. 26343
ataagacgaggcggagcagcccgaatccccccaccacaccccaccgggagcggccgaggaagcaggcagccaccagccatgtcgtgcggcgggtgcggctgcgaggcgccggcgggaacgggggcgacggcgtcggaggcgtacctgagcagcgagccggtgcgggaggcgcgggagctggtggcggagctctgccgccacttctatgcgcaggggtgggtcaccggcaccggcggcagcatcaccgtcaaggtcaacgaccccgccgtgccgctcgccgaccgcctcatcgtcatgtcgccctccggtgtgcagaaggagaggatggtggcagaggacatgtatgtgatggctgcagatgggaaagtgctctctgcaccagcagcaaagccatggcccaacaaacctcccaagtgtacagactgtgcctgtccttctctgttcatgaaggcctatttgatgagaggggctggggctgtcattcacagccatggaatggagacttgcatagcaacaatgctttaccctggtgcaaaggagttcatgatgactcctttggaaatgatttaaaggaatccaagccatggggt

SEQ ID NO: 26343 - protein, 163 aa, Panicum virgatum
  misc_feature: Ceres CLONE 1868948
  misc_feature (33)..(163): Pfam Name: Aldolase_II Pfam Description: Class II Aldolase and Adducin N-terminal domain
MSCGGCGCEAPAGTGATASEAYLSSEPVREARELVAELCRHFYAQGWVTGTGGSITVKVNDPAVPLADRLIVMSPSGVQKERMVAEDMYVMAADGKVLSAPAAKPWPNKPPKCTDCACPSLFMKAYLMRGAGAVIHSHGMETCIATMLYPGAKEFMMTPLEMI

SEQ ID NO: 26344 - DNA, 336 bp, Panicum virgatum
  misc_feature: Ceres CLONE 1868953
  misc_feature: Encodes the peptide sequence at SEQ ID NO. 26345
tcctcagctcaggcgagcggcagagccgagcagagctcttaccctcctcaaaatcccgaccaggcgaccacctccatttgcccgtccggggggagccaaccacttgaccggcccagcgcgatggggtccgtcccggaggaccccgcggcgggcctgttcccctcccaactggcggaactccaggaccccccccggctcctccctgcaggctatatggtttcagacgcgtctccccgaggtgtcctcccgcccgtgcctcatcgacgggcacacgggcgccccccacccctacccagacgtggagctcctctcgcggcgcgcggcggcggcgctccg

SEQ ID NO: 26345 - protein, 111 aa, Panicum virgatum
  misc_feature: Ceres CLONE 1868953
  misc_feature: SWISSPROT Homolog: EC 6.2.1.12 4-coumarate--CoA ligase
PQLRRAAEPSRALTLLKIPTRRPPPFARPGGANHLTGPARWGPSRRTPRRACSPPNWRNSRTPPGSSLQAIWFQTRLPEVSSRPCLIDGHTGAPHPYPDVELLSRRAAAAL

SEQ ID NO: 26346 - DNA, 2278 bp, Panicum virgatum
  misc_feature: Ceres CLONE 1868954
  misc_feature: Encodes the peptide sequence at SEQ ID NO. 26347
ggcttagatcaaaccctccgatccccccaaaagcgtaagcgccacatatattgttgagcttgatcgagcattagaaacatggcgacctcgccgctgccacggtgggcaccgacgcccagcccgtcgcggccgctgtggtgtccttcgtcgtccgccgccggcagcggcagccgcttgctgcccccgttccgtgccatgctcggagccttacgtgggcgtgccgccgcccctgcgggggaggcacagccgccggcaccacctgccggggatggtggtgtccgcggtggaactcatgctgggtttgatggcattattgctgatcatcccgaggacgacgacgaccagcgggaggacatccgtcttggcggcggcggcagcggcgtgttcataacgtgggaggacgtgtgggtgacggcggtcgacggcagggggaagaccgccaccatcctgcacggcgtcagcggcagcgcgcgccccggcgaggtgctagccatcatgggcccctctggttgcggcaagactacactgctcgacaccttggccgggagactaaacacgaacctgaggagtaaaggagatattctcatcaacggccggcgacagaaactcgccttcggaacctcggcgtacgtgacgcaagagaacgtgttgatggccaccctgacggtgcgcgaggcaatctactactcggcgcagatccagctgccggacaccatgccggtcgccgagaagctcgcccgcgccggcgacacgatccaggagatggggctcgccggcgcactggacacgcgcatcggcgggcgccagaccaagggcatcagcggcgggcagaggaagcgcctcagcatctgcctcgagatcctcacgcgcccgcggctgctcttcctggacgagcccaccagcgggctcgacagcgccgcctcgtaccacgtgatgagccgcatcgccggcctcgccgccagggaggggatgaccatcgtcgccgtcgtgcaccagccgtgcagcgaggtgttcgagctcttccatggcctctgcttgctcgcctccggccagaccatctactttggcccggccgccaacgccgctgagttcttcacgtcaaacggctacccttgcccaccaatgagaaatccttcagatcatttcttgaggacaatcaacagagactttgaattggaaagtgaagcaacaagaacagtatccaagccatctgcagcagatgaagcaatagaaactttggtgaatgcctacaaatcctccaatacttcagaaaatgccaaaaaggaaatgcatgacataaatgaaatgggcggagtgatgctcagaagaaaacaagccactttccttaccaaggtgcttgtactcactagaagatcgtttgtgaacatgtaccgagacgttggatactactggttgcgacttggaatctatatttccattagtttatgccttggtaccatatactgcaattttggctatggatacgattctattcgttctagatcatcaatgctaatgttcaccggtggacttctaaccttgatggcaattggaggattcccttcctttgtggaggaaatgaagatatttaggagagagaggctaaatggacactacggtgtttcagcatttgtgatctccaattggttgtcagccacaccatatctcgtactcatcgctgtattacctggcgcaatagcttactatctgtctggtctaaagagacgagtagaccatttcatgtactttacgcttgtgctttgttcatgcacaatgcttgttgaaggccttatgatgatcgtagctgctatcgtgccagattttcttatgggcatcatcacaggtgcagggatacaaggtatcatgatgctcaactgtggattcttccaactacctagtaaactgccaaaaatagtatggaaatacccaatgttctacatttctttccacaagtatgtactccaaggattttacaagaatgagttcttgggtttggtgcttgaaaataacccaggagttggagataaaacaataactggggagcaagttatcagtatattatttgaaacagaaatggggcactcaaaatgggcggactttgcagtgttatgtggaatgattgtagcatataggctgctctttgtaatgattattaaggttgtcgacatgctaacgcccatgtttaagggtgaaacatttaggtgccactctcaatgcaagtaatgtatgatatgataaaggatgctaccaataaataaaaggtactccctccgttcgg

SEQ ID NO: 26347 - protein, 675 aa, Panicum virgatum
  misc_feature: Ceres CLONE 1868954
  misc_feature (95)..(285): Pfam Name: ABC_tran Pfam Description: ABC transporter
  misc_feature (385)..(597): Pfam Name: ABC2_membrane Pfam Description: ABC-2 type transporter
  misc_feature: SWISSPROT Homolog: EC 3.6.3.28 Phosphonate-transporting ATPase
MLGALRGRAAAPAGEAQPPAPPAGDGGVRGGTHAGFDGIIADHPEDDDDQREDIRLGGGGSGVFITWEDVWVTAVDGRGKTATILHGVSGSARPGEVLAIMGPSGCGKTTLLDTLAGRLNTNLRSKGDILINGRRQKLAFGTSAYVTQENVLMATLTVREAIYYSAQIQLPDTMPVAEKLARAGDTIQEMGLAGALDTRIGGRQTKGISGGQRKRLSICLEILTRPRLLFLDEPTSGLDSAASYHVMSRIAGLAAREGMTIVAVVHQPCSEVFELFHGLCLLASGQTIYFGPAANAAEFFTSNGYPCPPMRNPSDHFLRTINRDFELESEATRTVSKPSAADEAIETLVNAYKSSNTSENAKKEMHDINEMGGVMLRRKQATFLTKVLVLTRRSFVNMYRDVGYYWLRLGIYISISLCLGTIYCNFGYGYDSIRSRSSMLMFTGGLLTLMAIGGFPSFVEEMKIFRRERLNGHYGVSAFVISNWLSATPYLVLIAVLPGAIAYYLSGLKRRVDHFMYFTLVLCSCTMLVEGLMMIVAAIVPDFLMGIITGAGIQGIMMLNCGFFQLPSKLPKIVWKYPMFYISFHKYVLQGFYKNEFLGLVLENNPGVGDKTITGEQVISILFETEMGHSKWADFAVLCGMIVAYRLLFVMIIKVVDMLTPMFKGETFRCHSQCK

SEQ ID NO: 26348 - DNA, 1744 bp, Panicum virgatum
  misc_feature: Ceres CLONE 1868970
  misc_feature: Encodes the peptide sequence at SEQ ID NO. 26349
agggtttctcccccaattcgccgcgccgccacccgccgccgcagccatggccgccgacacctcgaagccgttcttccccgcgacgccgagccaggctctcctcccctcccggagcgccgccgctcgcgcctccctggacggctcctattggcgcgccttccgctcctccgagctcgtctccggcgccgacttccctgtcaccgacctcaccttcgccccggccgccgctgcctcctcctccccgaccctcgccgccgcgtggtccacctctgtgcatctcttctccggcgacccgctcgagccgctccgccggatctccgtcgccggcgacctcgccttctccccctccttccgctgcgacggcgtcctcctcgccgcaggcgacaagaagggcgtcgtccgcgtcttccgcgccgacaagcccgcggcgggcgccgccctccgcacgctgtgcgcccacgccgccgagacccgcgtcgtccggtacccggtcgccggcggggacaagctccacctgttcaccgccggagacgacgcgctcctcacctactgggacgtgccctcggagacgcccgtcttctccgtccccgccgcgcaccgggactacatccgcggcggcgcgacctcccccgccgaccacaacctcttcgccacgggctcctacgaccgcagcgtcaaattgtgggatgcccgcacgggaaacactggcccgtcgttatccttctcccacggggaactggtggagagcgtgctgttcctgccgtccggcgggttgctggccacggctggagggaacatggtcaagatttgggacgtcattggcggcggccggctcgtgcactctgtggagagccatgtcaagacagtgatggcgctggcgcttgggaagatggccaacaccaccggggagacgcggctgcttagtgcgggcattgatggatatgtgaagtgctttgattttggcaagcttaagatcacacattcactgcggcacccgcagccgctcctgtctgtcgcttgctcgccctgcggcactgtcttggtggctgggtctgcaaaagggaagatttatatgggcaagaggaagaaggctgttgctgaggatgaagggaagaaggctggcagtgatttgattgattgggtatctccagagctggagaagccagtgttgaggccaaattactacaggtacttcctccgtggacagaatgagaaggccaaagagggtgactttgtgattgagaagcctaagaaggtgaaagttgcagagcatgacaagttgcttagaaagttcaggcacaaggatgctctagtttcagcgttggttaaaaacaacccaagaagtgctgtggctgtgatggaggagctagttgcaaggagaaagctggtgagatgcattgggaatttggatacagaggaacttgcacttctgcttgagttccttcaccggaacgcgacattaccaaggtatgcaaggttcttgttgggtgtggcaaacaaggtactggagatgcgagaggaggatatccgatctgatgagaagctgaggatgcacattaggaatctcaagagaatggttggagaagagatccagatacagcacacattgctggggattcaaggaatgatttcgcccatgcttgcacttgccaccagatgagaaggtgcttttctttaaagggaattttttgctatatgttaatttacaatgagggggtgccatatgcaatgtgtattgctttgg

SEQ ID NO: 26349 - protein, 537 aa, Panicum virgatum
  misc_feature: Ceres CLONE 1868970
  misc_feature (175)..(214): Pfam Name: WD40 Pfam Description: WD domain, G-beta repeat
  misc_feature: SWISSPROT Homolog: EC 2.3.1.48 Histone acetyltransferase
MAADTSKPFFPATPSQALLPSRSAAARASLDGSYWRAFRSSELVSGADFPVTDLTFAPAAAASSSPTLAAAWSTSVHLFSGDPLEPLRRISVAGDLAFSPSFRCDGVLLAAGDKKGVVRVFRADKPAAGAALRTLCAHAAETRVVRYPVAGGDKLHLFTAGDDALLTYWDVPSETPVFSVPAAHRDYIRGGATSPADHNLFATGSYDRSVKLWDARTGNTGPSLSFSHGELVESVLFLPSGGLLATAGGNMVKIWDVIGGGRLVHSVESHVKTVMALALGKMANTTGETRLLSAGIDGYVKCFDFGKLKITHSLRHPQPLLSVACSPCGTVLVAGSAKGKIYMGKRKKAVAEDEGKKAGSDLIDWVSPELEKPVLRPNYYRYFLRGQNEKAKEGDFVIEKPKKVKVAEHDKLLRKFRHKDALVSALVKNNPRSAVAVMEELVARRKLVRCIGNLDTEELALLLEFLHRNATLPRYARFLLGVANKVLEMREEDIRSDEKLRMHIRNLKRMVGEEIQIQHTLLGIQGMISPMLALATR

SEQ ID NO: 26350 - DNA, 1288 bp, Panicum virgatum
  misc_feature: Ceres CLONE 1868988
  misc_feature: Encodes the peptide sequence at SEQ ID NO. 26351
gacacaaattgggcaaatctttttaccctttctggcgtcgccaactccacttgtcggatcttgcccatatgctatggagctcgccggagccgcgtcccctcggtcgccggaatcccacgtggcgccgccccgcccgcctccgcagccgccggagaaggatgcatgcgaagatacaggggacatgagtattactggggaaaagccatgcacacatcaggagttagactttggtcagacaaatagttctagccttaacagttccagtgagcgtgagaatcaggcacccagcaatgacgaaatgactggatcagagtccaatttggagacagccaagactgagggcgatgtaccgagtggagagaaggtcctgaagaaaccagataagatcctgccatgccctcgttgcaacagcatggatacaaagttctgttattacaacaactacaacattaagcaaccaaggcatttttgcaagagttgtcagaggtactggactgcaggtgggagcatgagaaatattcctgtcggtgctggtaggcgcaagagcaagagctctagttcgaattgccgcagcatattgattcccggcagtagtgtagccactcctgtgggagagtctaccctctttccattgcctatcaacggaaatcaagcagcagttaacttcgggcctgattcccctctctgcaactccatggcctcggtgctgaagattggaggggagcagagtaagaatgccaaccctgcctcaacagcacagccaagaaatggagaaacccagatttgcccaccttctacgacaacatcagacggtcctcggagtgaatctcataaaggaacagtgagtgcacatcagaatggagttgttgggcatggcaacggggtcacttccatgcatcctataccattcttccctggccctccttttgtgtacccatggagtccagcatggaatggcgttcctgccgcggcagcaccggtatgcccagccccagcagaagctgtgaattcttcagaaaatggcaacagtagtagtagtgttcaatggaattttccaccattggtgtcggtactgccaccaggattctgcggtgcacctattccagttcctgtaatgccatcttcagtttggccattcattacgccttggcccaatggagcatggaacacaccatggctcggacctggcgtgtcagcatcatctcccacaggcagcaccacatgttcagatagcgggtcacctgtcctggggaaacactcaagagactccagacctcaaggtgatgag

SEQ ID NO: 26351 - protein, 404 aa, Panicum virgatum
  misc_feature: Ceres CLONE 1868988
  misc_feature (101)..(163): Pfam Name: zf-Dof Pfam Description: Dof domain, zinc finger
  misc_feature: The sequence is a functional homolog of SEQ ID NO 1131 in the 10/374,780 US patent application
  misc_feature: The sequence is a functional homolog of SEQ ID NO 1330 in the 10/412,699 US patent application
MELAGAASPRSPESHVAPPRPPPQPPEKDACEDTGDMSITGEKPCTHQELDFGQTNSSSLNSSSERENQAPSNDEMTGSESNLETAKTEGDVPSGEKVLKKPDKILPCPRCNSMDTKFCYYNNYNIKQPRHFCKSCQRYWTAGGSMRNIPVGAGRRKSKSSSSNCRSILIPGSSVATPVGESTLFPLPINGNQAAVNFGPDSPLCNSMASVLKIGGEQSKNANPASTAQPRNGETQICPPSTTTSDGPRSESHKGTVSAHQNGVVGHGNGVTSMHPIPFFPGPPFVYPWSPAWNGVPAAAAPVCPAPAEAVNSSENGNSSSSVQWNFPPLVSVLPPGFCGAPIPVPVMPSSVWPFITPWPNGAWNTPWLGPGVSASSPTGSTTCSDSGSPVLGKHSRDSRPQGD

SEQ ID NO: 26352 - DNA, 670 bp, Panicum virgatum
  misc_feature: Ceres CLONE 1868989
  misc_feature: Encodes the peptide sequence at SEQ ID NO. 26353
tttgtctgctttggccaatgcaacttgccatcacattgcagttcacgacatctggatggtgccaatatttttacaggatcaaagaaactgcatattgcagctcagttctttaaaacaaaagatcatgccacttgagctgaagatgagctgatcctgctggtgcgcatcggcagccggccatggagctcgtaggcttgacctcggacacctcgacgatccccctcctctgctgcctcatcaccctgttcgtctcgctccttttcttcattcgctgccgccgtggccccagcgacgactcagcagcggtcaacggtaaggcccggctcccgccaggcccgccggcgctggtcttcctggccaagttcttggcgctgcggcgatccatcttcgacctggccccgctgctgcgcgacctgcacgcgcgccacgggcccgtcatctccgtccgcctcttcggcacgctcgtcttcgtcgccgaccgccgcctcgcgcaccgcgccctcgtccgcgacggcgccaccttcgccgaccgcccgccgctcgtcgacccggacccgctcttcagcgccggcgacatcaacaccgcgccctacgggccctactggcgcctcgtccgccgcaacctcgccgcccacgcgctgcaccgcgcccgcgtcggcctcttcgcgcc

SEQ ID NO: 26353 - protein, 163 aa, Panicum virgatum
  misc_feature: Ceres CLONE 1868989
  misc_feature: SWISSPROT Homolog: EC 1.14.13.68 4-hydroxyphenylacetaldehyde oxime monooxygenase
MELVGLTSDTSTIPLLCCLITLFVSLLFFIRCRRGPSDDSAAVNGKARLPPGPPALVFLAKFLALRRSIFDLAPLLRDLHARHGPVISVRLFGTLVFVADRRLAHRALVRDGATFADRPPLVDPDPLFSAGDINTAPYGPYWRLVRRNLAAHALHRARVGLFA

SEQ ID NO: 26354 - DNA, 672 bp, Panicum virgatum
  misc_feature: Ceres CLONE 1868995-R
  misc_feature: Encodes the peptide sequence at SEQ ID NO. 26355
aacttgtgatgatcagcagagagagatgatccttacaaggataaaaacacacctgaacaccctcaagaagtacacttacgggaagcacatagtagcacgcgtagagaaacttgttgctgctggagagaagcgccttgggcttcaaccagcatgcactgctgcctgaagggcaaatgatctagttgtacagctaacagttgctaggtttggactcacgttttttctctactgaaaaccttataaaagggccattttagccttgccggaaataaatactgtatgtctgcgccgaagagtgtacattaatcctttagctgaagaccccacgcagaatcaagggaggagtgatgcatgcaagtttgatctgcaagctgctgtaaagaggaggaagatggaggggagtaagaagcacgtttattactctgccgctgtacaaattaaatttagctttagagtgagagaaagtaagctgttagctgtctaaaagaaaagccgtctggttgtatctgttgatatagtagtggcttcctgttgtttggcctttgttgtaacataagcagaggcgcactagccttcttttacagttaagctgaattattagtaccagctttcctggactgtttggtatgtattatgacttgtttcttgtgctaatggagtctcatgtaatcc

SEQ ID NO: 26355 - protein, 54 aa, Panicum virgatum
  misc_feature: Ceres CLONE 1868995-R
  misc_feature: The sequence is a functional homolog of SEQ ID NO 1232 in the 10/666,642 US patent application
TCDDQQREMILTRIKTHLNTLKKYTYGKHIVARVEKLVAAGEKRLGLQPACTAA

SEQ ID NO: 26356 - DNA, 1067 bp, Panicum virgatum
  misc_feature: Ceres CLONE 1868995
tcttctccagtctctactcttcttcccccactaccagcacgccactgctcacacttgcagcggaaagggggagctccaatccctcgcaaatccgcaccatttcaccgaattcgaacgccttctctcccgcagatggaagctctgtccccgatttgtccatcctgagcagccaaaatcggttcttgccgcttcccgatctcggctagtgctcattccgcggatagttttttgttaaaagctgtggctttctcggttttggtcgcgggagcacgataatggcgggattctagcgcgctaaaccctaaagatcttggcttttctgcgcccaccgcgatggtgacggagatggcggcgcgcggcggcgaggcgttcggcgcggaggcggaccgggacttcgaggtcttccgcagcggctccgcgccgcccaccgtcgagggtgccatgggcgctgccaccgccgccggcagcctcttcctcgacgacgaggtccgcgccgacccggcctaccagagctactactactccaatgcgcacctcaacccgcgcctcccgccgccgctgctctccaaggaggactggcgctcctcgcaccaccgcctccgctcctccggccttggcgggatcggggacggcaggaggcagcagccgcaggcggcggctgccgaagggacggtggggctgcccgggatcgatcttggtcgccagaggagcttctccaacgtctttcaggaagactcataccaacgggatatggataggcagactgccaaccacaatagtaatgacttgctaggttcttctggaatacagtatggcctacatcgtggacctggagctatgggaggcctgcactctagtaataattcacgaggcttggatgaaattcagaacaatgatttatcatcaaatacatacgcttctattttagggtcacctctttctcgaagtgcatctccagatcctgagcttgtgaggagggcccctagtccatctctacctccaattggtgtgaaagttagtgctaatgacaagaagattaatggtggttcatcttctttccgtcgtag

SEQ ID NO: 26357 - DNA, 1898 bp, Panicum virgatum
  misc_feature: Ceres CLONE 1869005
  misc_feature: Encodes the peptide sequence at SEQ ID NO. 26358
ctacgtacatactaccattacgaccatcatggagttctcactcctctgccttccggtggccgtgtggctcctggtgctcgccggggctgacttcgcggcggcgcaacggagccccagctgcaaaacgatgtgcggcgacatcgaggtcccgtacccgttcggcttggaaaaagagtgcgcaatccacagcggctttcatctcaactgcacgaccgcggacggcaccaccaagctgttagggggtaacgtggaggtgaccaaggtctccgtgcaggataacaaggcctggttcaatacttatatctcccggcagtgctacagccaatccatcaagaggatgacagactggaacgcgtggataaacattaccggcacgcccttcgtggtatcggcagacgataacaaagtcaccgtcctcgggtgcaacagtttggcctacatgcgaagcaacgattacataatcggctgcgtgtcgacatgcggcgagacaagccccaagaacggctcgtgttctggtgctgggtgctgccgggtggatatcccgagaggagtccggtattatgaaggttttttcaacccattatacaacaccagcgagatctggaggacaaacccttgcaattatgtaggtgtgatcgcaaatgaagccttcaacttcagcaccacttatctcaactcgacggtgttctacgacacagacggggcaaagaaaccaattgtgatggaatgggcgattgcacggaatacatgtgaagaagccaaaattgacaagaatacaccctacgcgtgtgtcagcgaccatagcaattgtatcacgaatgatgcgggctatgcctgtaggtgctccgatggatacgaaggaaacccatacatctacgatggatgcacagatatcgatgagtgcctagataatgttaaatacccgtgtgctggaatttgcaaaaacacaccggggagtttcacttgttcatgcccacgagggaaacgcatgatcggtagcgtttgtttgaaagatcagaagtcaacctggatggcaccagttgttggtgcaagcattggacttgtggttcttgtggtttccgtcgcttgtgcatgctcgatccaagatagacgaaacctacaccgcatcaaacagaagtattttcgacagcatggtggcctactgctattccaggagatgaagtcgcaacaaggaattccgttcaaaatattctctgaagaagaagtacaggaagccacaaaccggtttgcggagcagcaagtcatcggccatgggggtcacgggaaagtctacaagggagttttgaagggcgacgtagaagtagccgtgaaaagatgcatgacaatcgatgaacaacaaaagaaagaattcggcaaggagatgctaatcctatcccagatcaaccacaggaacatcgtcaagctcctcggctgttgcctcgaagttgaagtacccatgctggtgtacgagttcatcccaaatggaacattgttccatctcatccatggcagccacagcgggcacatttccttggacactcgtgtgaggattgctcatgagtctgcagaagctttagattaccttcattcctctgcatccccaccaatcgtccatggcgatgtcaagtctgctaacatcctcctgaatggcgacttcacagcaaaagtatcagactttggcgcgtccattctggcaccaagtgatgagtcgcagtttgtaacacttgtccaaggaacttgtggctaccttgacccggagtacatgcagacatgccaactgacagataagagcgacgtctacagcttcggagttgttctcctggagcttctcacacgcaagaagccattcaacctcaaaggacctgagcacgagaagagcctgtccatggtgttcctag

SEQ ID NO: 26358 - protein, 623 aa, Panicum virgatum
  misc_feature: Ceres CLONE 1869005
  misc_feature (407)..(623): Pfam Name: Pkinase Pfam Description: Protein kinase domain
  misc_feature (288)..(326): Pfam Name: EGF_CA Pfam Description: Calcium binding EGF domain
  misc_feature: SWISSPROT Homolog: EC 2.7.11.1 Non-specific serine/threonine protein kinase
MEFSLLCLPVAVWLLVLAGADFAAAQRSPSCKTMCGDIEVPYPFGLEKECAIHSGFHLNCTTADGTTKLLGGNVEVTKVSVQDNKAWFNTYISRQCYSQSIKRMTDWNAWINITGTPFVVSADDNKVTVLGCNSLAYMRSNDYIIGCVSTCGETSPKNGSCSGAGCCRVDIPRGVRYYEGFFNPLYNTSEIWRTNPCNYVGVIANEAFNFSTTYLNSTVFYDTDGAKKPIVMEWAIARNTCEEAKIDKNTPYACVSDHSNCITNDAGYACRCSDGYEGNPYIYDGCTDIDECLDNVKYPCAGICKNTPGSFTCSCPRGKRMIGSVCLKDQKSTWMAPVVGASIGLVVLVVSVACACSIQDRRNLHRIKQKYFRQHGGLLLFQEMKSQQGIPFKIFSEEEVQEATNRFAEQQVIGHGGHGKVYKGVLKGDVEVAVKRCMTIDEQQKKEFGKEMLILSQINHRNIVKLLGCCLEVEVPMLVYEFIPNGTLFHLIHGSHSGHISLDTRVRIAHESAEALDYLHSSASPPIVHGDVKSANILLNGDFTAKVSDFGASILAPSDESQFVTLVQGTCGYLDPEYMQTCQLTDKSDVYSFGVVLLELLTRKKPFNLKGPEHEKSLSMVFL

SEQ ID NO: 26359 - DNA, 128 bp, Panicum virgatum
  misc_feature: Ceres CLONE 1869005-R
cccggagaaggccccccggagcggcccacacgcaagaagccaaacaaccacaaaggaccggagcacgagaagagccggcccagggcgagccgagaggcaaggaaggagaacaagcgagaggacaccca

SEQ ID NO: 26360 - DNA, 1105 bp, Panicum virgatum
  misc_feature: Ceres CLONE 1869007
  misc_feature: Encodes the peptide sequence at SEQ ID NO. 26361
cttccgtcgccctcccctcgcgcgccgctcgcaaaacctctcccgctccccctccgcccgcccagaaccctagccccggcggcgcgcccgctcgcttccatggccgcgccggcgggtgggacggcggcgacgagccgggacgcgttccgcgcggcggtgaccaacacgctggagcggcgcctcttcttcgtgccctccttcaagatctacggcggcgtcgcggggctctacgactacgggccccccgggtgcgccgtcaaggccaacgtcctcgccttctggcgccagcattttgtattagaggaagggatgcttgaggtcgactgcccatgtgtgacaccagaagttgtcttgaaagcctctggtcatgtggataaatttacagacttaatggttaaagatgaaaagacaggcaactgctaccgtgcagatcatttgctcaaggatttctgtaaggataagcttgagaaggaccagacattgtcaccagagcaggcagaagaatacaataaaattcttgctatcttggatgatctctctgctgagcaattgggtgctaagattaaggaatatgggattgttgctcctgacactaagaacccgttgtcagatccctaccccttcaatctcatgtttcagacttccattggaccatcaggtttgagtccagggtatatgaggccagagacagcgcagggtatctttgtgaactttaaagacttgtattactacaatggcaacaagctaccttttgctgcagctcaaattggccaggccttcaggaatgagatatctccccgccaaggccttctgagagtccgcgagtttacattagcggaaattgagcactttgtggatccagaggacaaatcccacccaaaatttggtgatgtctctgatctagagttcttgatgtttccaagagaagatcaaatggcaggaaggtcagccacaagacttaaactcggaaatgctgtatctgagggaactgtgaacgatgagacccttggctactttatcgggaaggtctaccttttcttgacacaacttgggattgataaagatcgtctacgcttccgacagcatctgccaaatgaaatggctc

SEQ ID NO: 26361 - protein, 335 aa, Panicum virgatum
  misc_feature: Ceres CLONE 1869007
  misc_feature (53)..(334): Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
MAAPAGGTAATSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDQTLSPEQAEEYNKILAILDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFLMFPREDQMAGRSATRLKLGNAVSEGTVNDETLGYFIGKVYLFLTQLGIDKDRLRFRQHLPNEMA

SEQ ID NO: 26362 - DNA, 715 bp, Panicum virgatum
  misc_feature: Ceres CLONE 1869007-R
  misc_feature: Encodes the peptide sequence at SEQ ID NO. 26363
ggcattatatactgcctttttgagcactgttctaccaaaggcctggcaaggcagaggatgagcagttaaatgtgtttggtttcccccctcttgttgccccaataaagtgcactgtctttccactggtgaagcttgagaaatttgaggttgttgccaagaaaatctcaaaggccttgacagcagcagggatttcacatattatcgacatgacaggtaacacaataggaaaacgctacgcaaggacggacgagctcggcgtgcccctggcgatcaccgttgacaacaccacaagcgtgacggtgcgtgaccgggacagcaaggaccagatccgtgtggaggtggatgaggtggcctcggtggtgaaggaggtgacggacgggcagagcacctgggccgacatcatgtggaggtacccggcgcacactgcctcggtcgccgaggatgaggaggccgaaccctgaagagcacagccaaaacaatatccaacgatcgttggcccctgatagcatttcctgcttaaaagaaacagaatgcgttgtcgtgtaagtctacggtagcctgattcctgcaaatttccacatagtttatttgtgaattgtgatgtttgacccgtagattctgctgttcgtttcatttttttttttcaccttgcgaactgcaatgtttgatgaatcctttgtcagattgcaattttcacagtgttccttttttgcag

SEQ ID NO: 26363 - protein, 84 aa, Panicum virgatum
  misc_feature: Ceres CLONE 1869007-R
  misc_feature: SWISSPROT Homolog: EC 6.1.1.14 Glycine--tRNA ligase
MTGNTIGKRYARTDELGVPLAITVDNTTSVTVRDRDSKDQIRVEVDEVASVVKEVTDGQSTWADIMWRYPAHTASVAEDEEAEP

SEQ ID NO: 26364 - DNA, 725 bp, Panicum virgatum
  misc_feature: Ceres CLONE 1869010
  misc_feature: Encodes the peptide sequence at SEQ ID NO. 26365
gaagcgggcgcgtcgccaaacgccttctctctcttccacgggagattcagtcggctcccaactgcctattatatttgcttttacagtacagcggcgtcgcctctgcccgcgctgcatatagtaataagaagaagaagaagcagtagcagcaagcagaagcacaagaagaagaggatcggagggccgcaccaacagacggccgccggagccgcgataatggagcagggcggcgccggttcacggcggcgcgcgcgagggattgccctgctggttctcgccgtcgtgtcgctgagggcgctccacgccgaggccgctgcgatcacgcagtcggatttccccgagggattcgtcttcggcgccgggacgtcggcctatcaggtggaaggcgcatgggatgaggacggaaagaaaccgagcatctgggacacatttgcgcatcgtggtgagtggggacgcctcaggactttgcttatgatgttttaacagtctgaggccaagtaccagactaccagtatattctcacaggcgccttttgttcttggaggctatgcttttgtcttttgaccatgcgactggagacgtagctgctgatcagtatcacaagtacaagatttccacatttaatttcaggaggatgtgaagctaatgcatgagatgggcttggatgcgtacagattttctattgcctggacaaggcttattcctgacggtcgaggagctgtgaa

SEQ ID NO: 26365 - protein, 88 aa, Panicum virgatum
  misc_feature: Ceres CLONE 1869010
  misc_feature: SWISSPROT Homolog: EC 3.2.1.21 Beta-glucosidase
  misc_feature: Useful for making plants with altered cell wall content and/or composition
MEQGGAGSRRRARGIALLVLAVVSLRALHAEAAAITQSDFPEGFVFGAGTSAYQVEGAWDEDGKKPSIWDTFAHRGEWGRLRTLLMMF

SEQ ID NO: 26366 - DNA, 1827 bp, Panicum virgatum
  misc_feature: Ceres CLONE 1869012
  misc_feature: Encodes the peptide sequence at SEQ ID NO. 26367
gccgaatggtcgccgccctccgccgcgcaccaccatgctgctccgccgcctcctcctctcctcccgccacttccggcacggcctccaaaccgtagctccggccaccagcgcctcgtcctctccacttccatttggccgcctccgggacctcctcccctcgcgcgtcctctccccgaggctcctctccacctccggccgcgacgacgacggcaacaagccatggagtttcgcggccgactcgggcgatccggaccccttcgcccaagaggacgccgcagctgacgctggagaggcactgccggtaggacctgcggccgtcgccgacgagccctggacgaagggcttcggcgtggaaggcgagaatggggacgtgttcgaggggatctacaaggaggtggcgtcggcggtcccggcgagcggagaggcggctccagccggtgacgaggagcagtggacgctgagtggggatgagaaggatccctttgccgattccgtgctcggggagggcatcgatgggattcaaagagagggtggtgggctcgatgagctcgatgggggtgaagaccctgaggctgagctgaagcgacagaagaacatggagagggagaaggagctgatggagatactcaaaggtccaaatcgtgcgtttggtgatctcattgctaactctgggatcaccgagggaatgattgatagtttgatcctcttaaaggatgtcagggatgttccgggattgcctcccctaagtgaaatagaagatgaaggtatccagaaacttagtgcaacatcaagtagagctgaagtcgagcgccaaaagcaagaagaaattgccaaggcacgagtaagacaggttgatgagaaaggaagggcttatggaacagggaaaaggaaatgcagcattgcccgtgtttggattgagcctggtaatggcaaattcattgtcaatgaaaaggagtttgatgcatacttcccaattctggaccatcgagccgaacttcttcgtccatttacagttaccaagaatttgggcctttttgatgtgacctgtactgtgaaaggtggtggcatctcaggacaagttggagctatccgcttaggaatcagcagggccttgcagaattgggaaccaggactgcgtccatatcttaaagcagctggatatttgacaaaagattcacgtgtggttgaaaggaaaaagcctggaaaggcaaaagcaagaaagagcttccaatgggtcaagcggtaacaggtctgtcagcagaactaccatctatttttgtggcagatctctgctcttcgttgtgggttttcttgtcaatgtggagatctccttgcacttggtctgcggaaggtccgttcagcttgatactaaaatactcctgcttgtatggacatggggatcatgctatacttgagtattctatttatgaaatgatcacacagcgaattgatccagagaatgtcgttttgacctaatcaagattcgaagttgctctgcattgagctgccaataaagcaggccgtgccaatgaaactcaatgttcagctccgatgaaaaatcccctcacctcgatgagggtttcatggctgagaaacaggtttcgtatgccaacagatgattatgataatttgcttcacaatttcttttctctctccatgtttgttcatgtactctagccatcaggtatcatttgactagggtaaaggtgttgtacacgattgttttctgtctgatgaaataatagctagcaagtcccaatctcagagcatggctcgttttcaattgttaccgtccgttttgtactgattctcaatcatgttaatctt

SEQ ID NO: 26367 - protein, 403 aa, Panicum virgatum
  misc_feature: Ceres CLONE 1869012
  misc_feature (283)..(403): Pfam Name: Ribosomal_S9 Pfam Description: Ribosomal protein S9/S16
MLLRRLLLSSRHFRHGLQTVAPATSASSSPLPFGRLRDLLPSRVLSPRLLSTSGRDDDGNKPWSFAADSGDPDPFAQEDAAADAGEALPVGPAAVADEPWTKGFGVEGENGDVFEGIYKEVASAVPASGEAAPAGDEEQWTLSGDEKDPFADSVLGEGIDGIQREGGGLDELDGGEDPEAELKRQKNMEREKELMEILKGPNRAFGDLIANSGITEGMIDSLILLKDVRDVPGLPPLSEIEDEGIQKLSATSSRAEVERQKQEEIAKARVRQVDEKGRAYGTGKRKCSIARVWIEPGNGKFIVNEKEFDAYFPILDHRAELLRPFTVTKNLGLFDVTCTVKGGGISGQVGAIRLGISRALQNWEPGLRPYLKAAGYLTKDSRVVERKKPGKAKARKSFQWVKR

SEQ ID NO: 26368 - DNA, 724 bp, Panicum virgatum
  misc_feature: Ceres CLONE 1869017
  misc_feature: Encodes the peptide sequence at SEQ ID NO. 26369
acgaacgagcagttgcgtgcgctgcgctcgctttccccgaaacgggacccgagcggcaggagaccagacagagggagaaggaagaagccgccatgaagcagcgccagctgcggcagcagctgcctcctactagtcccggtcctcgccgttaaatccagagcccccccaagcccggctcctctcctcccggctcccgctcccgctcccattccctgacccaaccagaacacccagataagagattccgttccgtctgcggcgttggcgtctccgtgagcggggcggccgccgggagcttgatgcgctaggggcggcggctccaccccgtcgtttgatgggcaacgcatgcggcggcgcccttagatccaagcacctgcccagcttcaagcacgccgcgtcgcagcgccaggactcggagtacagcgccgccgacgactcgccgaagaagccctccacccgcgcgcccacgccgcccgccgccacggacgcccacgcgggccacgcgtcggcgccgcccgccgccgggatgaggcgcggcggggcgggcgcgccgccggacctcggctccgtgctcggccaccccacgcccaacctccgcgacctctacgcgctgggccgcaagctcgggcaggggcagttcggcaccacctacctctgcaccgagctcgccacgggggtcgactacgcctggcagtccatctccaagcgcaagctcatcaccagg

SEQ ID NO: 26369 - protein, 129 aa, Panicum virgatum
  misc_feature: Ceres CLONE 1869017
  misc_feature: SWISSPROT Homolog: EC 2.7.11.1 Non-specific serine/threonine protein kinase
MGNACGGALRSKHLPSFKHAASQRQDSEYSAADDSPKKPSTRAPTPPAATDAHAGHASAPPAAGMRRGGAGAPPDLGSVLGHPTPNLRDLYALGRKLGQGQFGTTYLCTELATGVDYAWQSISKRKLIT

SEQ ID NO: 26370 - DNA, 716 bp, Panicum virgatum
  misc_feature: Ceres CLONE 1869031
  misc_feature: Encodes the peptide sequence at SEQ ID NO. 26371
aagcaaactgcaccaaaagttgtgaggcattatccatcagaatcgacgctttttccatatgaactttttgtgaagctctatgacaagattgagttgcacccttttggtcttaataaccttggcaacagttgctatgcgaatgctgttcttcagtgcttgatgtttactcgaccacttacaacatatcttttggaaggacttcattcaaaaaaatgttccaaaagggaatggtgcttcatgtgtgaatttgaaaaactcattgtggagggcaaacggcgcaagacttctttgtcaccaactgggatactctctcatttgcatgacattggcagtagctttggtcctggtaaacaagaagatgctcatgaatttcttaggtatgcaattgatgctatgcaatctgtatgcatgaaagaagctagaaaaggaggtgcccttcggtcagcagaagaaactacacttgtgcaattgatatatgggggctatctgcgatctaagataaagtgctcaaggtgtcatactacttctgagcaatgtgagcgtatgttggatcttactgttgaaatagatggtgacatcagttcactcgatgaggctcttgtgcgatttacatccacagaagtattggatggagaaaatagatatcactgcagcagatgcaaatcctatgagcgtgctaaaaagaagttgacaatagaagaagcaccaaatgttct

SEQ ID NO: 26371 - protein, 238 aa, Panicum virgatum
  misc_feature: Ceres CLONE 1869031
  misc_feature (32)..(234): Pfam Name: UCH Pfam Description: Ubiquitin carboxyl-terminal hydrolase
  misc_feature: SWISSPROT Homolog: EC 3.1.2.15 Ubiquitin thiolesterase
KQTAPKVVRHYPSESTLFPYELFVKLYDKIELHPFGLNNLGNSCYANAVLQCLMFTRPLTTYLLEGLHSKKCSKREWCFMCEFEKLIVEGKRRKTSLSPTGILSHLHDIGSSFGPGKQEDAHEFLRYAIDAMQSVCMKEARKGGALRSAEETTLVQLIYGGYLRSKIKCSRCHTTSEQCERMLDLTVEIDGDISSLDEALVRFTSTEVLDGENRYHCSRCKSYERAKKKLTIEEAPNV

SEQ ID NO: 26372 - DNA, 698 bp, Panicum virgatum
  misc_feature: Ceres CLONE 1869036
  misc_feature: Encodes the peptide sequence at SEQ ID NO. 26373
tccttcattcctagtccctggccgccgcggggccgctggccagctgacggcgccccccgccgttgcgcgccgcctcggcttccaaacggcggcacctcgctgatttgactttcaagcaccagtgatgcaaagggacaccagctctagcgatgcttctgcttctcacacagggcgtgttagacgtcggagacagccaagtgaggctaccgcggatgggaatagagctaatggacagccattgcttgtcaatgatcggaacaagtacaaatcaatgcttatccgtacatattcaacagtatggatgattggaggctttgccttgattgtttacatgggtcatctatatatctgggccatggttgttgtgattcaaatatacatggcaagagagcttttcaacctgctcataaaatccagtgaagaaaaacaactgccagggttcaggctcctgaactggcacttctttttcacggcgatgctgtacacttacgggcgctttcttagtcggcagcttgtgaatacagtaacttcagatcacttactgtataaggttgtcagcggcctaataaaataccagatgtttatttgctattttctttatattgcagggtttgtatggtttattttgactctgaagaaaaagacatacaagtatcaattcagacagtatgcgtggacgcacatgatactttttacag

SEQ ID NO: 26373 - protein, 191 aa, Panicum virgatum
  misc_feature: Ceres CLONE 1869036
  misc_feature (51)..(191): Pfam Name: CTP_transf_1 Pfam Description: Cytidylyltransferase family
  misc_feature: SWISSPROT Homolog: EC 2.7.7.41 Phosphatidate cytidylyltransferase
MQRDTSSSDASASHTGRVRRRRQPSEATADGNRANGQPLLVNDRNKYKSMLIRTYSTVWMIGGFALIVYMGHLYIWAMVVVIQIYMARELFNLLIKSSEEKQLPGFRLLNWHFFFTAMLYTYGRFLSRQLVNTVTSDHLLYKVVSGLIKYQMFICYFLYIAGFVWFILTLKKKTYKYQFRQYAWTHMILFT

SEQ ID NO: 26374 - DNA, 621 bp, Panicum virgatum
  misc_feature: Ceres CLONE 1869047
  misc_feature: Encodes the peptide sequence at SEQ ID NO. 26375
caattccttcgcttctcgatttcacagcagcctttgcagccgagctgaatcgtctggttcaaatcatctcccctctctctctctctctctctctctctctctctctcgcagcctcccttgttggttggttggttttcgcctccgatccaaagggaagagagccatggcgctgatgacgctgcgttccaccacgtcgttcctgtcgcccgtcgaccccagctccaagctcctccacaagcccggcgccgacgacgcgccgccgagctgcgccgccgcggcgcccgcgccggcggcggaccgcgcgccggccggggccgccgccgagctgctgcacgccggcggcgcgggccaggaccacgggcgcgcgcgcggcggggtccccgtctacgtgatgctgccgctggacacggtggggcccggcggtcagctgtcgcggcagcgcgcggtggcggcgagtctgatggcgctgcggggcgccggggtggagggcgtcatggtggacgtctggtggggcgtcgtggagcgggagggccccggccgctacgactgggaggcctacgccgagctcgtgcgcatggtggagcgcgccggcctgcggctccaggccgtcatgtccttcca

SEQ ID NO: 26375 - protein, 152 aa, Panicum virgatum
  misc_feature: Ceres CLONE 1869047
  misc_feature: SWISSPROT Homolog: EC 3.2.1.2 Beta-amylase
MALMTLRSTTSFLSPVDPSSKLLHKPGADDAPPSCAAAAPAPAADRAPAGAAAELLHAGGAGQDHGRARGGVPVYVMLPLDTVGPGGQLSRQRAVAASLMALRGAGVEGVMVDVWWGVVEREGPGRYDWEAYAELVRMVERAGLRLQAVMSF

SEQ ID NO: 26376 - DNA, 2235 bp, Panicum virgatum
  misc_feature: Ceres CLONE 1869049
  misc_feature: Encodes the peptide sequence at SEQ ID NO. 26377
gtaggcctctcccgctctcttctcttcttgtgtctgacttcttcctccctccgggagtcagtccagctcaccaggaaggagaagttccatagccttcttggctcatctgcccgcgtccacgctcgaacagttgagtcgttcttcctctcccaatccccccattgttccattgatctccctcccggcgttgtagaaaccggatgtacccgcgctgggcagcaagaagcagcaagcgcgtgacgtttctcccccggcgtcagaggattaggtggctcctcgttttccccctggattccgcggctcgattcacgatcttggaaacagcttctttttttttcaatgtacttttatcatttcaatacggtggcagaggcatccggtggcgatgctgatgcagtgctcgatcgcctagcagcactagcgcgaccagcagctagcgtttttttctttagttttttgtttcgatccgacggcacaacttgccgctgatccaccagaaaaacaacgctttttcgggggcgaaaagtatgccaatttggccgtacatttcgccaagttgcactcctgttccgatgttgattactggtcccccgtttcttcccctcccctgccaacgtttttgagaggataagacctgcttcgtttcgctcacttgtgttcgtcgtggtttgcgttgtgcgcgcgtgcagaggcggccggggagcgggggtagtggtggtggtggtggcccttgctgggtggaggtggaggcttcgattcgggcggtggattgtggcctgacgaatcccggaaaggccgccggaaagggagaacaaaggtaagctaagcaggcagccgtaaagccatggggtgcggggcgtcgagccagaaggacgccgtcggcgggccccggagacggccggggagcgtcggcgacgtggtcgtgttcctcccgggcctccgggtgccgaggagcgtcgacctcgcccaggcgctcggcgggcgcctggacaggagcatcgtggagcggctgtcggctctgagagctcgcgtcgtcgagatggcaatgcaagagtcggcggcggcgctgaagccgaggcggaagacggcggcggcacggcacgggtctagtacagccagtctcctgcaggccctcgaagactacttgccaattctgctaggattggtaacagaaggtagtacgttgaggcatacagtgcaattcacctggactaaccaagaggataatgctgctgaggagacgaccatggcagatgcctggtacgaggtgctgtctgtgctgcatttgatggccatggtctgcttgcttcaggccaacaccctgcttctccccaggtcatacggcgatggctacgcaccaagagtttccgaagagagcagacgggccactgtcgatgttttcttgaaggcagctggatacttagcctgcgcaattcggcatgtaattccgcagattccacctgaactaaggaggcaacttccagtagacctggttgaaggaaatctcaaagctctaagcctgcaagctctgggtcagggggttgacatgcagcttggtttggctattgatagtccaaaggccactttagcagtaaaacggcgcttagcctgtgaaatggtcaagtattggcaacaagttcaggaaagcattccagatcttcctggctccgatggatgggggaaaaagcaccggctgtttgtcaagtggaaatatgctgaagcaaaggctgcagcatactattttcatggtttgattcttgatgagggaaatacagagaaatcccacggaatggcaatagctgcacttcaagcttcagaagaatttctaaaagaaagcaaaagggtttcagaagccttccatgcaactcctccaacatcgaggagccctactccattcggaacagcaaaatatatgtttgacaagatcccaaaagatgcttcaagcaaggtccgaatcaaccaggacttgtatgctcaagaaaaggtcataggaactccgcctcccttaccggattttgcattggcactaatgccagaagactatgatcttcctccattagatccactttggaacaaagaagacagacgtcagtaggtgtgtatgcaactgaatggattcttcagatggaaagcttggctttggagagaggggagaagaaccaagatctgccatgtcaaagctgaacatggtaacaaatcaagtgtacaaaatatgtttaaacaaaatcctgagtc

SEQ ID NO: 26377 - protein, 416 aa, Panicum virgatum
  misc_feature: Ceres CLONE 1869049
  misc_feature (27)..(413): Pfam Name: BRO1 Pfam Description: BRO1-like domain
MGCGASSQKDAVGGPRRRPGSVGDVVVFLPGLRVPRSVDLAQALGGRLDRSIVERLSALRARVVEMAMQESAAALKPRRKTAAARHGSSTASLLQALEDYLPILLGLVTEGSTLRHTVQFTWTNQEDNAAEETTMADAWYEVLSVLHLMAMVCLLQANTLLLPRSYGDGYAPRVSEESRRATVDVFLKAAGYLACAIRHVIPQIPPELRRQLPVDLVEGNLKALSLQALGQGVDMQLGLAIDSPKATLAVKRRLACEMVKYWQQVQESIPDLPGSDGWGKKHRLFVKWKYAEAKAAAYYFHGLILDEGNTEKSHGMAIAALQASEEFLKESKRVSEAFHATPPTSRSPTPFGTAKYMFDKIPKDASSKVRINQDLYAQEKVIGTPPPLPDFALALMPEDYDLPPLDPLWNKEDRRQ

SEQ ID NO: 26378 - DNA, 673 bp, Panicum virgatum
  misc_feature: Ceres CLONE 1869054
  misc_feature: Encodes the peptide sequence at SEQ ID NO. 26379
atcttccacacctacacacactgcttgctcggagatcatcgatcgacctcatgcacattccttagcactattactagatcgccgcagctacgcgcaccggcggattccgcacgtacgtgtgcgagatcatcatcaaggccggacctgcagaacagcaatgaggaagccggagggtccagcggcggcgaacagctgcaataatgcaggggcggcggcgaagctgcgcaaggggctgtggtcgccggaggaggacgagaagctggtggcgtacatgctgcggagcgggcagggctcgtggagcgacgtggcccggaacgccggcctgcagcgctgcggcaagagctgccgcctccggtggatcaactacctccggccggacctcaagcgcggcgccttctcgccgcaggaggaggagctcatcgtcagcctccacgccatcctcggcaacaggtggtctcagatcgctgcccggctgccggggcgcaccgacaacgagatcaagaacttctggaactccaccatcaagaagcggatcaagaacagctcctcggcctcgtcgccggcggcggccactgactgcgcgtcgccggagcctaataacggcaaggtcgccggcttcgacatcagcggcgccgccagctgcccggacctcgctggcctggatcgtcaggtc

SEQ ID NO: 26379 - protein, 171 aa, Panicum virgatum
  misc_feature: Ceres CLONE 1869054
  misc_feature (77)..(122): Pfam Name: Myb_DNA-binding Pfam Description: Myb-like DNA-binding domain
  misc_feature (24)..(71): Pfam Name: Myb_DNA-binding Pfam Description: Myb-like DNA-binding domain
  misc_feature: Useful for making plants with altered cell wall content and/or composition
  misc_feature: Useful for making plants with altered lignin content
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: Useful for making plants with modulated biomass
  misc_feature: The sequence is a functional homolog of SEQ ID NO 1917 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1004 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1002 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1681 in the 10/374,780 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 794 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 126 in the 10/412,699 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1564 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: Useful for making plants with modulated nitrogen use efficiency
MRKPEGPAAANSCNNAGAAAKLRKGLWSPEEDEKLVAYMLRSGQGSWSDVARNAGLQRCGKSCRLRWINYLRPDLKRGAFSPQEEELIVSLHAILGNRWSQIAARLPGRTDNEIKNFWNSTIKKRIKNSSSASSPAAATDCASPEPNNGKVAGFDISGAASCPDLAGLDRQ

SEQ ID NO: 26380 - DNA, 2220 bp, Panicum virgatum
  misc_feature: Ceres CLONE 1869061
  misc_feature: Encodes the peptide sequence at SEQ ID NO. 26381
ctcctcttttttttccattttcctcctcctttgtgtttttttaaaatcctctgcaaggttgctcgttggggatgtagcaacaaaaggggctttggcagcttcttgcgtctcttgctgggtctctgaacccccggcgagcggcggaataggctccaatggggaagtctccggagaagtggatcaagtccgtgctcttcgggaagaagtcgtcgtcgcggtccacctccaccaattccaaggatttatcgaagggtgcaagcaacaaagggtatgctggtaaggagcccgcattcgctgagagctccccggtgatctcggagccggtgcttgttagcgcccacaacaatgagaccgtgcgggaggtggctaagggtgagaattccaactcgcaaggcgaagttgcagtgcctgatgtcaatcaagatttggagaagcatgtcactgtggggtctgatgcttccaatgatgctgagaggttgagggaagagcatgcggctgtgaaggcacaagctgcgttccgtggttatctggcacgccgagcattccgtgcattgaaagggatcataagacttcaggctttgattcggggtcatcttgtaaggaggcaagctgtttcaactctccgtgcaacatggttgatcgtgaaatttcaagccctgatccgtggaaggaatgccagagtttcacaagctgccattcatgcaagttggaaacttacccaacagaactttgggagtgctaaacctgattcatggaaggagaaattatcttcaaatgcatttgctcgtaagcttctatcttcaccaattgtggttgaagctctccactttcagtatgatgaaatggaccctaattcagccttcaactggttggagagatggaccactagtcatgtctggaagcccatttcccaaccaaagagagttggtgctgatgcgaagccacatgcaaagaaggccagttatgcaatggaaactgagtcagggaaattaaagcgcaatgctaggaagagctctgtgacgccatttgagccttcacaaacaaacatatccatagaaattgagaagacaaaacggaatcccaggaaaccaagtagtgctcctgctgattcagtgcctgatggacagttaaccgaacttgagaaggttaagcgtagccttaggaaggttactaattccatggctgaaacctcaaaggtatctaatccagcacctgagatccctgatcatcaagaggtccaaagtgagagaccactgaaaaatgcaaagcaagtccaggttcattctgagaatcaagagccccagaatgttaaactatcggataatgcaaagatagatatcctggtacctgatctccagcctgatgaggaagttgcttcagatccagtcacaaacgacgaaaaagttgatgaaccaactgttgttgctccaccagctgaaattatgccactgcaagacattaacaatgaagaaaatgctttggtgaatgatacagaacagagatccaaagaagaacctctttctactgaaagccttaaaggcagcaagaggaggtcctcattgtcgactaagtcagaatatcctgaaaatggctccaaaaattctccagctctgcccagctacatggctgcaacacaatcagcaaaggcaaaactacggggacagaattcaccgagactcagctctgattcagcagagaaaaatggcttcactcgccgtcactcccttccatcctctaccaatggtaagatgattgcgcattctccacgtacacaaaggccaacccatgctggtggcaaggatggagcgaaaggtgacaaggctatgctgtcatcaagagatttgagtgagagaccattgaaagctgagtggaggcgctgaagaggcacaccaaactccgaaatcgtccatttgattagcacaactgttttggtggaaggcgtctgcagtttgctcggattgttttgcttgtgatgtaaaaaagatgttctcatcatcccgcgacgatggctttgttgtgctgaaccttctgtgagtcgacttatttatagggttttccgtccagccttttgtgatgtatagctgaagtgtttgcccggtttgttttggtcccgagacatgccccagttcctgcttgtttggagagctgctgatgttagagagaacgagaacctgtatggattgagttgagcaatctaagccccgtttgggcattctgggc

SEQ ID NO: 26381 - protein, 574 aa, Panicum virgatum
  misc_feature: Ceres CLONE 1869061
  misc_feature (111)..(131): Pfam Name: IQ Pfam Description: IQ calmodulin-binding motif
MGKSPEKWIKSVLFGKKSSSRSTSTNSKDLSKGASNKGYAGKEPAFAESSPVISEPVLVSAHNNETVREVAKGENSNSQGEVAVPDVNQDLEKHVTVGSDASNDAERLREEHAAVKAQAAFRGYLARRAFRALKGIIRLQALIRGHLVRRQAVSTLRATWLIVKFQALIRGRNARVSQAAIHASWKLTQQNFGSAKPDSWKEKLSSNAFARKLLSSPIVVEALHFQYDEMDPNSAFNWLERWTTSHVWKPISQPKRVGADAKPHAKKASYAMETESGKLKRNARKSSVTPFEPSQTNISIEIEKTKRNPRKPSSAPADSVPDGQLTELEKVKRSLRKVTNSMAETSKVSNPAPEIPDHQEVQSERPLKNAKQVQVHSENQEPQNVKLSDNAKIDILVPDLQPDEEVASDPVTNDEKVDEPTVVAPPAEIMPLQDINNEENALVNDTEQRSKEEPLSTESLKGSKRRSSLSTKSEYPENGSKNSPALPSYMAATQSAKAKLRGQNSPRLSSDSAEKNGFTRRHSLPSSTNGKMIAHSPRTQRPTHAGGKDGAKGDKAMLSSRDLSERPLKAEWRR

SEQ ID NO: 26382 - DNA, 683 bp, Panicum virgatum
  misc_feature: Ceres CLONE 1869069
  misc_feature: Encodes the peptide sequence at SEQ ID NO. 26383
gtcaccgcgtcccgagagcgcgaatcattccgcgcgccgcaaaaaccctagcccagccactgatctcctctcatggcggccaccaccagccaggcgagcctcctcctccagaagcagctcagagatctcgccaagcacccggtggatgggttctcggctgggctggtcgacgacatcaatgttttcgagtggcaggtcaccatcatcggcccgcctgacaccctatatgatggagggtactttaacgcgataatgagcttcccacaaaattacccaaacagcccgccgtcagtcagatttacctctgaaatgtggcatccaaatgtgtatccagatggcagggtgtgtatttctattcttcatccacctggtgaagatcccaacggctatgagctcgcgagtgagcgttggacacctgtgcacaccgtagggcttcgtatacaatgtctacattgctaacattttctttttccattttcaatttttcttctgcactagtaccatcccattaacttattctgcatcaaagtctttattagctaaatttatttactgatacatcatcaacactactcaaaagttcactgatatgtctgtaaaatcttgaatttagttatgatatgatgcattttgacgagtgaatcatattgaaatattgttatatagtatgatacgtttcccta

SEQ ID NO: 26383 - protein, 128 aa, Panicum virgatum
  misc_feature: Ceres CLONE 1869069
  misc_feature (11)..(127): Pfam Name: UQ_con Pfam Description: Ubiquitin-conjugating enzyme
  misc_feature: SWISSPROT Homolog: EC 6.3.2.19 Ubiquitin--protein ligase
MAATTSQASLLLQKQLRDLAKHPVDGFSAGLVDDINVFEWQVTIIGPPDTLYDGGYFNAIMSFPQNYPNSPPSVRFTSEMWHPNVYPDGRVCISILHPPGEDPNGYELASERWTPVHTVGLRIQCLHC

SEQ ID NO: 26384 - DNA, 2557 bp, Panicum virgatum
  misc_feature: Ceres CLONE 1869073
  misc_feature: Encodes the peptide sequence at SEQ ID NO. 26385
acggcgaagggatgagtgggcatgcagaattgcagtcgcagaccaccccggcccggcctcggcctcgctttctttcccttcccttcgcccttgcctcttgcatgacacgagaaaaagcgtcgccaccaaagccaccactctaatatgccctgccgcctgcctcccctgcccacccagctctcacttttcttcctcctccccgctcgggcgcctctcccccgcccatcattcccgttcccccggcgctcccgatggcctcctccggcggcttggccctcctctccctcctcgccgtcgtcctcctcctcgcctcggcgccgcccctcgccgtcgcctccgagcccctcaaccccgaagtgcaggcgctgatcgccatccggcaggggctggtcgacccgcacggcgtgctcggcaactgggaccaggactccgtcgacccctgcagctgggccatgatcacctgctccgcccagaacctcgtcatcggcctgggagcgccgagccagggcctgtcggggacgctgtccgggaggatcgccaacctcacccatctcgagcaagtgctgctgcagaacaacaacatctccggccggctgccgccggagctgggcgcgctgccgcggctgcagacgctggacctctccaacaaccgcttctccggccgcgtgcccgacacgctcggccgcgtctccaccctccggtacctgaggctgaacaacaacagcttgtcagggccgttccccgcgtctctcgccaaaatcccgcagctctccttcctggacttgtccttcaacaacctcaccggccccgttccggtcttcccgacaaggacgttcaacatcgtgggcaacccgatgatatgcgggagcgccggcgcgggggagtgcgccgccgcgcaggcgccggccgccgtgcccttcccgctggaatccactccgggcggcggcggcggcagcagcagggcggcggcggcggcggggaggtcgtccaaggctggcgcgcggctgccgatcggcgtggggacgagcctgggcgcctcctcccttgtgctcctcgccgtgtcctgcttcctctggcgccggaagcgccggcactcgggggcccgctcctccgtcctcggcatcctcgatcggggcgggcgcgacctggaggacggcggcggcggggtggcgcggctggggaacgtgcgccagttcgggctgcgcgagctgcaggccgccacggacgggttcgcggcgcggcacatcctgggcaagggcgggttcggcaacgtgtaccgcggccggctcgccgacggaacggcggtggccgtgaagcggctcaacgaccccgccagcgcgtccggggaggcgcagttccgcacggaggtggagatgatcagcctcgccgtgcaccgccacctgctccgcctcgtcggcttctgcgccgccggcggcgagcgcctcctcgtctacccctacatgcccaacggcagcgtcgcgtcgcgcctccgagcgaagccggcgctggactgggcggcgcggaagcggatcgcggtgggggcggcgcgggggctgctgtacctgcacgagcagtgcgaccccaagatcatccaccgggacgtcaaggccgccaacgtgctgctggacgagcgccacgaggccgtcgtcggcgacttcgggctcgccaagctgctggaccacggcgactcgcacgtcaccaccgcggtgcggggcaccgtggggcacatcgcgcccgagtacctctccacgggccagtcgtcggagaagacggacgtcttcggcttcggcatcctgctgctcgagctcgtcaccggccagcgcgcgctcgagctcggcaagggctccggcgccgggcacaaccacaagggcggcgtcatgctcgactgggtgaggaaggtgcatcaggagaagatgctggacctgctggtggaccaggacctgggcccgcactacgaccggatcgaggtggcggagatggtgcacgtcgcgctcctctgcacgcagttccagccgtcgcaccggcccaagatgtccgaggtggtccggatgctggagggcgacggcctggccgagaagtgggaggccacgaaccggccggccgccgcgggggcgccgccgtgccaggacgcgctcggctacgaccaccgcaacgactccaacggctctgtcttcttcaacgacttccacgacaacgacagcagcctcagcagcgacgaggcgcggtccatcgacatggtcgaggagatggagctctcagggccgaggtagcatagctgctgccgggaagaaccagctcattattcatagcattaaagttcagactaggatcagagtgcttgaaaaaaaattacaggtagagagtgactgagtgagggttgggtaagatcggttgcgagccagtttggaattaaagttaccactaggtgcttttgagcttagacgaccacagtgagtagtttctgatgggagccgccgtccttttccctggaaaaaagatgtaaagaaaaaggatagcttctcttttgcttcttttcacaggcttctttttcttttcc

SEQ ID NO: 26385 - protein, 672 aa, Panicum virgatum
  misc_feature: Ceres CLONE 1869073
  misc_feature (327)..(601): Pfam Name: Pkinase_Tyr Pfam Description: Protein tyrosine kinase
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Useful for making plants with modulated nitrogen use efficiency
MASSGGLALLSLLAVVLLLASAPPLAVASEPLNPEVQALIAIRQGLVDPHGVLGNWDQDSVDPCSWAMITCSAQNLVIGLGAPSQGLSGTLSGRIANLTHLEQVLLQNNNISGRLPPELGALPRLQTLDLSNNRFSGRVPDTLGRVSTLRYLRLNNNSLSGPFPASLAKIPQLSFLDLSFNNLTGPVPVFPTRTFNIVGNPMICGSAGAGECAAAQAPAAVPFPLESTPGGGGGSSRAAAAAGRSSKAGARLPIGVGTSLGASSLVLLAVSCFLWRRKRRHSGARSSVLGILDRGGRDLEDGGGGVARLGNVRQFGLRELQAATDGFAARHILGKGGFGNVYRGRLADGTAVAVKRLNDPASASGEAQFRTEVEMISLAVHRHLLRLVGFCAAGGERLLVYPYMPNGSVASRLRAKPALDWAARKRIAVGAARGLLYLHEQCDPKIIHRDVKAANVLLDERHEAVVGDFGLAKLLDHGDSHVTTAVRGTVGHIAPEYLSTGQSSEKTDVFGFGILLLELVTGQRALELGKGSGAGHNHKGGVMLDWVRKVHQEKMLDLLVDQDLGPHYDRIEVAEMVHVALLCTQFQPSHRPKMSEVVRMLEGDGLAEKWEATNRPAAAGAPPCQDALGYDHRNDSNGSVFFNDFHDNDSSLSSDEARSIDMVEEMELSGPR

SEQ ID NO: 26386 - DNA, 1572 bp, Panicum virgatum
  misc_feature: Ceres CLONE 1869078
  misc_feature: Encodes the peptide sequence at SEQ ID NO. 26387
accacaccagcgcggcgcggcgcggcgcggcggccaaccagaaggacgaagcgtagcgggcggagccagccagccagccagccaacaaaccaacggacgacggaagaggcgaaggcccgccgcgaagccgagccaatccggccacgctgccctgccccgcgctccgccgctcctctcgggatccgcccgcccgcccggcgtgatctcgccgcctcgcccgcggttggggctccggccgcacgcccccatgtgtcccggagcggatcgccgcgcgtagaggcccggatcgccgcgcgtagaggcccgggtggggagagggagtttagtgttggggcaggccaggcagggaagcgtcgccttgccgtgtcccgcggcgagatggacgcgagtgccggctccttcgtcgccgtccgccggctctccggctccgaccgcgccgccgccttccaccactcctcctcggcggaggtggtgacggggtcgtcggcgtggatcgggagggggctctcctgcgtctgcgcgcagaggagggacagcgatgcgcgcctctccttcgatttgacgcctacgcaggaagaatgcctacagaggctacagaatagaatagaagttcagtatgatagtgcaaacagagagcatcaggaagcattacgggctctttggtgtgctgcttttcctggaactgagcttcggggtctaatatcagaacaatggaaagagatgggttggcaagggaaagacccatctacagattttagaggcggaggcttcatctccttggagaatctgttgtactttgcaaggaactatccgaaatcttttcaggaacttcttcgcaagcagaatggtgaccgtgcaatctgggagtatccatttgctgtagctggtgtaaatataaccttcatgctcattcagatgcttgatctccaagcagttaaaccaaggtcattgtttggagcagttttcctaaagcttctttcagaaaatgatcaagcatttgacattctctactgcataaccttcaagctgatggatcagcaatggcttgacatgcatgctacttacatggacttcaatatggtcatgaaatcaacacggcgtcagctagaaagggagcttttgatcgaggatattcagcggattgaggacatgccctcatacaggcttctagcccggtagctagaagaaactgaaaatcttaacatggctacacgttgcaagccttgagttgctgatggattgcaactggcacccacagcctgagagaatcctggaatgtagatgcatctgtatccctgtgtttagatactctggtaacctgatctctgaaatttacaaggtagggtttttcttggtgatagaatgccgcttagggtaactgaagtgtctgatcagctgccaaggcaaagtatttgtagggtgtgttattgcaatcgggctgttgcccatcataccacgtaaagggagtgttccagttcctagagtttgcgatgtaaacaggaggattttgggaaagctgatctgagttgtctcccattcgcataaagaaagaggctagttctttgagtgcgc

SEQ ID NO: 26387 - protein, 266 aa, Panicum virgatum
  misc_feature: Ceres CLONE 1869078
  misc_feature (85)..(246): Pfam Name: ELMO_CED12 Pfam Description: ELMO/CED-12 family
MDASAGSFVAVRRLSGSDRAAAFHHSSSAEVVTGSSAWIGRGLSCVCAQRRDSDARLSFDLTPTQEECLQRLQNRIEVQYDSANREHQEALRALWCAAFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDQAFDILYCITFKLMDQQWLDMHATYMDFNMVMKSTRRQLERELLIEDIQRIEDMPSYRLLAR

SEQ ID NO: 26388 - DNA, 1807 bp, Panicum virgatum
  misc_feature: Ceres CLONE 1869080
  misc_feature: Encodes the peptide sequence at SEQ ID NO. 26389
gacgatgctaggctggcgcgcgcctgctgctacctccaattcatcaattcaccgctcgtagctagccgccaccgctgatcgccatggatttcggccgccgcaagagcttcagcttcttcgaggaggaccgcaagtcgtcgtcgcgcccgggcgcccacacccccgtgcaccagtactacgcgcgcgccgcggccggcggccgctcgccggcgcgcgagccggcgcgcctcagcatgtcgtccgtgcccggggtcgaggtgccgcccatcggcgccggcgccggcgggtgctcgccgtgggtgcagtccccgctgcacggccgcctccgcttcccgccctcgccggccgccatctaccactgcctcgccgcgctgcaccgcctggagggcgacgtgcacgcgctggccgtcgcccggggcgtcctcttcacggcctccgacagcggccgggtccgcgcctgggcggcgcccggctgcttcaaccgcggctacctcgacgtcggccgcggccgcgtcccggcgctcgccgcctgcggggccacgctcgtcacctcccacagccgcgaccaccacgtccgggtctggaccgtctgcgccgccgccgtctgcgaccacatccgcgccaggaaggccgccacgctccccgccggcaggggcagcaccctctcgctcctctccgccgccttgggcggcaagctcaagcgcccgcaccagcaccgcgacaccgtctcctgcctcgtcctccacgccgtcgccggcctcctctacaccgcctcccacgaccacaccgtcaaggcctggaagctctccgacggcacctgcgtcgactccttcgtcgcgcacgacgggcccatccacgccatggtcgtcagcgaggccgacggctgcgtcttcaccgcctccgccgacgccaccgtcaagatgtggcgccgcgtctacggcggcaccgcgcacgcgctcatcatcgtgctccgctcctccgagctgtccccggtcaacgcgctcgcgctctgccacgccgcctccgccggcggcacgcgcaggtgcttcctctacgccggctcctccgacggctacgtcaacgtgtgggagaaggaggccacggcggggcggccggcgcacgcggggtacctcaagggccaccgccttgccgtcctctgcctggcgtccggctgcggcggccgggtggtggtcagtgggtcggaggacgccacgatgcgcgtgtggaggcgggagggcggcaagggcggcggcggcgcggcgcacacgtgccttgccgtgattgagggccaccggggccccgtgcggtgcctggccgtgggcggcggcgaggccggggaggtggagggcggcatggtggtgtacagcgcggggctggacaagagcgtcaaggtgtggaggatacgggtggtggggaaggaggaggaggacgacgacgaggacgaggacggagaggaggacgccgagataatggcggcgggaaggccgacgacgaggccatccccgtgatgagggacgaggtggacttggaggacaacgaggagccggagctggtgggcgcgacgccggtgctgtcgccggtgtgggtggagaagcggcggcacaccagccggggttgacgacgacgacgtaggatgtgcagtcagtagttgcgccgccatctacgacgacgcactagctagctagggctactgcatggtcagtcgtccgatccgatccgaagctgcatcgatcgtctgccatttcggggctgatctgataacgtggccgcagagcaggtattaaattattattattattgagtacct

SEQ ID NO: 26389 - protein, 474 aa, Panicum virgatum
  misc_feature: Ceres CLONE 1869080
  misc_feature (394)..(439): Pfam Name: WD40 Pfam Description: WD domain, G-beta repeat
  misc_feature (244)..(282): Pfam Name: WD40 Pfam Description: WD domain, G-beta repeat
  misc_feature (202)..(240): Pfam Name: WD40 Pfam Description: WD domain, G-beta repeat
  misc_feature (344)..(382): Pfam Name: WD40 Pfam Description: WD domain, G-beta repeat
  misc_feature: SWISSPROT Homolog: EC 2.7.11.7 [Myosin heavy-chain] kinase
MDFGRRKSFSFFEEDRKSSSRPGAHTPVHQYYARAAAGGRSPAREPARLSMSSVPGVEVPPIGAGAGGCSPWVQSPLHGRLRFPPSPAAIYHCLAALHRLEGDVHALAVARGVLFTASDSGRVRAWAAPGCFNRGYLDVGRGRVPALAACGATLVTSHSRDHHVRVWTVCAAAVCDHIRARKAATLPAGRGSTLSLLSAALGGKLKRPHQHRDTVSCLVLHAVAGLLYTASHDHTVKAWKLSDGTCVDSFVAHDGPIHAMVVSEADGCVFTASADATVKMWRRVYGGTAHALIIVLRSSELSPVNALALCHAASAGGTRRCFLYAGSSDGYVNVWEKEATAGRPAHAGYLKGHRLAVLCLASGCGGRVVVSGSEDATMRVWRREGGKGGGGAAHTCLAVIEGHRGPVRCLAVGGGEAGEVEGGMVVYSAGLDKSVKVWRIRVVGKEEEDDDEDEDGEEDAEIMAAGRPTTRPSP

SEQ ID NO: 26390 - DNA, 707 bp, Panicum virgatum
  misc_feature: Ceres CLONE 1869093
  misc_feature: Encodes the peptide sequence at SEQ ID NO. 26391
acacgcacagacacactcctctcccacactctgccgcacctcttcttcttctctgttctctctctctctagaagaggaacaagcagctgaggtgagccgaagccgagcgcagctgccccatctctatccctccctccctggaggtctctcgcgtgctcacagggacaggggcgttcctcggccgggcgagcttcggtagcggcggaccatgaaggcgctggtggtggcggtgctgcttctgctctcctccaccctcgccgcgtcacaatggtgcgtgtgcaggcaggatgcgccgcaggccgcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccactctcaccaccagcgacccaagttcttctggctgctctttcccaacaagtgcaaggtacattgtgaacttcacttaaattaactgtataccatgatccatgaagttacttactactgccactaaggacttgttgagtatttcataccggagtaaatatttcgaaattgtgcattttgggaactggtaccccatgaaacctatgcatcatcttgaatcagatcttttgt

SEQ ID NO: 26391 - protein, 115 aa, Panicum virgatum
  misc_feature: Ceres CLONE 1869093
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
  misc_feature: Useful for making plants with altered cell wall content and/or composition
MKALVVAVLLLLSSTLAASQWCVCRQDAPQAALQKTIDYACGAGADCNSIHENGPCYNPNNVPAHCSWAANSYYQNNKAKGATCDFTGTATLTTSDPSSSGCSFPTSARYIVNFT

SEQ ID NO: 26392 - DNA, 1423 bp, Panicum virgatum
  misc_feature: Ceres CLONE 1869109
  misc_feature: Encodes the peptide sequence at SEQ ID NO. 26393
agcactgcctctgcctgccttgctcttgctggcacatcacgttggcgagcaggcgaatcaatcgccggtaaccccgttccgcctcccctccgacgtggtcctccccgagggggcgaacgaggatgttctggcacggggtcgcggaccggctgacggggaagaacaaggaggcgtggaacgaggggaagatccgcggcacggtggtgctggtcaagggcaccgtcgtcttcgtcgccaactcgtgggtctacccgcaccacctctacgcccaggaccgcatcttcttcgccaacgacacctatctgccaagcaaaatgcctgcagcattggtgccttatcggcaagatgaactcaagattctccgaggtgatgataatgctggaccatacaaggagcatgaccgtgtctaccgttatgaccactacaatgaccttggtgagccggacaaaggtgaagaccatgtacggccgatccttggtggcagccaagaacatccatatccccgtcgctgcagaactggcagggaccgagcgaaaacagacccaaattcagagagcaggctttttctgctcaacctgaacatctatgtcccgcgtgatgaacgctttggacatctcaagttctcagacttccttgggtactcactgaaggcagtcattgaggctgttcttccaacaatagggactttcattgatgatacgccgaaggagtttgattcattcgaagacatcctaggactctatgaacttggtccagaagcacccaaccatccagtagtagcagagatcaggaagaaaatccccagtcagttccttagaagtattctgccaaatggtagtcatgaccaccccctaaagatgccacttccaaatatcatcaaatcagatgtattgaaacaggctccagagtttaagtttggatggaggactgatgaggagtttgcaagagaaacacttgcaggcgtgaacccagtaatcatcaaacgccttacggagttccctgctaaaagtgccctggatccaagtcagtatggtgaccataccagcaagatcactgaagctcacattcagcataacctggaaggcttgacagtgcagaatgcactgaagaacaacaagctcttcatcctggaccaccatgatcatttcatgccgtaccttgaccgcatcaacaggttggagagcaacttcatctatgccagcaggacccttctgttcttgaaggacgatggcaccctgaagcccgtggccatcgagctgagcctgccccaccctgatggtcagcagcacggcgccgtcaacaaggtgtacaccccagctcacaccggcgttgagggccacatttggcagcttgcaaaggcttacgccaccgtcaatgactctgcctggcatcagttgatcagccactggctgaatacgcacgc

SEQ ID NO: 26393 - protein, 433 aa, Panicum virgatum
  misc_feature: Ceres CLONE 1869109
  misc_feature (66)..(433): Pfam Name: Lipoxygenase Pfam Description: Lipoxygenase
  misc_feature: SWISSPROT Homolog: EC 1.13.11.12 Lipoxygenase
  misc_feature: Useful for making plants with altered lignin content
MFWHGVADRLTGKNKEAWNEGKIRGTVVLVKGTVVFVANSWVYPHHLYAQDRIFFANDTYLPSKMPAALVPYRQDELKILRGDDNAGPYKEHDRVYRYDHYNDLGEPDKGEDHVRPILGGSQEHPYPRRCRTGRDRAKTDPNSESRLFLLNLNIYVPRDERFGHLKFSDFLGYSLKAVIEAVLPTIGTFIDDTPKEFDSFEDILGLYELGPEAPNHPVVAEIRKKIPSQFLRSILPNGSHDHPLKMPLPNIIKSDVLKQAPEFKFGWRTDEEFARETLAGVNPVIIKRLTEFPAKSALDPSQYGDHTSKITEAHIQHNLEGLTVQNALKNNKLFILDHHDHFMPYLDRINRLESNFIYASRTLLFLKDDGTLKPVAIELSLPHPDGQQHGAVNKVYTPAHTGVEGHIWQLAKAYATVNDSAWHQLISHWLNTH

SEQ ID NO: 26394 - DNA, 732 bp, Panicum virgatum
  misc_feature: Ceres CLONE 1869109-R
  misc_feature: Encodes the peptide sequence at SEQ ID NO. 26395
caggacctgcacgaccatcatctgggtggcgtcggcgctgcacgcggccgtcaacttcgggcagtacccgtacgccgggtacctcccaaaccggccgacggtgagccggcggccgatgccggagccgggcagcaaggagtatgcgcagctggaagcggggcaggaggaggccgacaaggtgtacatccgcactatcaccagccagttccagagcatcctgggcatctcgctcatcgaggtcctctccaagcactcctccgacgaggtgtacctcggccagcgcgacgagccggagcgctggacgtcggacgccaaggcgctggacgcgttcaagaggttcggctcccggctggtggagatcgagaagcggatcaagtcgatgaacgacaacccggcgttcaagaaccggaaggggcctgtggacatgccctacatgctgctgtaccccaacacgtcagacgtcgacggcacgaagggcgagggtctcacggccatgggcatccccaacagtatctccatctgagactgagcagatgcgtctcaactcttgtgggatggtaggttgatgctgtgccgccgctacacgtttggccgtttgggcattgtgcgtagtgtgtttcttcgttggttttgtgagggtgtagtggtctagtgaagattgtaacaatgatttgttgggttggggcgttgggcagaggagctgcagtgaggaatcagggcttgtttgtttcc

SEQ ID NO: 26395 - protein, 173 aa, Panicum virgatum
  misc_feature: Ceres CLONE 1869109-R
  misc_feature: SWISSPROT Homolog: EC 1.13.11.12 Lipoxygenase
  misc_feature: Useful for making plants with altered lignin content
RTCTTIIWVASALHAAVNFGQYPYAGYLPNRPTVSRRPMPEPGSKEYAQLEAGQEEADKVYIRTITSQFQSILGISLIEVLSKHSSDEVYLGQRDEPERWTSDAKALDAFKRFGSRLVEIEKRIKSMNDNPAFKNRKGPVDMPYMLLYPNTSDVDGTKGEGLTAMGIPNSISI

SEQ ID NO: 26396 - DNA, 1476 bp, Panicum virgatum
  misc_feature: Ceres CLONE 1869110
  misc_feature: Encodes the peptide sequence at SEQ ID NO. 26397
gtatccctccctctctctgcctcgccgtcgccgaggccggcgcctcctcgccggctagggttcccgcgacaccagcgcttgcatcctcgggaggtgcgtgctctccgccgacccgaaccttccgccttcgctgatcgctctcgttcgttcatacctaccgcccgcccgccccctcgattcttctcttagcattcactgggggccggcgggttggttttttagttgtcgcgtgttgttattggcttgatttgccgcgtgatcatcgttttcctgttcatttgcgtcatacaaacggtcgtggcagggggcgcgtgttggaattcgagatctttttttttggcttgatttgtgtgcaaaatgctgcttttttttttcttttccatgtttcgttgtctgtcaagaccatgttagggcggagggaaaattctgccttgtaggaggcctaggtgtgagaggggttacgcaaattagggctttaattgcaccgtttcattggctcggaattagtaactttagcagtgtaaaataaggatttctctctttatcttagggttctgtgaaatccgtagagagctgattatggtttcagtagttctaggcttctacttcacagcacatgtagtctctctattgtttccagaatcatttgaactcagatagctgattagttgctgtgttgtacgagattgtttttgtgtgtccgtccgatcatctaattgacagcttttggcttgatttgttgggggtctttatgctgcattttcttttcttttttcctttctcatgatcatgctaggacggacggatcacagcttacaattttgtggtcttgttgttgcggggatcatctgcaatgacaagagttcaagagttttctggtgctatgtctgtgtgagaaaatttttgtctttgaattacctgttgctgggatgcttcacacaatatttgtaacttattttgtgacatccctagcatgtatctaactgctaactttagtacagctaaaatggcatgcagtaaataaattttttcaagaagcaattactcctctgcattgtgtatgaatcttccataggagtagcatgattagggggacgtaggctaactaattgaggtcacttccatcaggtccatgcatgttcatttgttatcagtcagacaaaatgttctatgtagttattatatcctgacattttctcctcatgctgagcaaaatgcatcgatacgatgaccgctatgattataatgatcggtacgaccactatggtcgacatggtggtaacaccaagttgtacgtgggtcagatttctccagatactcagatacatgatcttgaggaccttttcagcaaatatgggagactgcggaaagtggatctgaagagggactttggctttgttgagtttagtgatccgcgggatgctgatgacgcaaggtatgatcttgatggccgaaaatttgatgggagtcgcatcg

SEQ ID NO: 26397 - protein, 87 aa, Panicum virgatum
  misc_feature: Ceres CLONE 1869110
  misc_feature (26)..(87): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
MHRYDDRYDYNDRYDHYGRHGGNTKLYVGQISPDTQIHDLEDLFSKYGRLRKVDLKRDFGFVEFSDPRDADDARYDLDGRKFDGSRI

SEQ ID NO: 26398 - DNA, 572 bp, Panicum virgatum
  misc_feature: Ceres CLONE 1869110-R
ctagaaagaaactgccagaacagtccaaaggatctgaagcgagaaagacgctacccaaggtctccatctcctcaccatggaaagggccgagggagaagcagaagctactcaaggtctccgtctcctcgtcatgcaaggggccgaagctggacttacagtaggtcgccaccgccaaggagggattactgtaacgctcgtggtgaagagttggcgtcaagaagtgcccattacagccccaaccccaggaggaacctcccaccaagggaacaagctgaacgcaatggctcatatcttggtgggagccccagtaggggtgaagctcgtgagaagcgccagtgacccggaacttgagactgtggggttgtgaattctcaaactctctccaacttcgatgactatgacaaggcattgtctgaagaatcgtagcttttgtgaagattggattgtgaattctcacagaagctcgcctgaatgctgctagttttgccgaggcgtcatatctgaaggatcttgaccggatatggttctctgttaagaatattgcctgcaattaattacgtttctgtgacctc

SEQ ID NO: 26399 - DNA, 727 bp, Panicum virgatum
  misc_feature: Ceres CLONE 1869111
  misc_feature: Encodes the peptide sequence at SEQ ID NO. 26400
atcgctcgagccaggaacaacgcggagcagaggaagcgaggcggcggcgatgtcggcggggctggtgaccgacgaggcgaccatgggccggctctaccggatccggcggacggtgatgcagatgctgcgcgaccgcgggtacctggtgggcgagcacgagctcgccaccagccgccgcgacttcctccgcaagttcggcgagtccttccaccgcgaggacctcctcatcaacaagtacaagaaggacgacccctccgaccagatatatgttttcttccccaacgatgataaagtggggatgaagcacatcaagaagtacgttgaaatgatgacacatgagaacgtctccagagctgtgttggttcttcagcagaatctaactccatttgccaagtcatttctcatagaattagagccaaagatccacttggaaattttccaggaggccgagttgcttataaatatcaaggagcatgttcttgttcctgagcatcaggtgctcacaaatgaggagaagaagacattattggagcggtacaccttaaaggaaactcaggtattgctaattattcacacttgcaagtttagcttttggggccagtggatccaatcatatatctataatcattttaagtagtcccttttgatcaaccatctttcataattttacttccacacttctagtttgtgccttaatcatttatagttatagtacaaatttcctaaa

SEQ ID NO: 26400 - protein, 195 aa, Panicum virgatum
  misc_feature: Ceres CLONE 1869111
  misc_feature (6)..(95): Pfam Name: RNA_pol_Rpb5_N Pfam Description: RNA polymerase Rpb5, N-terminal domain
  misc_feature: SWISSPROT Homolog: EC 2.7.7.6 DNA-directed RNA polymerase
  misc_feature: Useful for making plants with modulated drought sensitivity
  misc_feature: Useful for making plants with modulated water use efficiency
MSAGLVTDEATMGRLYRIRRTVMQMLRDRGYLVGEHELATSRRDFLRKFGESFHREDLLINKYKKDDPSDQIYVFFPNDDKVGMKHIKKYVEMMTHENVSRAVLVLQQNLTPFAKSFLIELEPKIHLEIFQEAELLINIKEHVLVPEHQVLTNEEKKTLLERYTLKETQVLLIIHTCKFSFWGQWIQSYIYNHFK

SEQ ID NO: 26401 - DNA, 292 bp, Panicum virgatum
  misc_feature: Ceres CLONE 1869112
  misc_feature: Encodes the peptide sequence at SEQ ID NO. 26402
gagcgagcggtgaaggagctgttgggcggcggcgaggaggggaggaaggcgagggagaaggccatggagatgaaggccgcgtgcaggaacgccgtggaggagggtggctcgtccgacgcggcgctgcaccggctagcagagcagctttacaaaggcgtagtggtcaccacgagtaagtgacgacgagacgagaggcagctcctcctatgtcgcatcgcatgtaatgtgttcgtcgatgctccgatttaggaggtattgttgctatttttcaaataaaaggttattgcctctc

SEQ ID NO: 26402 - protein, 59 aa, Panicum virgatum
  misc_feature: Ceres CLONE 1869112
  misc_feature: Useful for making plants with altered carbohydrate content
ERAVKELLGGGEEGRKAREKAMEMKAACRNAVEEGGSSDAALHRLAEQLYKGVVVTTSK

SEQ ID NO: 26403 - DNA, 676 bp, Panicum virgatum
  misc_feature: Ceres CLONE 1869131
  misc_feature: Encodes the peptide sequence at SEQ ID NO. 26404
gggagcctcggaagggcatagtattgtatactaccactatataaccagccgccgccgcggtcgtcgtcgtcggccagtcctccccccccccccccccccgcctcgccgcgccgcgcctccgtcgccgggagtagggagggagaagggccgggagattgatcggggaggggcgcgggggctcggcgggcgggtggtggtatgggggaagggggggggggggtgcgcgcgagctttgcgggggggcggaagcgggcgggggaatgggggggggggcagctccgggggctggtggggatgattgaagaacgggagggcgaaattaccgccgcgctccacgaagaactcgccaagccgcacatggagtcctacctccacgaaatatcgctcgcgaaatcctcgtgcaagttcgcgctcaacggggtcaaaaactggatgaaacccgagaagggacctgcgggcataactacgtttccgtcctctgcgcaaatcgtggctgaacccctcggtgtggtgctcgtcatctccccctggaactacccatttctggtctctattgatccggtaattggaacaataactgctggaaatgctgttgttctgaaaccatcaaaaataacgcccgccacctcgttcctgttcgcaaagctgctggctgagtatgttgacagcacatgta

SEQ ID NO: 26404 - protein, 159 aa, Panicum virgatum
  misc_feature: Ceres CLONE 1869131
  misc_feature: SWISSPROT Homolog: EC 1.2.1.3 Aldehyde dehydrogenase (NAD(+))
MGEGGGGVRASFAGGRKRAGEWGGGQLRGLVGMIEEREGEITAALHEELAKPHMESYLHEISLAKSSCKFALNGVKNWMKPEKGPAGITTFPSSAQIVAEPLGVVLVISPWNYPFLVSIDPVIGTITAGNAVVLKPSKITPATSFLFAKLLAEYVDSTC

SEQ ID NO: 26405 - DNA, 689 bp, Panicum virgatum
  misc_feature: Ceres CLONE 1869145-R
  misc_feature: Encodes the peptide sequence at SEQ ID NO. 26406
gcggcggagatggcgcagacgctgcgcgactgcgaggcgcccgcggccaagggcgagaagaaggcctgcgccacgtcgctggagtccatggtcgacttcgccacggccggccttgggaccagccacgtgagggccgtctccaccgtcgtggcgaggccggactcaccgaagcaggagtacaccatcaccggcgttaagcgcgcgggcgcgggcgccgacgacggcggccggctcgtcgcctgccacgcggagccgtacgcgtacgccgtgttcgcgtgccaccagacgcggcggacgcgggcgtactcggtgtcgatgctcggcagggacggcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttgggtggccgccgccgttgtatgttcttgctgcgctgatggttttcatctacgttctagtagcctctaagcatgctgtcgtatggtatcatgatgcgtttgcttatgttttcagtattgtatggatggtgttgccagccagtatcgatcacctgctaggatctgttgtacatttctgaataaacggacatctctttggc

SEQ ID NO: 26406 - protein, 161 aa, Panicum virgatum
  misc_feature: Ceres CLONE 1869145-R
  misc_feature (1)..(160): Pfam Name: BURP Pfam Description: BURP domain
AAEMAQTLRDCEAPAAKGEKKACATSLESMVDFATAGLGTSHVRAVSTVVARPDSPKQEYTITGVKRAGAGADDGGRLVACHAEPYAYAVFACHQTRRTRAYSVSMLGRDGTAVDAVAVCHADTSGWNPKHVAFQVLNVKPGTVPVCHFLPQDHVVWTRSG

SEQ ID NO: 26407 - DNA, 1295 bp, Panicum virgatum
  misc_feature: Ceres CLONE 1869145
agcaaggccatctcgtctgcatcgccctcctttacaccgggatcatctcagcttgctcattggccatcttcgtcgtccatggacaggctcctcgccggcttgcttggcttcctattggtcagtccctcactaccacgcagctcactcgtcttctctgcatcttctcccatcatctagttccttcagactttagctgctagtgatccctgtggcatacgctgttcatttggcgaaacatttatgtgaatctggaaaacattcagaagaggttcaggcgttcagctagcttacaccatgcctgatcagacttcaaaccatgcaaagaggttgtatgcttgtagtaggagcttttgctgctgttgtatcgatgctttttcaggcgatgcttacattcttatcacccttaatgatgtaacttataaaaggttgaagttctctgacgcatctctttcaaaacaaaaaagagaaagttctctgatgcatagggagattgttgtggtctgctgcatgcagcttgcgtcagtaggaagccatgcagctcgagctccggatcagtactggaagtctgctctccccgacacgcccatgccaagctccctctcccaactcctaaacaccccagccggcggcacgaccgtgaacgtcggctggggcggtgtccatgtcgacgccgggcatggcaagcccgggggcacgaccgttgatgtaggcaagggcggcgtcggtgtcaacgtcaaccctggcagcggcaagcccggcggcaccaccgtcggtgttgggaaaggtggagtcggcgttaacgtcaagcctggttatggcaagcccggcggcaccaccgtcggcgtcggcaagggcggggtcggcgtcaacgtcaaaccagggagcggcgggaagcccggcggcaccacggtcggcgtcgggaagggaggtgttggcgtcaacgtcaatcctggcaagccgggtggcaccaccgtcggcgtcggcaaaggtggcgtcggcgtcggcgtcaatcccggatacggcaagcccggcggcaccacggtgggcgtcgggaagggtggggttggcgtcaacgtgaagccccgcgggaagcccgtccacgtcaacgtctctcctttcctatacaactacgccgcgacggagacgcagctgcacgacgaccccagcgtcgcgctcttcttccaggagaaggagctccgccccggcaagaagatgaccgtccagttcaccaacaccgtgcccggtaccaagttcctcccccggagcgaggccgatgccatcccgttctcctccga

SEQ ID NO: 26408 - DNA, 631 bp, Panicum virgatum
  misc_feature: Ceres CLONE 1869154
  misc_feature: Encodes the peptide sequence at SEQ ID NO. 26409
accgatacctcactcccctcctcccggcgccgccgctgctgctcgccatggacgccggcggcctcgcggcggggtcgcacatgcggggcgagctgcacgtcgtgcgcggccgcgacgcggagccgggcgccgcccggagcgccgcggcggacgtgaggacgtgccgcgtgtgcggggacgaggtcggggcgcgggaggacggacagcccttcgtggcgtgcgccgagtgcggcttccccgtgtgccggccctgctacgagtacgagcgcagcgacggcacgcagcgctgcccgcagtgcaacacccgctacaagcgccacaaagggtgcccgagggtggaaggggacgaagacgacggcccggagatggacgacctggaggaggagttccccgccgccaagagcccgagtaagaagccccacgagcccgtcgccttcgacgtctactcggagaacggggagcacccgccgcagcggtggcggacgggaggccagacgctctcctccttcaccggaagcgtggccgggaaggacctggaggccgagagggagatggaggggagcatggagtggaaggaccgcatcgacaagtggaagaccaagcaggagaagaggggcaacaagctcaaccc

SEQ ID NO: 26409 - protein, 194 aa, Panicum virgatum
  misc_feature: Ceres CLONE 1869154
  misc_feature: SWISSPROT Homolog: EC 2.4.1.12 Cellulose synthase (UDP-forming)
  misc_feature: Useful for making plants with altered cell wall content and/or composition
  misc_feature: Useful for making plants with modulated biomass
MDAGGLAAGSHMRGELHVVRGRDAEPGAARSAAADVRTCRVCGDEVGAREDGQPFVACAECGFPVCRPCYEYERSDGTQRCPQCNTRYKRHKGCPRVEGDEDDGPEMDDLEEEFPAAKSPSKKPHEPVAFDVYSENGEHPPQRWRTGGQTLSSFTGSVAGKDLEAEREMEGSMEWKDRIDKWKTKQEKRGNKLN

SEQ ID NO: 26410 - DNA, 747 bp, Panicum virgatum
  misc_feature: Ceres CLONE 1869161
  misc_feature: Encodes the peptide sequence at SEQ ID NO. 26411
gtgtacaatgccagctccaatcatatcgagcacccatcgctcttcaattttgatggtacacgcccgtgtcctgcatcccgcccgaccgatgatgatggagctaccagcaccgtcgccgacgacatccttcctcgccgtcgtgctcgccgccgctctcttcctcgcgtccatcctccgcctccgcgggcgcgccgcgcgcaagtacaacctcccgccgggcccccggccgtggccggtgatcggcaacctggacctgctcggcccgctcccgcaccactccgcccgcgacctctccgcgcggcacggcccgctcatgtcgctccggctcggctccttccccgccgtcgtcgcctcgtcgcccgacatggccaggttcttcctcaagacccgcgacctggcgttcgtggaccgcccccggacggccgccggcaagtacatctcctacaactactccggcctcttctcctcgccctacggcgcgtactggcgtcaggggcggaagctctggcaggccgagctcttcaacgcgaggcggctcgcgtcgctcgagcacgtccgcggcgaggaggtgagctccatgctcagcgacctgcgcgccgctgctgcggcggcggcggccggcggcgggcgcgcggaggcggtggcgctcagggagcacctgttcatggtgaacctcaacgtcatctcgcgcatggtgctgggcaggaagtacatcgtcgatggggctggctcgccgttcacgcctga

SEQ ID NO: 26411 - protein, 217 aa, Panicum virgatum
  misc_feature: Ceres CLONE 1869161
  misc_feature: SWISSPROT Homolog: EC 1.14.13.21 Flavonoid 3'-monooxygenase
  misc_feature: Useful for making plants with altered carbohydrate content
MELPAPSPTTSFLAVVLAAALFLASILRLRGRAARKYNLPPGPRPWPVIGNLDLLGPLPHHSARDLSARHGPLMSLRLGSFPAVVASSPDMARFFLKTRDLAFVDRPRTAAGKYISYNYSGLFSSPYGAYWRQGRKLWQAELFNARRLASLEHVRGEEVSSMLSDLRAAAAAAAAGGGRAEAVALREHLFMVNLNVISRMVLGRKYIVDGAGSPFTP

SEQ ID NO: 26412 - DNA, 733 bp, Panicum virgatum
  misc_feature: Ceres CLONE 1869162
  misc_feature: Encodes the peptide sequence at SEQ ID NO. 26413
atcactgtgcaggtcacccggagcgggtacaggcagaaactctcaatatatgatcttctggccggcgacattgtccacctctccattggtgatcaggtgccggctgacggtctgttcttgtcaggcttctcgcttctgatcaacgagtcaagcttgactggagagagcgagccagttgctgttaatgctgagaacccgttccttctgtctggaaccaaggtgcaggacggttcttgcaagatgcttgtcacgacagtcggcatgaggactcagtgggggaagctgatggccactctcagcgaaggtggtgatgacgagacgccattgcaggtcaagctgaatggcgtagccaccatcattggtaagataggcctcatctttgcagtcatcacatttgcagtgctgaccgaaagcctgttccggcgcaagatcagcgatggcacatacttgagctggactggagatgatgcattggagctgcttgagttctttgccattgctgtaacaattgtggtcgtggcagtccctgaagggttgccgcttgccgtgacactgagccttgcatttgcaatgaagaagatgatgaacgacaaggcactcgttcggcaccttgcagcctgtgagaccatgggctcggcgacctccatctgcagcgacaagaccggcacactcacgacaaaccacatgactgtcgtcaaggcctgcatctgcagcaagattaaagatgtggatg

SEQ ID NO: 26413 - protein, 244 aa, Panicum virgatum
  misc_feature: Ceres CLONE 1869162
  misc_feature (2)..(209): Pfam Name: E1-E2_ATPase Pfam Description: E1-E2 ATPase
  misc_feature: SWISSPROT Homolog: EC 3.6.3.8 Calcium-transporting ATPase
ITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVITFAVLTESLFRRKISDGTYLSWTGDDALELLEFFAIAVTIVVVAVPEGLPLAVTLSLAFAMKKMMNDKALVRHLAACETMGSATSICSDKTGTLTTNHMTVVKACICSKIKDVD

SEQ ID NO: 26414 - DNA, 1295 bp, Panicum virgatum
  misc_feature: Ceres CLONE 1869164
  misc_feature: Encodes the peptide sequence at SEQ ID NO. 26415
gcccggcgcgcggtggcgacaccgctacgtccacgcggcttaccgcttcctccctggctgcccctgcgcagcgcagctgcccacggcaccagtgcaccacgcacacccgcgcaccaggattgcggcgctgcgctcgcgaatccgcgaacaatcacaacagccaccgcaacgccacccgcccgcaccatccttctctcttccgctcatcgtctccaccctcttgtgggggcaaagccgcgaggggataggcagataggcacaggtagacaggacaaagatcggaattagtcacgcacccaggagagccaggggggacggagagagagccaagagagggaggaggaaaccttcttcttcctcgccgcctcctcttttcctggtcgcgtcttctttgttcttgaatccgccggcgagttcttgcgtccgggcgtggcaatctgcatctttttttttctctccatcctgtccgaacccgtgtaaccgaagaactcaatcaaatcgaattggaaaagaacgtaaattttaatctgctaggtaggggtgggggcaagggcgggcggtcttgacaggaggtaaggcggcccggccgattgatcggcgatggcgccgccgtccagggactactggctcggcttcttccgcggcgcgggcgacaacatcttcgacgccatcgacgcggccatcactgtcgccgcgtccgaccacccgggcgccctccgcgagcgccgcgacggcatcgccgagcgcctcttcaccgcgctcctggtgaccggcgccacggcggcgcccgggccggcggcggtcgctggggcggcggcggggacccccgtggcgggggcgcccacgccggcgcagctccaccacgagggcgccgccagcgtacccagcctctgcagctccgaccgcgccgaggccatcaccgacgatggcgcgccgcgctgcgacgatcccgtcctcgctgagaccgagcgcatcaaggccatcctcctcaacgaccaagaaaagtcggaggccgagttgttggagctgctccggcggctgcaggagttggacttagcgttcgacacgttggatgttactgcgattggcaaggctgtggccaacttccgtaagcacagctccaagcagattcggaacctcgtcagatcgctcattgaaagttggaagcgtacagttgatgtgtggattgctcgccgccgagaggctgttgtagatcacacacctcagtccatgggtccttccagcttggagcaggaggaacgaggggtgaactccaccccgatggatgaaggtga

SEQ ID NO: 26415 - protein, 231 aa, Panicum virgatum
  misc_feature: Ceres CLONE 1869164
  misc_feature (116)..(202): Pfam Name: TFIIS Pfam Description: Transcription elongation factor S-II protein N terminal
MAPPSRDYWLGFFRGAGDNIFDAIDAAITVAASDHPGALRERRDGIAERLFTALLVTGATAAPGPAAVAGAAAGTPVAGAPTPAQLHHEGAASVPSLCSSDRAEAITDDGAPRCDDPVLAETERIKAILLNDQEKSEAELLELLRRLQELDLAFDTLDVTAIGKAVANFRKHSSKQIRNLVRSLIESWKRTVDVWIARRREAVVDHTPQSMGPSSLEQEERGVNSTPMDEG

SEQ ID NO: 26416 - DNA, 691 bp, Panicum virgatum
  misc_feature: Ceres CLONE 1869164-R
ggaatttgttgctgagatgcttgcaagaccttcaaacgcagagtcaggccctgggagaccacaggcaaggcctaggcagcatcaagatgcttcaccagctcaaggcaggacgcagtcggctccatctgagaaatcggcagcccaccatgatccaaactctgtccgagcaaagctggaactcgccaagaatgcgaagctagaggccactaagagaaaacttcaggaaggctaccaagaatttgataatgcgaagaagcaaagaaccatacaaatggtggatccgcaaaatttgccgaagcaagggaacaacaggaatttccaacctagtggcaagccaaggaataacagcaacatcaacagcaatcggaattggtcaagatgaggcaccaattccactaagcagcagcgactataggattgcaaccatcaaatccccttcaaaacttcattcttctcctctctatttttttttggggttatgatcggctaaatttttagtccaggccagtacataaacagcagcaataaggcttggttcagaattgctcacattgcccccacagacacttccccagaggtgcattgcgtgtttgcattctctggccttggtcacagttgctggtcctagtgcttgtcaaacctgtaaagatacgatgctgagtcctaataccaattctgatcttgagctccg

SEQ ID NO: 26417 - DNA, 704 bp, Panicum virgatum
  misc_feature: Ceres CLONE 1869175
  misc_feature: Encodes the peptide sequence at SEQ ID NO. 26418
agcccctgctcccactcccccatcccaccgacacgcggcgtgtgacacgcctgcgctaaaaccctagccgccccaggcccgatggccgccccgccgcagccgcagccgccgccggcggaggagggggccgcaccggccgctcccctgcccgccgccccgccggggcctcggccgtacgaggtggcggtcgcggcggccgagctccgaccggtggactgcaacctcgcggcgctctgcgaccacgtccaggcggagggcttcggctccggggccttctccgatgtcgtcgtggaggccatgggcgcctacttcaggaatatgctacatggtccttggagagaggctggagcacctaccgtggtcctgcacattgatgatgccaatgttgattcagaggcaattgcaatcgctttggcatatctttatgggcaacctcccaagcttaatgataacaatgcatttcgggtgctcgcagctgcatcatttctggatcttcaggacttatgtacaatatgtacagattttattatttctgagctttggacatcaaactttttacaatatcagttgtttgctgaaagtcaagattatggtagtcatggggaacgtgtcagaaatgcctgctggggttatctttgtcaaagtgccacactggaactacgagaggtgctaccgaagctttcttcacaaactttgcatgctct

SEQ ID NO: 26418 - protein, 207 aa, Panicum virgatum
  misc_feature: Ceres CLONE 1869175
  misc_feature (52)..(153): Pfam Name: BTB Pfam Description: BTB/POZ domain
MAAPPQPQPPPAEEGAAPAAPLPAAPPGPRPYEVAVAAAELRPVDCNLAALCDHVQAEGFGSGAFSDVVVEAMGAYFRNMLHGPWREAGAPTVVLHIDDANVDSEAIAIALAYLYGQPPKLNDNNAFRVLAAASFLDLQDLCTICTDFIISELWTSNFLQYQLFAESQDYGSHGERVRNACWGYLCQSATLELREVLPKLSSQTLHA

SEQ ID NO: 26419 - DNA, 702 bp, Panicum virgatum
  misc_feature: Ceres CLONE 1869180
  misc_feature: Encodes the peptide sequence at SEQ ID NO. 26420
gcacctcacaagagagttcagagttcaccacttcatctcatcggctcgtccaaatcgccggcgccgatggagcccaatcccaatcccaatcccaccccgaccgtggtgctgcacgcctgcctcggcgtgggccacctgatcccgatggtggagctcgccaagctgctcctccgccgcggcctcgccgccgtcatcgccgtcccgaccccgccggcctccaccgccgacttcttcgcctcctccgcctccgccgtcgcggagctcgccgccgccaacccctccgtctccttccaccacctcccgccgccggactaccccgccccggacccggaccccttcctccagatgctcgacgcgctccgcctcacggcgcccgccctcgccgccttcctccgctccctcccctccgtcgccgcgctcgtgctcgacctcttctgcgtcgacgcgctcgacacggccgcatccatcggcgtcccggcctacttctactacacctcctgcgccggcgacctcgccgcgttcctccacctcccccactacttcgccgagacggacggcggcgctagcttcaaggacatgggcaaggcgctccttcgcttccccggcgtcccgccgatcccggcgtcggacatgccgcacacggttctcgaccgcgcggatcggacctgcgccgtgcgggtcggccactacggccgcatcccc

SEQ ID NO: 26420 - protein, 211 aa, Panicum virgatum
  misc_feature: Ceres CLONE 1869180
  misc_feature: SWISSPROT Homolog: EC 2.4.1.115 Anthocyanidin 3-O-glucosyltransferase
MEPNPNPNPTPTVVLHACLGVGHLIPMVELAKLLLRRGLAAVIAVPTPPASTADFFASSASAVAELAAANPSVSFHHLPPPDYPAPDPDPFLQMLDALRLTAPALAAFLRSLPSVAALVLDLFCVDALDTAASIGVPAYFYYTSCAGDLAAFLHLPHYFAETDGGASFKDMGKALLRFPGVPPIPASDMPHTVLDRADRTCAVRVGHYGRI

SEQ ID NO: 26421 - DNA, 730 bp, Panicum virgatum
  misc_feature: Ceres CLONE 1869185
  misc_feature: Encodes the peptide sequence at SEQ ID NO. 26422
gacaaagcgtcgatcgaaacacggcagagacactgcgcatcatgctccggagctcgccggcgtcgccggtcaagccgcagcaatggacggtgtgccggagcggcgcggcggtggtggcgtccccgccaccggtggtggccgtcgcgccgaggacggttgcctccgctcctctccgcgccctgaccaccgagtcagcggaaacgcatcccgtgcctgagcctccgccattgttcgccgacgacgatgaggagacgatgctcgccagctacgtcccggtctacgtcatgctcccagtaagctcgcgccaccagagcggccgtcccaaatcgctccatcgagctcagccagtgattctgaacctgcttgattgatcgcatcgcatcgcactgaacacgacacattgcgcgcggcagctggacgtgatgagcaccgagaacgagctggaggacgcggaggggctccggcggcagctgcggcggctgcggggcgccggcgtggacggcgtcatggtggacgtgtggtggggcatcgtggagggcgccgggcccgggcggtacgagtggcgcgcgtaccgagagctgttcggggtcgtgcaggccgaggggctcaagctgcaggccatcatgtccttccacgcgtgcggcggcaacgtcggcgacgccgtcagcatcccgatcccgcgctgggtgcgggaggtcggcgaggccgacccccacgtgttctacacgag

SEQ ID NO: 26422 - protein, 102 aa, Panicum virgatum
  misc_feature: Ceres CLONE 1869185
  misc_feature: SWISSPROT Homolog: EC 3.2.1.2 Beta-amylase
MSTENELEDAEGLRRQLRRLRGAGVDGVMVDVWWGIVEGAGPGRYEWRAYRELFGVVQAEGLKLQAIMSFHACGGNVGDAVSIPIPRWVREVGEADPHVFYT

SEQ ID NO: 26423 - DNA, 704 bp, Panicum virgatum
  misc_feature: Ceres CLONE 1869187
  misc_feature: Encodes the peptide sequence at SEQ ID NO. 26424
acgagcagctcgttcatcaccgaccctcaccgtctcgtctccctgctccgctccccgcacgcgctcgcccctccctccctctctcccctcctcaccgccgctcgcgccccgtgccgtttccgccatgtgtggcatcttcgccgtgctcgggctgaggcaccggggacccgactggtcgggggtgtaccagcacgagggcaacttcctcgcccagcagcggctcgccgtcgtctccccgctgtccggcgaccagccgctcttcaacgaggaccgcaccgtcgtcgtcgtggccaatggggagatctacaaccacaagaagatccgaaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgacggttccgtctggttcgcctccgagatgaaggcgctgagcgaggactgcgtccggttcgagcacttcccgccggggcacctctactccagcgccgccgcggggttccgccgctggtacaacccggcctggttcctcgagcaggtgccggcggcgccgtacgacccgctcgtgctca

SEQ ID NO: 26424 - protein, 193 aa, Panicum virgatum
  misc_feature: Ceres CLONE 1869187
  misc_feature (2)..(144): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGIFAVLGLRHRGPDWSGVYQHEGNFLAQQRLAVVSPLSGDQPLFNEDRTVVVVANGEIYNHKKIRKQFTGKHTFTTGSDCEVIIPLYEEYGENFVDMLDGVFAFVLYDTRNKTYMAARDAIGVNPLYIGWGGDGSVWFASEMKALSEDCVRFEHFPPGHLYSSAAAGFRRWYNPAWFLEQVPAAPYDPLVL

SEQ ID NO: 26425 - DNA, 765 bp, Panicum virgatum
  misc_feature: Ceres CLONE 1869207
  misc_feature: Encodes the peptide sequence at SEQ ID NO. 26426
atctccgccccctccactcccacctccctccctctgcgaggggcaaagcaaagcaagccgcaaagaccccctcctcctttccacaccccacgcctcgtcactgtgccgcccgtgccctcccgtcccaccaccaataatccaccacccccaccccgctgcagcggcgatgtgcggcggcgccatcctctccggcttcatccggccgtccgggccggcggccaagaagcagcagcagcagctactgcagcaccagccccgccgggtcacggccgacttgctgtggccggggcccggcaggaagggagcccccgtgggggatgacttcgaggccgacttccgcgagttcgtgcgcgggctcggcgaggacgacggcgcggacgccgccggcggcgacgaggtccaggaggtccccccgccggagccggcgatgtacgccttcgccgccgcggccaaggcggcgacccccgcagttgatggtgtgatgactgttcaaaatgatgaacctactgctacctcagcaaagcgcaaccggaagaatcagtacagggggatccgccagcgtccctggggcaaatgggcggctgagatccgagaccctagcaagggtgtccgtgtttggcttggaacttacaacacggccgaggaggccgcaagggcatatgacgctgaagctcgaaagattcgtggcaagaaggcaaaggtcaattttcctgatgaagcgccagatgctcagaaatcaatcctaagcccactactgtcaatcca

SEQ ID NO: 26426 - protein, 199 aa, Panicum virgatum
  misc_feature: Ceres CLONE 1869207
  misc_feature (124)..(175): Pfam Name: AP2 Pfam Description: AP2 domain
MCGGAILSGFIRPSGPAAKKQQQQLLQHQPRRVTADLLWPGPGRKGAPVGDDFEADFREFVRGLGEDDGADAAGGDEVQEVPPPEPAMYAFAAAAKAATPAVDGVMTVQNDEPTATSAKRNRKNQYRGIRQRPWGKWAAEIRDPSKGVRVWLGTYNTAEEAARAYDAEARKIRGKKAKVNFPDEAPDAQKSILSPLLSI

SEQ ID NO: 26427 - DNA, 2909 bp, Panicum virgatum
  misc_feature: Ceres CLONE 1869222
  misc_feature: Encodes the peptide sequence at SEQ ID NO. 26428
aggagatagctggacagtggttcgccaatcaccatcagtagcaccatactactagcttgtgacttgtgagcgagtgatggcggtagcagcaggggctaacgacgacggcgagcaggccgctgctcgtgatgagccaacagcaccaacaacccccgcagtcgcaatgcccagactagatccgcagctgctcatggctgctcgccgcggcgacagcaacgagctcaagcgtcttctacagccgctggaggagaaggaggcgactgcaccagcaccggaggtcgccgtggtagttgacgacgatgggccgcctcctcctgttgctgcacatgcgtcggcctgtggacgatcgtcgtcactccttttcggggtgaccgctatgggcgactctctgctgcacgtggttgccgccgcatgcggcgacggcgacggcttcgtggagtgcgccaagacgatctgcggcaagaagggtggggggcgcctcctgctcgcgtgcaacaagaatggcgacacacccttgcactgcgccgccagtgctgggaacgccaccatgatctcctgcctcctcgatctcgccgacgatcagcagggggcgatggccatggtgagagtgcagaaccagtgtggggagaccgccttgcaccacgcggtcaagcgggcctgctgcatgatgcgcaaccgcccgtggcccgtggtcgtggatgctgactatatagagcgcctggcctgcgtcgacaagctcatggccgtggatccagagctggcctgcatcccacatgatggggacggtgcttcgccgttgtacctggccatttcgttgggtgaaatggagattgcacgacacctgtttaccaagaccaaaggcaagctgtcctactccggaccagacggacgaaacgtcttgcatgcagctgtttcttgtgcgagtaacgtccaagcgcttggtatggttttgaagtggctcaagcaagaagcaccaaagacgcccaaccaaggagggtcgtctgacgacgatctcctgaagcgactcactagccaaggggacaagaagaacgggagcacccctcttcacttggctgcgtccttgtggggcttcccgtccacatgcattgttcccacttggtcttggatgtggtcagggtggcggcgtgtggtgatcgatgagctgctaggcgctaacgcatcgacggcgtaccaggcggacacgtacgggctgtaccccatacacgtttctgcaggggttggctccatcgtcgccatccgcaggatactagaaaggtgcccggagtgcgccagcctgcgggatggcaagggaaggacgttcctccacgtcgctgttgacaaggggatgtttggcgtggttaaatacgtgtgccgaacgccggagatgtcatggatgctgaatgccatggacgacaacggggacaccccgctccaccgagctgtgtatgctgaaaatctcagggtcttcggacgtctcttttggaatccacaggtacgcctggatgttgtgaataaggagggcatgcgaccggttgatgttgcatggagcaggatgcctctagaggcttattatgcatgggatccaagaatacatatacgaaattcactattaaaagtggcagctccatatggtgaaagcagtcggggcgacctcttcaagcaaaaacatgctgacctcttcaagcaaaaacatgctgacgacaaaacccaggcgcaattattagcaggaggcgaggacactacctcggcgaataaacatcatgctgacaacacccatcagcagttgtttgaaggaggcgagggcactatatcgtcgactctaacatctgcggcgcaagtcatgggtatcctatccgtccttgttacaactgtcacatttgcatcagccttcacgttgcctggaggatatcgagccgacggcggcgacgctgcaggcacgccggtgcttgccgggagctatgctttcgaggccttcgtcctcgctgacgctatggcatttatctgctctctgttagctacctctttcctgctctatgccggggtgcctgcttttaccctcacggaccgcttccaaaccgtgaatgaagcatacggcttgatgatgcattcagcaaggagcttggtggccgctcttggcttggggctctacgtcgcgctgcatccagttgcccgcaccattgcacttgtcatcgctgtctggatgagcatgcttgtatatggcttcaccaaggattcggaaggcatcgattatatgtttagctatcctataattccaagacagaaactctcggcatggagtcgcgtgttaggctggattatctatttgttggaacgcctctggtcctacatactaatcttcggcgtcccggcaattcgcaagtgggcaaggggaaggtagcccgccaacaagttacaacacctaatctcaagctactagtgtctctcctcgtgcatgcatggttcaaagaccacctagagtacctggtctcgcgatcgatgatggcagttgctgtggttggttggttgttgttgtgatggtgctgtcttgttggccgcgtactttaattcgtcgtgtgagtagtgtaattttcttatttttgtggttggttggttgttgttgtgatggtactgtcttgttggccgcgtactttaattcgtcgtgtgagtagtgtaattttcttatttttatggttggttggttgttgttgtgatggtactgtcttgttggccgcgtactttaattcgtcgtgtgagtagtgtaattttcttatttttgttgtgttttattgttttattaggtttctcattctctattaatactagcagagagggcacgtgcaacacgcacgtgatacaaaattatttgccttttctcttgaagtcgatactacccacccgtatcggttgcg

SEQ ID NO: 26428 - protein, 773 aa, Panicum virgatum
  misc_feature: Ceres CLONE 1869222
  misc_feature (142)..(181): Pfam Name: Ank Pfam Description: Ankyrin repeat
  misc_feature: SWISSPROT Homolog: EC 3.1.1.4 Phospholipase A(2)
MAVAAGANDDGEQAAARDEPTAPTTPAVAMPRLDPQLLMAARRGDSNELKRLLQPLEEKEATAPAPEVAVVVDDDGPPPPVAAHASACGRSSSLLFGVTAMGDSLLHVVAAACGDGDGFVECAKTICGKKGGGRLLLACNKNGDTPLHCAASAGNATMISCLLDLADDQQGAMAMVRVQNQCGETALHHAVKRACCMMRNRPWPVVVDADYIERLACVDKLMAVDPELACIPHDGDGASPLYLAISLGEMEIARHLFTKTKGKLSYSGPDGRNVLHAAVSCASNVQALGMVLKWLKQEAPKTPNQGGSSDDDLLKRLTSQGDKKNGSTPLHLAASLWGFPSTCIVPTWSWMWSGWRRVVIDELLGANASTAYQADTYGLYPIHVSAGVGSIVAIRRILERCPECASLRDGKGRTFLHVAVDKGMFGVVKYVCRTPEMSWMLNAMDDNGDTPLHRAVYAENLRVFGRLFWNPQVRLDVVNKEGMRPVDVAWSRMPLEAYYAWDPRIHIRNSLLKVAAPYGESSRGDLFKQKHADLFKQKHADDKTQAQLLAGGEDTTSANKHHADNTHQQLFEGGEGTISSTLTSAAQVMGILSVLVTTVTFASAFTLPGGYRADGGDAAGTPVLAGSYAFEAFVLADAMAFICSLLATSFLLYAGVPAFTLTDRFQTVNEAYGLMMHSARSLVAALGLGLYVALHPVARTIALVIAVWMSMLVYGFTKDSEGIDYMFSYPIIPRQKLSAWSRVLGWIIYLLERLWSYILIFGVPAIRKWARGR

SEQ ID NO: 26429 - DNA, 436 bp, Panicum virgatum
  misc_feature: Ceres CLONE 1869232
  misc_feature: Encodes the peptide sequence at SEQ ID NO. 26430
cacggcccccaagccctccgccgccgcggacctccccgagggcgcgcagtggcgctacagcgagttcctctccgccgtcaagcgcggcaaggtcgagcgcgtccgcttctccaaggacggcggcctgctccagctcaccgccgtcgacggccgccgcgccaccgtcgtcgtccccaacgaccccgacctcatcgacatcctcgccaccaacggcgtcgacatctccgtctccgagggcgaagccgccgggcccgggggcttcctcgccttcgtcggcaacctcctcttccccttcatcgccttcgcgggcctcttcttcctcttccgccgcgcgcagggcggcccgggcgcgggccccggcggcctcggcgggcccatggactttggacgattatacaagaacttccacgaagacccctgagacagcggcctcttc

SEQ ID NO: 26430 - protein, 139 aa, Panicum virgatum
  misc_feature: Ceres CLONE 1869232
  misc_feature (15)..(135): Pfam Name: FtsH_ext Pfam Description: FtsH Extracellular
TAPKPSAAADLPEGAQWRYSEFLSAVKRGKVERVRFSKDGGLLQLTAVDGRRATVVVPNDPDLIDILATNGVDISVSEGEAAGPGGFLAFVGNLLFPFIAFAGLFFLFRRAQGGPGAGPGGLGGPMDFGRLYKNFHEDP

SEQ ID NO: 26431 - DNA, 719 bp, Panicum virgatum
  misc_feature: Ceres CLONE 1869237
  misc_feature: Encodes the peptide sequence at SEQ ID NO. 26432
gaccatctcaatggcggcggctgctacctccttcgctaccctcgccatcgcgcggccggcgacggcagcggcggcggcatccgggcagcgggccctccacgcctccaaggcctcctcgccgctcctatcctcccgcggtgcccgcctccactcacaggccgtttccttctccgggggcctggcgccttcgccctcccacagccgcgcgcgcttcgtcacatccgccagcgccgaacccaaggaagcagaaatccagtccaaaatcacaaacaaggtgtactttgacataagcatcgggaaccctgtggggaagaatgttgggaggattgtcatcggcttgtatggggatgatgttccccaaacagcagagaacttccgtgctctttgcactggagagaaagggttcggatacaagggatccagtttccaccgtgtcatcagggatttcatgattcaggggggagattttgacaagggcaatgtatgtttttacctactaccactaaactctggcgtgcacttggatatttataccattgtgcacattcagttcagagaaattaaagaatattttcggactgctgtgcttatatgctctatcaaaagattgaatggttcattttacctttttttttaattgtacaaatgtacttatttaatcttgttggttgttactgctaattattttctcattttgggggtatcgttcagagtacttc

SEQ ID NO: 26432 - protein, 208 aa, Panicum virgatum
  misc_feature: Ceres CLONE 1869237
  misc_feature (88)..(200): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAAAATSFATLAIARPATAAAAASGQRALHASKASSPLLSSRGARLHSQAVSFSGGLAPSPSHSRARFVTSASAEPKEAEIQSKITNKVYFDISIGNPVGKNVGRIVIGLYGDDVPQTAENFRALCTGEKGFGYKGSSFHRVIRDFMIQGGDFDKGNVCFYLLPLNSGVHLDIYTIVHIQFREIKEYFRTAVLICSIKRLNGSFYLFF

SEQ ID NO: 26433 - DNA, 664 bp, Panicum virgatum
  misc_feature: Ceres CLONE 1869242
  misc_feature: Encodes the peptide sequence at SEQ ID NO. 26434
gcaacaaccctagcgccgcagtccccatcgcagccgtgcgcgtggccggggccggcgcgagctcgcccgccggcgccgccatccatcccatcgcagccgcacgcgtggccggggccggcgcgagctcgcccgccggcgccgccatccatcccatcgcagccgcacgcgtggccggggccggcgcgagctcgcccgccggcgccgccatccattcccatcgcagccgcgcgcgtggccggggccggcgcaaggtcacccgcatctccgcccgtccgctggcgccgcatctccaacccgctcggactacatccagcaggtcgcgccgcaacggcctgctcaagaaggcctacgagctctccgtgctctgcgacgccgagttcgcgctcatcatcttctccagccacgacaagctacgagttcgggagcaccggatctgctgcttttacccttaatttcactttccctttgcggaaaagatctgcgagtagtcgagagctctactcctgtactcctgtacatctccgccctacgccgccactgctccagcggcactagatggaggcggcagacggagcaatggttaattttatagtattgcaggagttacctttcagtttagttgagcatgcaccttttccgagattcattgctactttaaacccat

SEQ ID NO: 26434 - protein, 149 aa, Panicum virgatum
  misc_feature: Ceres CLONE 1869242
  misc_feature (97)..(142): Pfam Name: SRF-TF Pfam Description: SRF-type transcription factor (DNA-binding and dimerisation domain)
NNPSAAVPIAAVRVAGAGASSPAGAAIHPIAAARVAGAGASSPAGAAIHPIAAARVAGAGASSPAGAAIHSHRSRARGRGRRKVTRISARPLAPHLQPARTTSSRSRRNGLLKKAYELSVLCDAEFALIIFSSHDKLRVREHRICCFYP

SEQ ID NO: 26435 - DNA, 749 bp, Panicum virgatum
  misc_feature: Ceres CLONE 1869257
  misc_feature: Encodes the peptide sequence at SEQ ID NO. 26436
attgttggcaatgtgttctagtgacttcatttgcttttatgactgggttgattgcagactaatacgccgaattgatgtcactgttaagaacctttactgggctgatagcggtgacctagttgcaatagcaagtgatacgtcattctacatcctcaagtacaatagagatgttgttgcttcttatctagaaggtggaaagcctgtggacgaggaaggtgttgaagatgcttttgagctgcttcatgaggtcaatgagcgagtgcgtactgggatttgggttggagactgcttcatatataacaattcatcttggcgcctaaattattgtgttggtggtgaggttaccacaatgtatcacttggatcgccctatgtatttgttgggatatcttgcgaaccaaagtcgagtttatctaatcgataaggagtttaacgtcattgggtacacattacttctcagtttgattgagtacaaaacccttgtgatgcgtggggatttggaacgcgcaaatgaaattttaccatccataccaaaggcacaatataatagtgtcgctcatttcttggagtctagaggtatgttggaagaggctcttgagatagccactgatgctgactataaatttgatctagctgtgcagcttggaaaattagatgttgcaaaggctatcgccataaaagcacaaactgaatctaaatggaagccgttgggcgaactctccatgtctacaggcaagctagagatgggcg

SEQ ID NO: 26436 - protein, 249 aa, Panicum virgatum
  misc_feature: Ceres CLONE 1869257
  misc_feature (1)..(249): Pfam Name: Coatomer_WDAD Pfam Description: Coatomer WD associated region
LLAMCSSDFICFYDWVDCRLIRRIDVTVKNLYWADSGDLVAIASDTSFYILKYNRDVVASYLEGGKPVDEEGVEDAFELLHEVNERVRTGIWVGDCFIYNNSSWRLNYCVGGEVTTMYHLDRPMYLLGYLANQSRVYLIDKEFNVIGYTLLLSLIEYKTLVMRGDLERANEILPSIPKAQYNSVAHFLESRGMLEEALEIATDADYKFDLAVQLGKLDVAKAIAIKAQTESKWKPLGELSMSTGKLEMG

SEQ ID NO: 26437 - DNA, 2000 bp, Panicum virgatum
  misc_feature: Ceres CLONE 1869259
  misc_feature: Encodes the peptide sequence at SEQ ID NO. 26438
atccccattcctggcccagccaagaacaccgcggcttgcggctgcggttacactactcaagtgtgcacaaaaaggtccatgcttcctctcgcttcccttttctgctccgtgaaggcacaagcagcagatcttggattcggctgcaggtggtagtaacgcacgcagcagcaggagtaggtgggcagcaccgcggcaggccagcccctccgccctcgtggtgccctgcatgtttcacagctctccacgcgtttgcttggagcattgaccggggaacgaatccagcttgccggttcttgaccccttctcctcctctcccatggcctgtccgcctctgcaggagctggcgttctgagcgagcgggtgcgtgtggtggccgtcggcggcggcggggatcttgggcgcgcgcgggatcctgggttctgtctggctctgaaggcgccgccgtcctgttcttctatcccttagatagtgcttcaatccgacaacgcttctagcttgcctgaaaggtttgtgaactatgaagccacctttggagaggaatcctaccaagaagcgccattcgtggtggtgggacagtcacattagccccaaaaactcgaaatggcttgcagaaaatctggaagaaatggataagcaagtgaaggaaatgctccagctgatcgaggaggacggtgactcctttgcaaagaaagcacagatgtactaccagaggcgtccaatgctcatcactcacgttgagaatttctaccggatgtaccgcgctctagctgagcgctatgacaatgtcaccggtgaattgcgcaagaatatcccaacaaggctgcaatcgatgggttctttagccagttcagagtgtggttctgagctccagaagtcaccctcaccatctcctgagccactacagaggtcatggacaagagagcagagtcctagagctgcgggctttgatttcttcctgagtaacaagaacaatgattcgccagcatcaaggaaggagcctgaggatctggcatcgcagtcagagtctgatgcgaaatccgaagatggcgatgatgatggtattgcctacacattgcatcagagagttctagaacttgaggacgagctcaatatgacaaaccagaaactgcgtgatgcaaatgaaaaacttgagattttggaggagaagagcttgaggtgccattgtgattataaagagaatggaaatgttgctgatcaaatagcaattttgtccagagagcactctaatatgttggaacaaaacaagaagctagaagctgacattatcaagctcaaggaagaagtggattcagtaagaaggcgatttgaagaggaattgtctgaaagggatggagaaattagcaagttaaagcaagaccttgctgatgcttcggagaaattgctgcaagagaagtgcagtaatggtgcgcgaatatctgaactgcaaaaatcggttgaagacatcaggtccaaactagagagagtttctgaagagaaattactagttgagaagcaggttaaggagctggaggaagcaaatgctgaagctgaaaagtacagtcaagaactgactgaagatgctgaaaggctttcagaagagaagttcaggcatgaagctgagattctcacaatgcagcagagcattgaaaatctgaagtccagaattgagagccttgctcaagagaaatcattgatgacaacatggttctcagacttggagcaagttgtggagcggggaaggagcattttcgtcgggtaaccaaattttatcggaaacaccagtagctagaatttagctagttagcaacattttatttttttccatatacataccatcatgtgaacttaagaagccctaccatacgtaagtgtactaccattgtccttgcttgaatttttatgtacgatgtgatggatggtggtgatgtactatgatacttgagatattgcactgaacttactcctcggtaataaaatgcccatggtgcacttgctggttc

SEQ ID NO: 26438 - protein, 413 aa, Panicum virgatum
  misc_feature: Ceres CLONE 1869259
  misc_feature (15)..(88): Pfam Name: KIP1 Pfam Description: KIP1-like protein
  misc_feature: SWISSPROT Homolog: EC 2.7.11.1 Non-specific serine/threonine protein kinase
MKPPLERNPTKKRHSWWWDSHISPKNSKWLAENLEEMDKQVKEMLQLIEEDGDSFAKKAQMYYQRRPMLITHVENFYRMYRALAERYDNVTGELRKNIPTRLQSMGSLASSECGSELQKSPSPSPEPLQRSWTREQSPRAAGFDFFLSNKNNDSPASRKEPEDLASQSESDAKSEDGDDDGIAYTLHQRVLELEDELNMTNQKLRDANEKLEILEEKSLRCHCDYKENGNVADQIAILSREHSNMLEQNKKLEADIIKLKEEVDSVRRRFEEELSERDGEISKLKQDLADASEKLLQEKCSNGARISELQKSVEDIRSKLERVSEEKLLVEKQVKELEEANAEAEKYSQELTEDAERLSEEKFRHEAEILTMQQSIENLKSRIESLAQEKSLMTTWFSDLEQVVERGRSIFVG

SEQ ID NO: 26439 - DNA, 1653 bp, Panicum virgatum
  misc_feature: Ceres CLONE 1869268
  misc_feature: Encodes the peptide sequence at SEQ ID NO. 26440
atcccaaaaccccctgccattaccaccaccttcctctgccccttccgaaatccccccctctctccgcctgtccgtcacgacacgacaggcacgcgcggccattaccaggagcaagcggacgctctctccgtctccagctctgccctgctccgtcccaagaaacaggggagcgggcaggaggaggagcagaggccggcggcggcgggcaatgggggaggagatgggcgcgggctggccgacgtggcgcgcggcggcggcgctggccgtggcggcgtggctggcgctgcacgtggcggcgcgcgtggcggacgcgctgtggtggcggccgcggcgcctggaggcgcacttcgcggcgcagggggtgcgcggcccaccgtaccggttcctgctggggtccgtgcgggagatggtggcgctcatggcggaggcctcctccaagcccatgtcgccgcccacctcccacaacgcgctccctcgggtgctcgccttctaccactactggcggaagatctacgggccgacgttcttgatctggttcgggccgacgccgcggctgacggtggcggagccggagctggtgcgggagatcttcctcacgcgcgccgacgcgttcgaccgctacgaggcgcaccccgtcgtgcgccagctcgagggcgacggcctcgtcagcctccacggcgacaagtgggcgctccaccgccgcgtcctcaccgacgccttctacccggacaacctcaaccggctggtgccccacgtcggcaggtcggtggcggcgctggcggaggagtggtgcgccatggcggccgccggcgggagcggcgaggtggaggtcgacgtcgcggagtggttccaggcggtcacggaggaggccatcacgcgcgccaccttcggccgcagctacgacgacggccgcgccgtgttcgccatgcagggccgcctcatggccttcgcctccgaggccttccgcaatgtcctcgtccccggctacaggttcttgccgaccaggaagaactggcaatcgtggaagttggacagggagatacggcggagcctgacccggctcatcgcccggcgcagcgacgaggccgaggcagagaacaaggccgccggcgacggcggcgccttccgcgacctcctcggcgccatgatcaatgccgccgacaggaagacgcgcgcgccgccgtcgccgccggcggcggcgatcccggtggaggacatgctggaggaatgcaagaccttcttcttcgccggcaagcaaaccaccacgaacctcctcacctgggccaccgtgctcctcgccatgcaccccgagtggcaggagcgcgcccgccgcgaggtcctcgacgtctgcggcgccgacgagctcccctccaaggaccacctccccaagctcaagacgctcggcatgatcatgaacgagaccctgcggctgtacccgccggcggtggcgacgatccgccgcgccatgaccgacgtccagctctccgacgggcgcgtgatcccgcgcgacatggagctgctcgtcccgatcatggccatccaccacgacccgcggttctggggccccgacgcggcacagttcaaccccgcgcgcttcgctggcggcccggcccgggcggcgaagcacccgctcgccttcatccccttcggcct

SEQ ID NO: 26440 - protein, 481 aa, Panicum virgatum
  misc_feature: Ceres CLONE 1869268
  misc_feature (78)..(481): Pfam Name: p450 Pfam Description: Cytochrome P450
  misc_feature: SWISSPROT Homolog: EC 1.3.3.9 Secologanin synthase
  misc_feature: The sequence is a functional homolog of SEQ ID NO 2 in US patent 7034205
MGEEMGAGWPTWRAAAALAVAAWLALHVAARVADALWWRPRRLEAHFAAQGVRGPPYRFLLGSVREMVALMAEASSKPMSPPTSHNALPRVLAFYHYWRKIYGPTFLIWFGPTPRLTVAEPELVREIFLTRADAFDRYEAHPVVRQLEGDGLVSLHGDKWALHRRVLTDAFYPDNLNRLVPHVGRSVAALAEEWCAMAAAGGSGEVEVDVAEWFQAVTEEAITRATFGRSYDDGRAVFAMQGRLMAFASEAFRNVLVPGYRFLPTRKNWQSWKLDREIRRSLTRLIARRSDEAEAENKAAGDGGAFRDLLGAMINAADRKTRAPPSPPAAAIPVEDMLEECKTFFFAGKQTTTNLLTWATVLLAMHPEWQERARREVLDVCGADELPSKDHLPKLKTLGMIMNETLRLYPPAVATIRRAMTDVQLSDGRVIPRDMELLVPIMAIHHDPRFWGPDAAQFNPARFAGGPARAAKHPLAFIPFG

SEQ ID NO: 26441 - DNA, 365 bp, Panicum virgatum
  misc_feature: Ceres CLONE 1869268-R
aaaaacaacaccgtaggatatgtttagaatgaccgaaatgcccctccccagccgcccccgtatatgtataggccaagtgatagtaaaagccaagaagcattaactttttgtcctagcctgcgcttcgggccccatccaggtggcccggaaatgccctccttaacaggccgtatcaggcccagcctttttttttaagatttgatgacacaaaacggggtgggccccaccccctcctcccctttttttttgttcctcgcccatggcagccggtgtatgtattttgtatagtggttttgtttgttcccgtctcctacgctggtagagacgaaaatgcaatggagaaaagaaatggaagaatttctttc

SEQ ID NO: 26442 - DNA, 633 bp, Panicum virgatum
  misc_feature: Ceres CLONE 1869283
  misc_feature: Encodes the peptide sequence at SEQ ID NO. 26443
atcgtttggttcaaaatctcccttcccattcctctttctctctctctcagccttgttagttggtttggttggcaagagccatggcgctgacgctgcgatccaccacgtcgttcctgtcgcccgtcgaccccatctccaagctcctccacaagcccggcgccgacgacgcgccgccgagctgcgccgccgtgccgtccccgccccacgccgccgcgccgagccgcaggctgcgcctcgtcagggcggccgccgcagaggagcacgcgaagggcttcggccacaagaaggagacgctcgagcacatgatgcacgactacaccactgatgtgatcaagacgctcaaggagagcgggaaccaccacacctggggccccgtcaccgtgaagctggcggaggcctaccgattctgctggggcgtcgagcgcgccgtgaatatcacctaccaggcgcgcaagcagttccccgaggagcgcatctggctcaccaacgaaatcatccacaaccccaccgtcaacaagaggttggatgagatgggtgtagaaatcattcgtgttgatgcaggcatcaaggatttcgatgtcgttgaaaaatgcgatgttgttgtgctacctgcatttggagctgctgtggagg

SEQ ID NO: 26443 - protein, 184 aa, Panicum virgatum
  misc_feature: Ceres CLONE 1869283
  misc_feature: SWISSPROT Homolog: EC 1.17.1.2 4-hydroxy-3-methylbut-2-enyl diphosphate reductase
  misc_feature: Useful for making plants with modulated nitrogen use efficiency
MALTLRSTTSFLSPVDPISKLLHKPGADDAPPSCAAVPSPPHAAAPSRRLRLVRAAAAEEHAKGFGHKKETLEHMMHDYTTDVIKTLKESGNHHTWGPVTVKLAEAYRFCWGVERAVNITYQARKQFPEERIWLTNEIIHNPTVNKRLDEMGVEIIRVDAGIKDFDVVEKCDVVVLPAFGAAVE

SEQ ID NO: 26444 - DNA, 704 bp, Panicum virgatum
  misc_feature: Ceres CLONE 1869298
  misc_feature: Encodes the peptide sequence at SEQ ID NO. 26445
gtcctcattctgctcccgtccgtctcccccctcatcctccatccctagcccgtcgaaaccctagcccgaaagtgccgcggtgaaagtctcgctctcgccgcctccccggcgccatgggcaagaagcggaggctggagaccggatccgcggcagccgctccgactaccccggccgctgcgccccaatccccgactgatactgccgctagcctatcccaggtcttcgcccccgccatggagcggaaggaggtgaagctgcccgaggaggcgggcgtcaaggaggaggaggaggaggagggcggtgacgagctgggcaacctcgaccgcgacgagctctgggccaaggtgtggggggaggccacctacgacctcgccaccgtgctcgccttcctcgccgtcctcgccttcaccatctccgtctacatcatgtccaggcccaggcccgtctacctcatcgacttcgcgtgctacaagcccgccgacgagctcaaggtgtccaaggcggagttcatcgagctggcgcgcaagtcgggcaagttcgatgaggagagcctggcgttccagtcgcggctgctggccaagtccggcatcggcgacgagtcgtacatgccgcgctccgtgttcgagcccaacgccaactgcgcccacatgaaggagggccgcgcggaggcctccacggccatgttcgcggcgctggacgagctc

SEQ ID NO: 26445 - protein, 156 aa, Panicum virgatum
  misc_feature: Ceres CLONE 1869298
  misc_feature (63)..(156): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MERKEVKLPEEAGVKEEEEEEGGDELGNLDRDELWAKVWGEATYDLATVLAFLAVLAFTISVYIMSRPRPVYLIDFACYKPADELKVSKAEFIELARKSGKFDEESLAFQSRLLAKSGIGDESYMPRSVFEPNANCAHMKEGRAEASTAMFAALDE

SEQ ID NO: 26446 - DNA, 697 bp, Panicum virgatum
  misc_feature: Ceres CLONE 1869300
  misc_feature: Encodes the peptide sequence at SEQ ID NO. 26447
aaccatactcaagcagctcaaaacctctagcctgctaccaagaaatggctctggttgcttctcccctgataagtcacactgcccatcgtcctggcctaagaagccacataggacccaatggtggcaatttgtcatggcacgagaagagtaaaagaaggtgtgaccttattagtgttagatcactaccctggagcggcgagcctgtagaatatttgacgccttcagaaatcccaaggagggactggttcagcgacgagttcgtctttggctccgccacttcagcataccaaattgaaggtgcttggaatgagcatggcaaggggccaagcacttgggaccacttctgccacacttatcctgagaggatagttgatggaagcaatggggatgttgcagtgaactcctaccatatgtatgaagaggatgtcaagttgctgaagcaaatgggcatggacgcctataggttctcaatctcttggtcgagaatactgccaaaggggacgctcgaaggtgggataaactataatggcctccagtactacagaaacctgatcaacacgttgaaagagaatggtgacaatattatttgactatagctaaccattttttcttgattctacaattaactaattgagaaagaatgtatgagtgcaatgcacaaaagtttacgcaactcaatagttatctgttgcaactc

SEQ ID NO: 26447 - protein, 181 aa, Panicum virgatum
  misc_feature: Ceres CLONE 1869300
  misc_feature (64)..(181): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
MALVASPLISHTAHRPGLRSHIGPNGGNLSWHEKSKRRCDLISVRSLPWSGEPVEYLTPSEIPRRDWFSDEFVFGSATSAYQIEGAWNEHGKGPSTWDHFCHTYPERIVDGSNGDVAVNSYHMYEEDVKLLKQMGMDAYRFSISWSRILPKGTLEGGINYNGLQYYRNLINTLKENGDNII

SEQ ID NO: 26448 - DNA, 574 bp, Panicum virgatum
  misc_feature: Ceres CLONE 1869311
  misc_feature: Encodes the peptide sequence at SEQ ID NO. 26449
gagactccaaccagcagaccgagctcgctcgcctcgccttttgagaagaacaaacgcgtcctctctggtcttcgtccttcccacttccacagtcctatccacacgtacgcacgagaaggaccacgctcgtgagccgccggccggtgcgagtgcgacgacgacgaacacccatggcgccgtccgaggactgcggctggctgctgtacctctccctggccgccaaatgcggcggcccccaccgcctgctcggcttcgccgcgatcgtcgccgccgccttcgtcgtcacggcgctgctgcactggtcgtcccccggcggccccgcgtggggctggtactggtggaccaggagggccggcctgggcatcgttggcgccgccatcccggggccccgggggctgccggtgctcggcagcatggggctcatgacgggcctggcgcaccggaagctcgcggcggcggcggcggacggcaaggccaggcgccgcctcatggcgttctcgctcggcgagacccgcgtcgtggtgaccgccgacccggacgtcgcgcgggagctgctccccagcgccgccttcgc

SEQ ID NO: 26449 - protein, 134 aa, Panicum virgatum
  misc_feature: Ceres CLONE 1869311
  misc_feature: Useful for biocontainment applications
  misc_feature: Useful for making plants with modulated flowering time
  misc_feature: Useful for making plants with modulated nitrogen use efficiency
MAPSEDCGWLLYLSLAAKCGGPHRLLGFAAIVAAAFVVTALLHWSSPGGPAWGWYWWTRRAGLGIVGAAIPGPRGLPVLGSMGLMTGLAHRKLAAAAADGKARRRLMAFSLGETRVVVTADPDVARELLPSAAF

SEQ ID NO: 26450 - DNA, 642 bp, Panicum virgatum
  misc_feature: Ceres CLONE 1869322
  misc_feature: Encodes the peptide sequence at SEQ ID NO. 26451
actcctccagaccccccccccccccccctcgcgcgcgcgccgccgccgccgccgcgagatccgctccgcgcgcgatgtggcgcagctgcgtctcgcggggcctctccagggcgagggcctccgcctccaggctcctctccacggcgccgtcgtcctacacggtggtggaccacacgtacgacgcggtggtggtgggggctgggggcgcggggctccgggcggcgatcggcctctccgagcacggcttcaacacggcgtgcatcaccaagctcttccccacgcgctcgcacactgtcgccgcgcagggaggcataaatgctgcacttggaaacatgactgaagatgattggaggtggcatatgtatgacactgttaagggaagcgattggcttggtgaccaggattctattcaatatatgtgcagagaagcaccaaaagctgttatagagcttgagaactatggattgccattttcaagaaccgaagagggaaagatataccaacgcgcctttggaggacagagcttatattttggaaaaggaggacaagcctaccgttgtgcctgtgctgctgacagaacaggacatgctatgctacacacactttatggtcaagcaatgaagcacaatactcagttttttg

SEQ ID NO: 26451 - protein, 189 aa, Panicum virgatum
  misc_feature: Ceres CLONE 1869322
  misc_feature: SWISSPROT Homolog: EC 1.3.5.1 Succinate dehydrogenase (ubiquinone)
MWRSCVSRGLSRARASASRLLSTAPSSYTVVDHTYDAVVVGAGGAGLRAAIGLSEHGFNTACITKLFPTRSHTVAAQGGINAALGNMTEDDWRWHMYDTVKGSDWLGDQDSIQYMCREAPKAVIELENYGLPFSRTEEGKIYQRAFGGQSLYFGKGGQAYRCACAADRTGHAMLHTLYGQAMKHNTQFF

SEQ ID NO: 26452 - DNA, 661 bp, Panicum virgatum
  misc_feature: Ceres CLONE 1869332
  misc_feature: Encodes the peptide sequence at SEQ ID NO. 26453
attccaacagcttcttcccctcaaagaccactccggcgagattcttcccagaccggccggcgaatcacagctcgatcgatcgttctccggcgagccagcaaccactccctgatcggaattcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggcgggcggggagaaggagtggtacttcttctcgccacgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacaacgcgctcaggcgtgctcgagctgtccctttcgtgacagcccgcggctacttgcagacggctggcccgggcgctctagagacctgt

SEQ ID NO: 26453 - protein, 178 aa, Panicum virgatum
  misc_feature: Ceres CLONE 1869332
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered terpenoid content
  misc_feature: Useful for making plants with altered cell wall content and/or composition
  misc_feature: Useful for making plants with altered lignin content
  misc_feature: The sequence is a functional homolog of SEQ ID NO 851 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Useful for making plants with modulated light quality sensitivity
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Useful for making plants with modulated nitrogen use efficiency
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered carbohydrate content
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1729 in the 11/479,226 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 344 in the 10/666,642 US patent application
  misc_feature: The sequence is a functional homolog of SEQ ID NO 854 in the 11/435,388 US patent application
  misc_feature: The sequence is a functional homolog of SEQ ID NO 886 in the 10/412,699 US patent application
  misc_feature: Useful for biocontainment applications
  misc_feature: The sequence is a functional homolog of SEQ ID NO 582 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 310 in the 10/666,642 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNNALRRARAVPFVTARGYLQTAGPGALET

SEQ ID NO: 26454 - DNA, 485 bp, Panicum virgatum
  misc_feature: Ceres CLONE 1869364
  misc_feature: Encodes the peptide sequence at SEQ ID NO. 26455
gcgctctctcctcctccctcgcctatctccggtccctgcttgctagtctgttgctgtatttatttccacctccccctcttcttctccagctcaatgctcaagcaccattccaagaagcccgatcgctgatacgaactcgcaagaaagagatttcttgtgcagttccgtgcgaagtctccggttcgtcgtcggccgttccaagaaggtctctgcttcgtcaaaagcggaggagatgatcacggtggcggcaccggaggggcagccgcaagcggcggcggcggcagcggaggtggtggcgccggaggagaccgtgttccggtcgaagctgccggacatcgagatccccagccacctgcccctgcacgagtactgctttgctcgggcggcggagctcccggacgcgccgtgcctcatcgcggcgggcacggggacgacatacacgtacgccgagaaacgcctcccctgtcgcaaaggggccgcgcctc

SEQ ID NO: 26455 - protein, 84 aa, Panicum virgatum
  misc_feature: Ceres CLONE 1869364
  misc_feature: SWISSPROT Homolog: EC 6.2.1.12 4-coumarate--CoA ligase
  misc_feature: Useful for making plants with altered carbohydrate content
MITVAAPEGQPQAAAAAAEVVAPEETVFRSKLPDIEIPSHLPLHEYCFARAAELPDAPCLIAAGTGTTYTYAEKRLPCRKGAAP

SEQ ID NO: 26456 - DNA, 1511 bp, Panicum virgatum
  misc_feature: Ceres CLONE 1869380
  misc_feature: Encodes the peptide sequence at SEQ ID NO. 26457
atccagtattccagtcctcaatccgtcgagaaattctcgcgagcgatcgaaatctaagcgaagcgaagaggcctccccagatcctctcaaggtatgcgagagcatcgatccccttccgatctatatcgcgtgtcctccctgttcttgttcttcgtcgatctagtttagggtttgatttggttctgaatcgaacccttttcctgcttgcgttcgatttgtactcgatcctcgggtagaggtgtggatctgcggggcgtgatgaggtagtttggtgtagatttgttctgggcgttcgatttgccactagggttcggctgctgttggcattcctgatcgagcggccggataggattgtttttccctttttatatgttggatgcgtgatggttcctgtgtgttgggttagattgctggtacgattcatctaggtggtgatttgcagaggaacaactttgctgttgaatattggtaggtctatctagatttattacttttgattatcgcctgataaggatcaccgattcgtgtagaataaattatttcattgttgggtcatgtagatatagctgcacaatttcttacttggctccttactgtgtgaattgtagaataaactgtgttactctatgagtttttctggattgctggatccagttaggccagtgctgtcaatttgttatggctgttaatgtaataattttctggattgttggcctgcttctcttcatgtttaatcacgtgatggttcatgatgcctgttgggttagattgtttgttcaattcatctaggcagtgctgtgcagagtacaactcgattgttgtttaatcttggtagcttcatctagatttgtacaaattttggtcacctgatgatgatcaccgattgttgtggaattatttcttaactggttcgttgttagtcaccaccttacttgtagaataacctgtggtactgcttttctgttctgttttaggccacatcatatgattgtcaaaaatttacatggtagtttaatgataaaattagttcagcttacttcagtttgatttgcttcatattttgttttctgttctattaatgatacttcatgaaatgtttgttttttctctgttcagatttgacatgtttcagtatcataataataatattctgtatcctttatagtttgttggcatgatttgctttgaatttagttagcctattctgttaatataggatgataagctgtgaggcgttcattctcttcagtccagagttatcattttcagtgttttaatgttgtttatcaagctggatgtatatggtggtttaactcttttctgtttcttaatgtttgcagatgcagatctttgtgaagaccctcaccggcaagaccatcaccttggaggtggagtcatctgacaccattgacaatgtgaaggccaagatccaggacaaggagggcatcccctcggaccagcagcgtctgatcttcgctggcaagcagctggaggatggccgcaccctggcg

SEQ ID NO: 26457 - protein, 56 aa, Panicum virgatum
  misc_feature: Ceres CLONE 1869380
  misc_feature (6)..(56): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPSDQQRLIFAGKQLEDGRTL

SEQ ID NO: 26458 - DNA, 787 bp, Panicum virgatum
  misc_feature: Ceres CLONE 1869380-R
  misc_feature: Encodes the peptide sequence at SEQ ID NO. 26459
ccagcagcgtctgatcttcgctggcaagcagctggaggatggccgcaccctggcggactacaacatccagaaggagtccaccctccacttggtgctccgtctgcgtggtggtatgcagatctttgtgaagaccctcaccggcaagaccatcaccttggaggtggagtcatctgacaccattgacaatgttaaggccaagatccaggacaaggagggcatccccccggaccagcagcgtctgatcttcgctggcaagcagctggaggatggccgcaccctggcggactacaacatccagaaggagtccaccctccacctggtgctccgcctgcgtggtggtatgcagatctttgtgaagaccctcaccggcaagaccatcaccttggaggtggagtcttctgacaccatcgacaacgtgaaggcgaagatccaggacaaggagggcatcccgccggaccagcagcgtctgatcttcgccggcaagcagctggaggatggccgcaccctggcagactacaacatccagaaggagtccaccctccacctggtgctccgtctccgtggtggacagtaagtccatggagctgctgttgtccctgggttcacaagtctggtgccttgccttgtctctccaatggtgattgcctgcgtgtccttgtcatgcctgtctgatgtgagttttatgtcatctggttgtgttttgtgaacacttaactgctgctgtgcagcagtttggttgaactatgtaatgaataagtgagccctgaagttactatggtaatcttgc

SEQ ID NO: 26459 - protein, 190 aa, Panicum virgatum
  misc_feature: Ceres CLONE 1869380-R
  misc_feature (43)..(111): Pfam Name: ubiquitin Pfam Description: Ubiquitin family
  misc_feature (119)..(187): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
QQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 26460 - DNA, 1964 bp, Panicum virgatum
  misc_feature: Ceres CLONE 1869402
  misc_feature: Encodes the peptide sequence at SEQ ID NO. 26461
acgcagctagctcagctcgatcgtcctctcctctccattcatccgttctcgtgctccctccctcccaatcctcgccacgcactgcagcggcggccggccggaggagatgatgagcggtggtaggctgaacgtggcgaggtccgcgccgggcgacgacttcccgttcgcgccgatgcagcagcagcagcagcagccgccgccctacgtcgggttcgagcacggcgtggtgggaggcggcggccagcgcggcggcggcgggatgcagcaccacctctacgacggcctcgacttcgccgcggcggcgctgcagttccaggaggcggcgccccaccaccagctgctcacgctgccgtccagcctcgcgcccatggcgccgccgccgctgccgatgcccatgccgatgcccggcgacgtgtacccggcgctcggcctggtgaagcgcgagggcggcggcgtcggcgcggacggcggcgcaggcgcggcggggggcggccggatcgggctcaacctcggccgccgcacctacttctccccgggcgacatgctggccgtggaccggctcctgatgcactcccgcctcggcggcgtgttcgggctcggcttcggcggcgcgcaccaccggcccccgcgctgccaggccgagggctgcaaggcagacctctccggcgccaagcactaccaccgccgccacaaggtctgcgagtaccacgccaaggcctccgtcgtcgccgccggcggcaagcagcagcgcttctgccagcaatgcagcaggtttcacgtcctgacggagttcgacgaggccaagaggagctgccggaagcggctggccgagcacaaccgccgccgccggaagccggccgccgcctccacggcgtcgtccaaggacgcggcagcgtcgccgcccgccaagaagcccagcggcggctccatgacgggctcctacaccactgacagcaggaacctgagcacggccaagtcgaccatgtcatcgaacacgggcagcgtgatcagctgcctggaccagggcaacaagcagctggcgaggccgacgctgaccctcggtgcgtcgccggacaaggaccaccagcaccagcagttcagcaccatgctccaggtccaggcggccgcgggcggccaccaccaggagcagcacttcatcacctccctgcaggttcacaaccacaacaatggcggcggcggcggcggcaacaacaacatcctgtcgtgctcgtcggtgtgctccagcgcgctgccgtcggccaacggcgaggtctccgaccagaacacccaccacaccaacggcaacggcaacatgcacaatctgttcgaggtggacttcatgtaggccgtacgtggatgcgtgcaaagcgagcgagcacgggagtacgttcttctgtcaaaggtgtccttggtgtgtagccgtgtaggtaaattaaaaggaataggagaaagtgagagtgagagtgagagagaacaaaaaaggcatgaagtgagagaaaaacaagagagagagagaaggctgagggtgcaaggattccatccagccagccagccatcagtgctcagtagcagctggctgcagcaggctggtctagcaaggtagagctagctatctccttgcaaagttgcatgcatggctatagtagctctagcaaagccatgcatccatcctgcatccggccggcatcccccttgcattgcattgggttctctacctgtactgtactgaactgcagtgcgtctgcatccaatccatccatccaagcctttctgcctttccatttcagtggggaatattgtgtctgctattatttcccctttatttttcccctttctagtttcctcttgttgcaaggtgagggtgtactactggtgtagtagtgcgtgtgttgtaccaaactaccagctactgttttttacagtgtctccaacaattaacaggcgagagaagattcattgttgtc

SEQ ID NO: 26461 - protein, 412 aa, Panicum virgatum
  misc_feature: Ceres CLONE 1869402
  misc_feature (175)..(253): Pfam Name: SBP Pfam Description: SBP domain
  misc_feature: Useful for making plants with altered terpenoid content
  misc_feature: Useful for making plants with modulated flowering time
MMSGGRLNVARSAPGDDFPFAPMQQQQQQPPPYVGFEHGVVGGGGQRGGGGMQHHLYDGLDFAAAALQFQEAAPHHQLLTLPSSLAPMAPPPLPMPMPMPGDVYPALGLVKREGGGVGADGGAGAAGGGRIGLNLGRRTYFSPGDMLAVDRLLMHSRLGGVFGLGFGGAHHRPPRCQAEGCKADLSGAKHYHRRHKVCEYHAKASVVAAGGKQQRFCQQCSRFHVLTEFDEAKRSCRKRLAEHNRRRRKPAAASTASSKDAAASPPAKKPSGGSMTGSYTTDSRNLSTAKSTMSSNTGSVISCLDQGNKQLARPTLTLGASPDKDHQHQQFSTMLQVQAAAGGHHQEQHFITSLQVHNHNNGGGGGGNNNILSCSSVCSSALPSANGEVSDQNTHHTNGNGNMHNLFEVDFM

SEQ ID NO: 26462 - DNA, 2284 bp, Panicum virgatum
  misc_feature: Ceres CLONE 1869404
  misc_feature: Encodes the peptide sequence at SEQ ID NO. 26463
gtcgcatcgacatcaccagttacttcaccggtgcctccctctttgcttgttcgcctgcgtacgtgctttactgtgtcgcagttgcagctccgtcgtcgccgtcctcgccgagctctgaccacccctgctgccgccgctgacacccgctgacatttgtctcccgagcccagagaggatcgttgctggtatcggtgtttatctaccgcattaacaattaacattgctccgggtcttgcagtggttccgatcctttgggtttagtgcggagtgcgctcgtctggtgcagctagctattctgctctcagggggtctcttcgctctgtccagattggtctcaaggttcagatctaggagagctcggggccgcttcttgatcacttctgctgacaaaggttccaactgctgcttgctctgacaaattcttgaacaccatcgctaagaaatcaggagatggccgaggtgaagccggaggacatggtccatcatatgcccatggaccagctccaggggttcgagtactgcatcgactccaatccttcctggggagaagggattgctttggggttccagcactacgtactgtccctgggcactgctgtcatgatccccacaatgctggttcagctcatgggtggaaatgataatgataaggccaaggtggtacaaactctgctgtttgtgactggaatcaagacgctgctccagacactatttggcactcgccttcctacaatcatgggaggttcatatgcatatgtggttccaatcctctccatcatccgcgacccctcgctcgtgcaaatagctgacggccatactagatttctgcagacaatgagggccatacaaggttcactgattgtatcctcaagcattcagataattcttggatatagccagttgtgggcaatatgttctagattctttagcccacttgggatggttcccgtcattgcattggtggggcttggccttttcgagagaggattcccagtggttgggaaatgcgtggagattggtcttccaatgcttatcctatttgttgcgctttcccagtatctgaagcacgtgcatgttcggcatgttcctgttttggagaggttctccatgctgatgtgcatcgctcttgtctgggtatatgcccacatcctcacagcaagtggtgcatacaagcacacggcacttgtcacccagatcaactgccgaacagaccttgccaacctcatctcttcatcacaatggataagcattccatatccgttacaatggggcgcaccgacattcagtgcagaccatgctttcggtatgatggctgcggtgctagtctctttaatcgagaccacaggagcattccaagctgctgcccggttggctagtgcaacaccaccaccagcatatgtcctgagcagaggcattgggtggcagggcattggcaccctattagatggcctatttggcactgggactggttctactgtttctgttgagaatgttggtctccttggatcaacaagggttggtagtagaagagtgattcaaatttctgctggtttcatgatcttcttctccatgctaggtaaatttggagcactttttgcctccattcccttcacaatatttgccgccatttactgtgttatgtttggaattgtcgctgctgtggggctctcctttatgcagttcaccaacatgaactcaatgcgcaacctattcattattggtgtttcacttttccttggtttatctataccagagtacttttctcggtattcgacgagttctcgacaaggcccagcacacacaaaggctggatggttcaatgactacattaacaccatcttctcatccccgccgacagtggccctcttcgtgtcagtactccttgacaacacactcgacgtcagagatgcagcaagggaccgaggaatgccatggtggacacgatttaggacgttcagaggcgacagtaggaacgaagagttctataccctgccgtttaacctcaacagattcttccccccatcatgaggcaaaggcaaaccactaaagtcaaaagatgctgcaagccaaattctcaacaagctcctagcactcagatgtgctttccatagagtagaacaacaactgcaagagaaagtttcttgcaaaaacaaaaagagaaagttggacaaaggccgaattaactccctgctggccgtcgattgtacataaatggttttgtttcaagtatcgatcaatgatcaaggaacaagaatgtcgaatatttgatatagtgtgattttag

SEQ ID NO: 26463 - protein, 525 aa, Panicum virgatum
  misc_feature: Ceres CLONE 1869404
  misc_feature (32)..(439): Pfam Name: Xan_ur_permease Pfam Description: Permease family
MAEVKPEDMVHHMPMDQLQGFEYCIDSNPSWGEGIALGFQHYVLSLGTAVMIPTMLVQLMGGNDNDKAKVVQTLLFVTGIKTLLQTLFGTRLPTIMGGSYAYVVPILSIIRDPSLVQIADGHTRFLQTMRAIQGSLIVSSSIQIILGYSQLWAICSRFFSPLGMVPVIALVGLGLFERGFPVVGKCVEIGLPMLILFVALSQYLKHVHVRHVPVLERFSMLMCIALVWVYAHILTASGAYKHTALVTQINCRTDLANLISSSQWISIPYPLQWGAPTFSADHAFGMMAAVLVSLIETTGAFQAAARLASATPPPAYVLSRGIGWQGIGTLLDGLFGTGTGSTVSVENVGLLGSTRVGSRRVIQISAGFMIFFSMLGKFGALFASIPFTIFAAIYCVMFGIVAAVGLSFMQFTNMNSMRNLFIIGVSLFLGLSIPEYFSRYSTSSRQGPAHTKAGWFNDYINTIFSSPPTVALFVSVLLDNTLDVRDAARDRGMPWWTRFRTFRGDSRNEEFYTLPFNLNRFFPPS

SEQ ID NO: 26464 - DNA, 1301 bp, Panicum virgatum
  misc_feature: Ceres CLONE 1869408
  misc_feature: Encodes the peptide sequence at SEQ ID NO. 26465
acgcagcccgaaacgcgagcacaatcaaggcctgaccaccaccaccattgccgccgccgccgccgccgcaggtgcaggagcagcgctcgcaatggcagctcgtcttgcttaagcgtcgaggagccgaggagctagaagcgcgcattggcgccgccggcgcgggcgcgagctgctgcgccgtgccaccgcgctacgccgatcgccggcgcccattgcctccgtggggtgggttggctggccgccaatctcgctagcgagcggcgccgccgaggagcgaagcggcgccaccgcgaatggcgggacgccgaatgacgctgccgctgctggcgctgctggcggccgcgttcctggccgccaccactggcagcaacagcaagtcctcggcggtgttcgaactgatccaccgggagcaggcgacctggaccgagctggcgcgcaatgaccgggagcgcatggcgttcatctcctcgcgcgggcgccgccgcgccgcggagacgggcacggccacggccaagcccagcaaggccgcgcccgcgtccgaggccttcgcgatgccgctctcctcgggcgcctacacgggcaccggccagtacttcgtccgcttccgcgtgggcacgcccgcgcagccgttcctgctcgtggccgacaccggcagcgacctgacctgggtcaagtgcctccgccccgccgccgccgccgacgaccccgccttcggcgccggctacggctacagctacggcgccccggcgccgaccgactcctccccgctgccggcgccgtcgtcctcctccccgccgccgcacgggcgcgtcttccggccggacgactcccggacgtgggcgcccatcccgtgctcctccgacacctgcacggcgtccctgcccttctccctcgccgcctgccccacccccggcagcccctgcgcctacgactaccggtacaaggacgggtcggcggcgcgcgggacggtgggctccgactcggcgaccatcgcgctgtcggggcgcggcgcggcggcggcggcggtggccagcaggagcaggagacagcggcgggccaagctgcggggcgtcgtgctgggctgcaccacctcctacagcggcgacagcttcgtggcctccgacggtgtgctcagcctcggctacagcaacatctccttcgcgtcccacgccgcggggcgcttcggcgggcgcttctcctactgcctcgtcgaccacctcgccccgcggaacgccaccagctacctcaccttcgggcgcaacccggccctgtcgccggccgccaggaccgcctgcgcgggg

SEQ ID NO: 26465 - protein, 335 aa, Panicum virgatum
  misc_feature: Ceres CLONE 1869408
  misc_feature: SWISSPROT Homolog: EC 3.4.23.12 Nepenthesin
MAGRRMTLPLLALLAAAFLAATTGSNSKSSAVFELIHREQATWTELARNDRERMAFISSRGRRRAAETGTATAKPSKAAPASEAFAMPLSSGAYTGTGQYFVRFRVGTPAQPFLLVADTGSDLTWVKCLRPAAAADDPAFGAGYGYSYGAPAPTDSSPLPAPSSSSPPPHGRVFRPDDSRTWAPIPCSSDTCTASLPFSLAACPTPGSPCAYDYRYKDGSAARGTVGSDSATIALSGRGAAAAAVASRSRRQRRAKLRGVVLGCTTSYSGDSFVASDGVLSLGYSNISFASHAAGRFGGRFSYCLVDHLAPRNATSYLTFGRNPALSPAARTACA

SEQ ID NO: 26466 - DNA, 674 bp, Panicum virgatum
  misc_feature: Ceres CLONE 1869408-R
  misc_feature: Encodes the peptide sequence at SEQ ID NO. 26467
tcaagatcccgcgcctagtctggaatatcgagagggcgggcggcaccatcctcgactcgggcacgagcctcacggtgctagccagcccggcgtaccgggtcgtggtcgcggcgctgagcaagaagctcgcggcgctgccccgggtgatcatggacccgttcgagtactgctacaactggacgtcgccgtcgacgggcgaggacctggccgtgcccgtgccggacttggcctttcacctcgcgggggcggcacgcctgcagccgccggcgaagagctacgtgatcgacgcggcgcccggcgtgaagtgcatcggcgtgcaggagggggagtggcccggggtgtccgtcatcggcaacatcctgcagcaggagcacctgtgggagttcgataccaagaaccgacgactcagatttatgaggtcgcggtgcacgcaatgattgggcccgcggtgatccatcgttcttccccccacttcttcaattttttaccccatgtggtggtgatcttgctgattctttttttttcttttcccttgttcagatactaatgcaatgagaaatgtaccttcttgcaatgcagaagtgataagctgtaatcagttttcttttctccttttccacaccctgttgttcttctcattccggtgaatatatgttcagagtgcatctcctcct

SEQ ID NO: 26467 - protein, 144 aa, Panicum virgatum
  misc_feature: Ceres CLONE 1869408-R
  misc_feature: SWISSPROT Homolog: EC 3.4.23.12 Nepenthesin
KIPRLVWNIERAGGTILDSGTSLTVLASPAYRVVVAALSKKLAALPRVIMDPFEYCYNWTSPSTGEDLAVPVPDLAFHLAGAARLQPPAKSYVIDAAPGVKCIGVQEGEWPGVSVIGNILQQEHLWEFDTKNRRLRFMRSRCTQ

SEQ ID NO: 26468 - DNA, 2653 bp, Panicum virgatum
  misc_feature: Ceres CLONE 1869421
  misc_feature: Encodes the peptide sequence at SEQ ID NO. 26469
ttttcgaaattgttacacggtgacgcctgaacagccggcacgagcccgcgccgccggcgatgttgcgcagggtcctcgcgagggcgatcccacgctccgccgcctccaccgggttgtccaaacctctaagccctctcttcatcggtgcctcgcgcctagccacttctcctggagaccacgtcgcagatggcggcggcggcggcgaggatgaccccttctccttcccggaccaatatctgcagcagctcccgcccgacgtcgcccgaggggtggactccgtcgtcgcggcggcccagactaatgcctccagtgcggcggacgccgcgcgggccctcgacctgtgcggcgccgaagcgtccgagccgctcgtggtggccgcgcttgcgcgcctccgcaacagctgcgccgccgcgcacgccgcattccggtgggccacagcgcagcccgggtacgcgccgggccggcgcgcgtcccactccatgctcgccatcctcgccaagcaccgccacttcgacgacgcgcgcgccctgctcgacgaaatgcgccgcgcatcgacggcctccccggccgcggtgcttctcctcatccggcgccactgcgccgcgcgggacgtcgctggcgccgtcgccgcgttccgcgcgctaccgaacttcggattccgacctggtgtcgccgagttccacggcctcctgagtgggctatgccggtacaagaacgttcaggacgcggagcacctgctcatgtccagccagaaggagttccccttcgagaccaagagcttcaacatcgtgctcaatggttggtgcaacattatcggcagtgttcgggaggcgaaaaggttttggaatgccatggggaatctgggcattgacagggacgttgtgtcgtacgggagcatgatctcatgcttctcaaagtctgggagtttggattctgtcatgaagctctttaaccgcatgaaggaggctggcattacaccagatcggaaagtatacaatgcagttgtgcatgcactagcaaagggacgttgcgtggaggaggcaaagatgcttgtccagactatggaggagaagaaggttgccccggacacagccacttttaactctctcattgggcctctttgcaaggctcgtcgtgttcatctggcaatggaaacgttttatgctatgttaggaaggggtctgcctccttcagtgaggacctttcatgcgttacttaatgtggccacacccactggggtatttgatctgttacataagatgaaagagttacgctgtgagcctgagatggacacttacattatgttgatcaggaaattctgccgatggaggcagtatgagagtgtggagaagctatggagtgcaatgcctgcaaatgggctgagccctgatcggagtgcatacattgtgttgatacatggattattcctaaatggaagactagaggaggcgtcaaagtattacgaagagatgaaagctaagggctttgcaccagagcagaagactcaagaaatgatacaagcttggctcgcgggcagagagcttgccaaggcatcagcttcaggttgttcaaagggtggttcagtgtctctcagacttcccagaaggtgacaaagttaaggttagctccgaagggcaattcataaaaggaaacgaaacagaatagaagggtacctattatgattcccgaataactcataagttcaaaaagatacttggctgcacggaaaactgggactactgtatgtttttcgtagttatttgtcacttgattgataagttgaaaactggaatatggcaagtcattttcaggtggatgcatgctatttgtatttctttgcattgagcttttagtgggtactgaccagatgttcgattatatttttacaaaacttctcctgagccatgtaggttttaagcccacctgaacgcttcctttaatatctaaggggcactacaggtgattttgcaaataaaatcagggaaaatgagatggataaagcaacgagcagattaacatagctttctgatctgatgatttttgacattcttgtttcaagcaaaagctgcagataccatacagagatccattaggcggtagatcccatggaggacagtagtggggcctgaactgccaccagaattgggctgactgaggacattgcaagggcaagagatctccaagtctcttttttcaagcaggagttaatacttgtttccacccagctgctgttctgcaggaccactgaccacgcttccgaaacctacctggcgcttgaactaatctgacgacaagatcacgttggatttgaagctgggagtgggtgctgccagcctgctattaatcaatggccattatgcttggattcgttctgacgatagggctcatctcgtctctgatatgtgaatacatctaatctatgagataccctttagattgctaccttgtggtttaaaataatgccttagcagctggctgcttagatcatactactagtagcatggtccaagtcaaagagcttatccttgtacagtctgacgacctttctgtcatattctcaaagttatacgcatctcaactggatctttaacgtgtatcttctcgcacgcctgaactcttctgatatgttatatgtactccagaatttggcgtt

SEQ ID NO: 26469 - protein, 516 aa, Panicum virgatum
  misc_feature: Ceres CLONE 1869421
  misc_feature (275)..(309): Pfam Name: PPR Pfam Description: PPR repeat
  misc_feature (446)..(480): Pfam Name: PPR Pfam Description: PPR repeat
  misc_feature (310)..(344): Pfam Name: PPR Pfam Description: PPR repeat
  misc_feature (345)..(379): Pfam Name: PPR Pfam Description: PPR repeat
  misc_feature (411)..(445): Pfam Name: PPR Pfam Description: PPR repeat
MLRRVLARAIPRSAASTGLSKPLSPLFIGASRLATSPGDHVADGGGGGEDDPFSFPDQYLQQLPPDVARGVDSVVAAAQTNASSAADAARALDLCGAEASEPLVVAALARLRNSCAAAHAAFRWATAQPGYAPGRRASHSMLAILAKHRHFDDARALLDEMRRASTASPAAVLLLIRRHCAARDVAGAVAAFRALPNFGFRPGVAEFHGLLSGLCRYKNVQDAEHLLMSSQKEFPFETKSFNIVLNGWCNIIGSVREAKRFWNAMGNLGIDRDVVSYGSMISCFSKSGSLDSVMKLFNRMKEAGITPDRKVYNAVVHALAKGRCVEEAKMLVQTMEEKKVAPDTATFNSLIGPLCKARRVHLAMETFYAMLGRGLPPSVRTFHALLNVATPTGVFDLLHKMKELRCEPEMDTYIMLIRKFCRWRQYESVEKLWSAMPANGLSPDRSAYIVLIHGLFLNGRLEEASKYYEEMKAKGFAPEQKTQEMIQAWLAGRELAKASASGCSKGGSVSLRLPRR

SEQ ID NO: 26470 - DNA, 752 bp, Panicum virgatum
  misc_feature: Ceres CLONE 1869437
  misc_feature: Encodes the peptide sequence at SEQ ID NO. 26471
acgccgagttctctcttccagaaacggacagagagagaaagtgagctccagcgaagcagccagcagcccgccacgccttcctccttcctctcgcggattcagagctccagacctcctccgtgtccgtgtgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttgtggacgtcggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccataataagacttgagtatgccaaggacagcattacttggcagacactgtatcctgaatggatcgatgaggaggaagaaactgagataccctcttgtccatctctcccagagcccaatgttcgaaaaggtgtacgctttgatgtcattgcagtgaaacttccttgtacccgtgttgcgggttgggtcagagacgttgcacggctccatttgcagctctcagcagc

SEQ ID NO: 26471 - protein, 250 aa, Panicum virgatum
  misc_feature: Ceres CLONE 1869437
  misc_feature: Useful for making plants with altered carbohydrate content
TPSSLFQKRTERESELQRSSQQPATPSSFLSRIQSSRPPPCPCEDTTKRRTSKSKSFKDVENFEVLVIEKNCGCKFKSLKIMIIAIISATVLTLITPTLYEHQLQSASRFVDVGWMWDKTSSDPRYASSVDVQWDDVHRALRNLKSGNQDLKVGLLNFNSTEYGSWTQLLPDSHVSIIRLEYAKDSITWQTLYPEWIDEEEETEIPSCPSLPEPNVRKGVRFDVIAVKLPCTRVAGWVRDVARLHLQLSA

SEQ ID NO: 26472 - DNA, 713 bp, Panicum virgatum
  misc_feature: Ceres CLONE 1869472
  misc_feature: Encodes the peptide sequence at SEQ ID NO. 26473
ttcgatcggagacggagagaggccaatggcagcgcggtgcggcggcggctgcgacgggcgcgagggcggcgcggtggaggcgctgctgcagtggcagaaggtgagcgacttcctcatcggcgcgtcctacctgtccatcccgctcgagctgctgcacttcgccacctgcgccgacctcgcgccgctccgctgggtgctcctccagttcggcgccttcaccgtcctctgcggcgtcgtcgacctcgccgccgtcctcacctacgcgcgcccggactcgcgccgccgcctcctcgcgttcaccgccgccaaggcgctcgcagccctggccgcctccgtctccctcccggccttcatcccgcacctgctccgcctcaagatccgcgaggcgctcctccgggacaaggcccgccagctcgaccgcgacgtcgccgccgtccggcgccgccaggagaccaccgcgcgcgtcgtccgcgccatcacgcagcacgtccgccgcggcggtggcgcgctcccgcacgacgcgcacgccgtcctgcgcaccgccgtgctccacctctccgaggccctcggcctccgtagctgcgccgtctggatgcccgcggatggctccagcgtgctccacctggtgtatcagctgccggaagacgaccggacgaggcaggccattcgtgtcgctgaccccgacgtggccgccgtcatggccagcaaggacg

SEQ ID NO: 26473 - protein, 229 aa, Panicum virgatum
  misc_feature: Ceres CLONE 1869472
  misc_feature: SWISSPROT Homolog: EC 2.7.13.3 Histidine kinase
MAARCGGGCDGREGGAVEALLQWQKVSDFLIGASYLSIPLELLHFATCADLAPLRWVLLQFGAFTVLCGVVDLAAVLTYARPDSRRRLLAFTAAKALAALAASVSLPAFIPHLLRLKIREALLRDKARQLDRDVAAVRRRQETTARVVRAITQHVRRGGGALPHDAHAVLRTAVLHLSEALGLRSCAVWMPADGSSVLHLVYQLPEDDRTRQAIRVADPDVAAVMASKD

SEQ ID NO: 26474 - DNA, 728 bp, Panicum virgatum
  misc_feature: Ceres CLONE 1869488
  misc_feature: Encodes the peptide sequence at SEQ ID NO. 26475
atcttctccctttgctatctcctccctttgctaccccagccgccgctctcgacgctgtcggcccgtgcggcgccctccagtcctccacgctcccctgcccaactgcagctcgagtccagctggtggggcagcaccctcccttcccacgacttctctgttcgttctttcggcctcggtcttcctttcctagcggcgatgacagggcgagttgcgctgcccgttgttcatcgagcgatgggggcttcgccggcgacgaacatccgacaaggacagaatacgcaggagaggagcatcggcaggcaagactccaggcaaccggcgccaatgttgggcccttctgaacgccagctcccgaagcgacgccgacggatggcttccgttggcagtgggattcctgaggatatactcttcgaaattctggtactacttccggtaaagtgccttgtgcgcctccaattggtgtgcaagctgtggcgtgcaaccataaccagcactcattttgcccaccgtcacctggagcgttcgagatccaaattctcttttctcctgatgccccggagggataacgaggactacagctatggcattaagggtgtgtctatcttcagctttgagccggagcagctccctaccaagatcgccccgttcctaatgcacaagggattgaggatgccgatgttcaccttgcctttgcactgcgacgggctcattctgatcccttgctttgt

SEQ ID NO: 26475 - protein, 134 aa, Panicum virgatum
  misc_feature: Ceres CLONE 1869488
  misc_feature (18)..(65): Pfam Name: F-box Pfam Description: F-box domain
MLGPSERQLPKRRRRMASVGSGIPEDILFEILVLLPVKCLVRLQLVCKLWRATITSTHFAHRHLERSRSKFSFLLMPRRDNEDYSYGIKGVSIFSFEPEQLPTKIAPFLMHKGLRMPMFTLPLHCDGLILIPCF

SEQ ID NO: 26476 - DNA, 2128 bp, Panicum virgatum
  misc_feature: Ceres CLONE 1869492
  misc_feature: Encodes the peptide sequence at SEQ ID NO. 26477
aaacgcggtgcagatacagacgcaggcaaacctgaacctgcagagcgcaccaatggcagatcacgatctgctagtgctaaagcagctgagtccagtgaggtcaaaccccgagctgagtgagctcggatacgcgtcgagcacctttcgcttttcaccagcaagcaatcgcctcgccctgcattatttctgagcggattgcggcggcggctcctcgctagatccgcgtccgcgaagacggcccagatggagccccaggatgacggaccccttcgcctccaagaacccgccgccgccggctgcggcggcgtcattggcaaaagttgcgtcgcctccccctgccgatggctgcggcggctgtcccgcaagctgcactggagcttcgtgctcgcggtcgtcgcggtctatggcgcctgccagggcgtcggcaacgccgtcggcggcgtcgccgcggggtactactggaaggacgtgcagcgcgtgcagccgtcggcggcccagttctaccagggcgtcacggacgcgccgtgggtcgtcaagcccctctggggactgctcaccgacgtggtcccggtcgccggctaccgccgccgcccgtacttcgttctcgcaggcgtggtcggcgtgtcgtcaatgctgatgctctccctgcaccgcggattggggatcatgccggcgctgctagccctgacggcgcagagtgcgggcgccgcgatagccgacgtgacggtggacgccctggttgctcagaacagcataacgcacccgccccttgcttccgacatgcaaagcctgtgtgggtttagctcctctcttggggcattggttggattctccattagcggcctgcttgttcactcaatgggctctcagggtgctcttggcctgttgagcatcccctctatactggtgctcttggccgggatcctgctgaaggagaaccacgttgcagaatttgactacaagcaggttcataaaaagttctacaaagcgattcggtctatggggacaacactgaaatgcccagaggtctggcggccatgtgtatatatgtttgtttctcacaatttgagtctggatattcagggaggaatgttctactggtacacagaccatgtggttggacctgggttttctgagggatttatcggtctcatctttgcaattggttcatttggttcactgcttggagttttgctataccaaagcgctctgaaggactattctttccgcagcatacttttatggggtcaagtgctgtctagtctggcaggaatgctcgatctggtattggtgaccaggctaaacttgaaaattggcataccggattatttctttgcaatgatcgataacagcatttcccaaatggttggcagactcaaatggttgccacttcttgtgctttgctccaagctttgttcccccggcatcgaaggaacattttacgcgctactcatgtcactacaaaatgccgggttgctgatgtctgcttggtggggtggcttgctgctgcacatgctgaatgtgactcgaatggagttcagtaacctctggatcgctgtcttgattagaaacatttcaaggcttgtcccattgacactattgtttcttgttcctcaaagtgatcagaactcaacactcctgcctgcagagatgcttgaatgtgacacaacagaagctgtgagggcaggatcagttgaattctcagtcctcgttcaagaagattctggctgcatttctcccaatatggtggctgaggatggacgaaccaaaatgcttgatgcagaaatcgatgatgtggaatcaatcccgctggttagtaagagccagaccattgattcatgatgtgttaagtgccatgatttggcaaatgattccatgactcatccccaagtccgttaaagacggtaagacattgcatcgaagatcgaacaaaggaattggagaatttggtaccgaaatgcgggacttggaattttcactgttacataggtggtagcagtcatgagcaagagttgactgagctcaagcatagcttgttgatacacagttttaggcacttcaattactccttatcgccatttagacatactgaacacattccttccggttatagaaatccattctttgg

SEQ ID NO: 26477 - protein, 532 aa, Panicum virgatum
  misc_feature: Ceres CLONE 1869492
  misc_feature (58)..(470): Pfam Name: BT1 Pfam Description: BT1 family
MEPQDDGPLRLQEPAAAGCGGVIGKSCVASPCRWLRRLSRKLHWSFVLAVVAVYGACQGVGNAVGGVAAGYYWKDVQRVQPSAAQFYQGVTDAPWVVKPLWGLLTDVVPVAGYRRRPYFVLAGVVGVSSMLMLSLHRGLGIMPALLALTAQSAGAAIADVTVDALVAQNSITHPPLASDMQSLCGFSSSLGALVGFSISGLLVHSMGSQGALGLLSIPSILVLLAGILLKENHVAEFDYKQVHKKFYKAIRSMGTTLKCPEVWRPCVYMFVSHNLSLDIQGGMFYWYTDHVVGPGFSEGFIGLIFAIGSFGSLLGVLLYQSALKDYSFRSILLWGQVLSSLAGMLDLVLVTRLNLKIGIPDYFFAMIDNSISQMVGRLKWLPLLVLCSKLCSPGIEGTFYALLMSLQNAGLLMSAWWGGLLLHMLNVTRMEFSNLWIAVLIRNISRLVPLTLLFLVPQSDQNSTLLPAEMLECDTTEAVRAGSVEFSVLVQEDSGCISPNMVAEDGRTKMLDAEIDDVESIPLVSKSQTIDS

SEQ ID NO: 26478 - DNA, 438 bp, Panicum virgatum
  misc_feature: Ceres CLONE 1869498
  misc_feature: Encodes the peptide sequence at SEQ ID NO. 26479
agtcatcaaggacgcctccacaaacgaatggccatagggaacctttaattggtgagatcactacagcacaatctgcatcacctactagaacgaaaaatgccctctcagtggtaccatggctgggtcttcggttcaccaggggtctctggccctttttattggaaaacacacgtagggaagtgccaagtgaaactgtcataccagtgggaagaaggcttttactgtttaaggatgatcaaggatattcatctctcagccatggcagtggaagtgaaattggaagctttcttggttgggcaatggcaataatctatatgggtggacgactgccccagattttcttaaatatgcaaagaggccatgctgaggggctcaatccattaatgtttaccttcgctttattggggaattcgacatacgtacgaagtatactttgtt

SEQ ID NO: 26479 - protein, 145 aa, Panicum virgatum
  misc_feature: Ceres CLONE 1869498
  misc_feature (89)..(145): Pfam Name: PQ-loop Pfam Description: PQ loop repeat
SSRTPPQTNGHREPLIGEITTAQSASPTRTKNALSVVPWLGLRFTRGLWPFLLENTRREVPSETVIPVGRRLLLFKDDQGYSSLSHGSGSEIGSFLGWAMAIIYMGGRLPQIFLNMQRGHAEGLNPLMFTFALLGNSTYVRSILC

SEQ ID NO: 26480 - DNA, 452 bp, Panicum virgatum
  misc_feature: Ceres CLONE 1869957
  misc_feature: Encodes the peptide sequence at SEQ ID NO. 26481
gtgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggccctatcccgcggcggtggcggcggcggcggcggttacggcggcggtcgccagggaggcttctgtgtgcgcggcggctacgcgctggcggtcgcgcgtgagggcgcgctacggcggcggcggct

SEQ ID NO: 26481 - protein, 124 aa, Panicum virgatum
  misc_feature: Ceres CLONE 1869957
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSTEQSMLDAIEAMNGKELDGRNITVNQALSRGGGGGGGGYGGGRQGGFCVRGGYALAVAREGALRRRR

SEQ ID NO: 26482 - DNA, 634 bp, Panicum virgatum
  misc_feature: Ceres CLONE 1869979
  misc_feature: Encodes the peptide sequence at SEQ ID NO. 26483
gcactcagcaatccgcaatcatcccgagcaatccctcgtcgaatccaccagcgaagcaaatccccagccttcctccccctctcccccgatggcccgcacgaagcagacggcgaggaagtccaccggcggcaaggcgccgaggaagcagctggcgacgaaggcggcgcgcaagtcggccccggcgaccggcggcgtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctccgcttccagagctcagccgtcgccgcgctgcaggaggcggccgaggcctacctcgtcgggctcttcgaggacaccaacctctgcgccgtcgccgtggagtggaagtagtagaaatggtagcttgtcatctgtgtccaatcggaatggtgtagagatgtgctgggttccttagctttggttgttggtcgaatcaagaagtggttgtttggtctcctgctgtaacttatcccattgtatcttcggtaccttggagttgcaatggatcaatgaaatggcaatgggcacagagttatcatg

SEQ ID NO: 26483 - protein, 118 aa, Panicum virgatum
  misc_feature: Ceres CLONE 1869979
  misc_feature (58)..(118): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAVAVEWK

SEQ ID NO: 26484 - DNA, 1058 bp, Panicum virgatum
  misc_feature: Ceres CLONE 1869990
  misc_feature: Encodes the peptide sequence at SEQ ID NO. 26485
accaccagtccaccaccaccaccaccacctcctccgccaccaccacgccgcagccgtttccgcgagaccgcaaacccccgccgcttcgctccagcaacccaccgcatcccggcccgcgcggcagcagcaagcagccagcgttacgaccgccatggccgccgcgcgctacgacgtggagcagggcgggaggggcggggaggggatgtacccgccgccgccgccgccggagcagatgtacccgcaacgggagggggagagggagtgggtgccctggttcgtgccggtcgtcgtggccgccaacatcgcgctcttcgccgtcgtcatgtacggtgctctctcaggaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggtggctacggcggcggcggsggcggctacggaggcggtggtggctacggcggtggtcgccgtgagggcggctacggcggaggcggtggcggcggtcgccgcgagggcggctacggtggtggtggctacggcagccgcggtgactccgtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatg

SEQ ID NO: 26485 - protein, 182 aa, Panicum virgatum
  misc_feature: Ceres CLONE 1869990
  misc_feature (10)..(81): Pfam Name: RRM_1 Pfam Description: RNA recognition motif. (a.k.a. RRM, RBD, or RNP domain)
  misc_feature (48)..(146): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: Useful for making plants with altered terpenoid content
  misc_feature: Useful for making plants with modulated phosphate use efficiency
MAAADVEYRCFVGGLAWATDNASLQQAFASYGDVLDSKVITDRETGRSRGFGFVTFSSEQSMLDAIEAMNGKDLDGRNITVNQAQSRGGGGGGYGGGRQGGYGGGGGGYGGGGGYGGGRREGGYGGGGGGGRREGGYGGGGYGSRGDSVVTGGTDGVALPCWQPSYPIYLLVFVSLFDPSYP

SEQ ID NO: 26486 - DNA, 648 bp, Panicum virgatum
  misc_feature: Ceres CLONE 1869997
  misc_feature: Encodes the peptide sequence at SEQ ID NO. 26487
agccgaactagggtttcttctcgccgccgccttctcgcctccacgcccagattgccggctctacttggtgagccgcacggatggcggaggaagccaatggaaagaaggaggaggaggagatcagcacaggccctctgtcagtgctgatgatgagcgtcaagaacaatacccaggttcttatcaactgccggaacaacaagaagttacttggtcgtgtgagggcatttgatcggcattgcaacatggttcttgagaatgttagggagatgtggactgagataccgaagactggtaaaggcaagaagaaggctcttccggtgaacaaagacaggttcataagcaagatgttcctccgtggggattcagtcatcattgttctcaggaacccgaaatgagttggacaactttgctagcttgctgtctaatctgtatgccaaacactgttccattcgtataagagacgattcttggtggagtgttttagttggatgctgtgatgcacctcttgcgttcactggtactttctatttggcccaatcattatcaaatttagaactccactgttccatttgtcgattcccatttgcaaattgcaaggatggtaatggcatgtgtttgagcaaagcagggtcgtcatacgcccacagt

SEQ ID NO: 26487 - protein, 104 aa, Panicum virgatum
  misc_feature: Ceres CLONE 1869997
  misc_feature (22)..(101): Pfam Name: LSM Pfam Description: LSM domain
MAEEANGKKEEEEISTGPLSVLMMSVKNNTQVLINCRNNKKLLGRVRAFDRHCNMVLENVREMWTEIPKTGKGKKKALPVNKDRFISKMFLRGDSVIIVLRNPK

SEQ ID NO: 26488 - DNA, 722 bp, Panicum virgatum
  misc_feature: Ceres CLONE 1870017
  misc_feature: Encodes the peptide sequence at SEQ ID NO. 26489
gtggtcgccagcgacactgctagtaacctcgacctcccttcctccccagcaaccgatcctcatctccgcctgctgcaacagcagcagcagccatggcggcctccacggcactctccaccgccgccaaccccacccagctctgccgcccccgcgcctctcccaacaagccggccgtcaagggcctgggcctcgggacgggccgggaccgcttctcccagcggcggagcagcagcagcgtcacgtgccaggcggcgagcagcatccccgccgaccgcgtccccgacatcaagttggaggagtggctgcagacgcacgggcccaacgaccgcaccctggcgcaggggctcaagggcgacccgacgtacctggtggtggagcaggacaagacgctggcctcctacggcatcaacgccgtgtgcacccacctcggttgcgtcgtgccgtggaacggcgccgagaacaagttcatctgcccctgccacggatcccagtacaacaaccagggcaaggtcgtccgtggcccggcgcccctgtcgctggccctggtgcacgtcgacgtcgacgacggcaaggtgctcttcgtcccgtgggtggagaccgacttcaggaccggcgaggacccctggtggaaggcataagcggcggcgttgttcctgtctgccatctcagaggacgttacgttactgctggcttccagattatatatgtacacaacaggctgt

SEQ ID NO: 26489 - protein, 181 aa, Panicum virgatum
  misc_feature: Ceres CLONE 1870017
  misc_feature (65)..(157): Pfam Name: Rieske Pfam Description: Rieske [2Fe-2S] domain
  misc_feature: SWISSPROT Homolog: EC 1.10.99.1 Plastoquinol--plastocyanin reductase
MAASTALSTAANPTQLCRPRASPNKPAVKGLGLGTGRDRFSQRRSSSSVTCQAASSIPADRVPDIKLEEWLQTHGPNDRTLAQGLKGDPTYLVVEQDKTLASYGINAVCTHLGCVVPWNGAENKFICPCHGSQYNNQGKVVRGPAPLSLALVHVDVDDGKVLFVPWVETDFRTGEDPWWKA

SEQ ID NO: 26490 - DNA, 605 bp, Panicum virgatum
  misc_feature: Ceres CLONE 1870036
  misc_feature: Encodes the peptide sequence at SEQ ID NO. 26491
atgggaatcacctcctcttcctcctcgaaacaggaatcccggggtatagggctcgtacggggggaggagatcctcccctccccacccgtcgtacctcttcgcaagtcttactgccctttctgcgtccgtgtgaagcagctgttcgagaatctgggagcatgcttcaaggccattgagatggatgtggaaagtgatggagctgagctccaggatgctctcaaggagtggactggacagaggaccgttccaaatgtcttcatcaatgggaagcatattggtggctgcgatgataccatggcactgaacaatgatgggaagctggtgtctctgctaactgaggctggagcgatcaagggttctacttccaagaaaaccgccactgcttagctcgatctgacagttgtcctggttgacatgtttatactgttcccatggtatgatatgaaataacggggctatggttcgcaggtcctgaactttgtgctgtctaagtgtcaagtactatcaggactgtctagtccccctgttgaaccgctcatacatcagtcgagttgcatgcctgcgctaatagtaatgagttcctaatcatgaaccctgtcttcttc

SEQ ID NO: 26491 - protein, 69 aa, Panicum virgatum
  misc_feature: Ceres CLONE 1870036
  misc_feature: Useful for biocontainment applications
MDVESDGAELQDALKEWTGQRTVPNVFINGKHIGGCDDTMALNNDGKLVSLLTEAGAIKGSTSKKTATA

SEQ ID NO: 26492 - DNA, 708 bp, Panicum virgatum
  misc_feature: Ceres CLONE 1870047
  misc_feature: Encodes the peptide sequence at SEQ ID NO. 26493
gccgttgcctccctccaaggcttctccgctcatggcgtccctggcgttctcactggcaggagccttcaagggcctctccctcgcgtccccttcctcttccatgcgccctgacttcctccgcggcgaccgcgccgcgctctccgtcggcggcgccgcggtgggcgtgccggtgccggcgcggcggctgaccatccagatggcgcacaagaagggagccgggagcacaaagaacggccgtgactccaaggggcagcggctgggagtcaagatatacggcgaccaggttgccaagcccggggccatcatcatccgccagcgcggcaccagggtctatcctggaaataatgttggaatgggcaaggatcatacactcttttctttgattgatggactagtcaagttcgagaaatatggaccagacaagaaaaaggtaagtgtctacccatacgagaaacagcctgaaaacccaaaccgttacagagcaagaaagagagagtacttccgcatgcagcgtgaacgcaagaaggcaagagcagagggagccattgagcctcaattggtattagccgctgtagacgaaaactctgaggtcagcacagactgctgataagcttactgtgtagtatttccccttttttttttccacaagccatgtttgatattttctccctaatttgtaagactgcatgatccatttaaagtcatatt

SEQ ID NO: 26493 - protein, 191 aa, Panicum virgatum
  misc_feature: Ceres CLONE 1870047
  misc_feature (57)..(137): Pfam Name: Ribosomal_L27 Pfam Description: Ribosomal L27 protein
  misc_feature: Useful for making plants with modulated biomass
MASLAFSLAGAFKGLSLASPSSSMRPDFLRGDRAALSVGGAAVGVPVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKQPENPNRYRARKREYFRMQRERKKARAEGAIEPQLVLAAVDENSEVSTDC

SEQ ID NO: 26494 - DNA, 729 bp, Panicum virgatum
  misc_feature: Ceres CLONE 1870064
  misc_feature: Encodes the peptide sequence at SEQ ID NO. 26495
aagtctccagttcttccggcgcgcgtaactctccactccatggaagaccagagccccaagcccatccgctgcaaagctgcggtgtgcagagccgccggcgagccgctcatcgtcgaggagatcgtcgtcgatccaccgaaagcgtacgagatccgcatcaagatcatctgcacctcgctctgccacagtgacatcaccttctggcgaggcaaggcagcaacagcttttccaagaatcttaggccacgaagcctacggggttgtggagagcgtgggggagcatgtggagggcttcgccgccggcgacacggtggtgccgacgttcatggggcagtgcgaccgctgcccgggctgcgcttccgagcacaacaacctctgcaccacggtgcccttcgtgttcggccccgggatgcggcgcgacggcaccacccggttccgggacgcccaggggaaccccctccacgacctggtcgccgtgtccagcttcagccagtacaccgtcgtggacgtgacccaggtcgtcaggatcgaccccgccgtgccgcccaagctcgcctgcctcctcagctgcggcgccagcaccggggtgggagctgcatggagggtggccaaggtggaaccaggctcatcagtggccatctttgggctggggtccgttgggttagcggtgggcgcaggtgcgaaaatgtgcggagcatccaagattatcggcgttgacatgaaccctgac

SEQ ID NO: 26495 - protein, 229 aa, Panicum virgatum
  misc_feature: Ceres CLONE 1870064
  misc_feature (35)..(163): Pfam Name: ADH_N Pfam Description: Alcohol dehydrogenase GroES-like domain
  misc_feature: SWISSPROT Homolog: EC 1.1.1.1 Alcohol dehydrogenase
  misc_feature: Useful for making plants with modulated heat sensitivity
MEDQSPKPIRCKAAVCRAAGEPLIVEEIVVDPPKAYEIRIKIICTSLCHSDITFWRGKAATAFPRILGHEAYGVVESVGEHVEGFAAGDTVVPTFMGQCDRCPGCASEHNNLCTTVPFVFGPGMRRDGTTRFRDAQGNPLHDLVAVSSFSQYTVVDVTQVVRIDPAVPPKLACLLSCGASTGVGAAWRVAKVEPGSSVAIFGLGSVGLAVGAGAKMCGASKIIGVDMNP

SEQ ID NO: 26496 - DNA, 720 bp, Panicum virgatum
  misc_feature: Ceres CLONE 1870111
  misc_feature: Encodes the peptide sequence at SEQ ID NO. 26497
acgtaaccacgtctcctccgccgccccgcttcctcctgcctccttgctaagcaaacccccgcttttcctcctccgccctgcacgcgcgcgcctcgcgaaatcccccctccctcgccgccgctcgccattccccgccccggaggaagccagccagccccgccggagatgtcgtacgcctacctcttcaagtacatcatcatcggcgacacaggcgtcggcaagtcgtgcctgctgctgcagttcaccgacaagcgcttccagcccgtgcacgacctcaccatcggcgtcgagttcggggcgcggatgatcaccatcgacaacaagcccatcaagctccagatttgggacacggcaggccaagagtcattcagatccataactagatcatactacagaggggccgcaggttctcttttggtctatgatatcaccaggagggagactttcaatcacctcgcaagctggctggaggatgcgaggcagcacgccaacgccaacatgacgataatgctggttgggaacaaatgtgatctgtctcacaggcgtgcagtgagctacgaggaaggcgagcagtttgcaaaggaacatggcctgatcttcatggaggcatctgcaaaaaccgcacaaaacgtcgaggaggtatttgttaagactgctggagcgatctacaagaaaatccaagatggtgttttcgatgtatctaatgagtcttatggaatc

SEQ ID NO: 26497 - protein, 184 aa, Panicum virgatum
  misc_feature: Ceres CLONE 1870111
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
MSYAYLFKYIIIGDTGVGKSCLLLQFTDKRFQPVHDLTIGVEFGARMITIDNKPIKLQIWDTAGQESFRSITRSYYRGAAGSLLVYDITRRETFNHLASWLEDARQHANANMTIMLVGNKCDLSHRRAVSYEEGEQFAKEHGLIFMEASAKTAQNVEEVFVKTAGAIYKKIQDGVFDVSNESYG

SEQ ID NO: 26498 - DNA, 687 bp, Panicum virgatum
  misc_feature: Ceres CLONE 1870198
  misc_feature: Encodes the peptide sequence at SEQ ID NO. 26499
gcactcgcccttatcatccatccaccctccgtcctccctcccctccctcgcccatcccccaccacgccggcccaccgccctcgccatcccactccgttcccccctcagttttcccactcggttgcagttgctgcgagcagtcaccaccgccgccgctgccgcgcacacaaaccagcggcaataaacacctcccccgcccccctcgcctcgctcccaacctccgattcgagggcgccgcgatcgcgatcggacccgtccgcggctggaatcgtcgaggagccgagagggatcggattggtggggggagagagagagagagaggggggcggcgatggggcggctgttcctgacgcacctggacggcaacgtctacagctgcaagcactgcaagacccacctcggccttgccagcgacatcatctccaaggccttccacagcaagaacgggaaggcctacctcttccataaggttgtcaatgtgactcctggagtaaaagaagaccgcatgatgataacaggaatgcatactgtttctgatatcttctgtgtttgctgtggatccattgttggatggaaatatgaagccgcacatgagaagaaccagaggtacaaggaaggaaagtatattctggagaggttcaaggtggcaggcccagacggaagccagtactggaatgcacatgatgc

SEQ ID NO: 26499 - protein, 118 aa, Panicum virgatum
  misc_feature: Ceres CLONE 1870198
  misc_feature (1)..(108): Pfam Name: Yippee Pfam Description: Yippee putative zinc-binding protein
MGRLFLTHLDGNVYSCKHCKTHLGLASDIISKAFHSKNGKAYLFHKVVNVTPGVKEDRMMITGMHTVSDIFCVCCGSIVGWKYEAAHEKNQRYKEGKYILERFKVAGPDGSQYWNAHD

SEQ ID NO: 26500 - DNA, 611 bp, Panicum virgatum
  misc_feature: Ceres CLONE 1870223
  misc_feature: Encodes the peptide sequence at SEQ ID NO. 26501
tatggaggggaaagtgtgtggtgttacatctgaaggtgaaactgcaaagtgcaagaaggtggtctgtgatccttcgtatttacccaacaaggttaggaagataggtagggttgtacgtgcaattgctatcatgtgccacccaatccctaatacaaatgagtcccactcagttcacattattttgccacagaaacaacttggacacagatcagacatgtatgttttctgttgctcatacacacacaatgttgcgccaagaggaaagttcattgcatttgtgtctgcagaagacgagactgataacccccagtccgagctaaagcctggacttgatctacttggccctgtagatgagatattttatgatatttatgacagatatgaaccagtgaatgaaccgtctcttgataattgctttgtctcaacgagttatgatgccaccacacattttgagacaaccgtgacagatgttcttaacatgtatacgatgatcactggaaagacggttgatcttagtgtggatttgagtgctgccagtgctgctgaataatactagatttctcaatcattacctcatgttcatcaaagaagcacatcgtcagggacagcac

SEQ ID NO: 26501 - protein, 182 aa, Panicum virgatum
  misc_feature: Ceres CLONE 1870223
  misc_feature (1)..(177): Pfam Name: GDI Pfam Description: GDP dissociation inhibitor
MEGKVCGVTSEGETAKCKKVVCDPSYLPNKVRKIGRVVRAIAIMCHPIPNTNESHSVHIILPQKQLGHRSDMYVFCCSYTHNVAPRGKFIAFVSAEDETDNPQSELKPGLDLLGPVDEIFYDIYDRYEPVNEPSLDNCFVSTSYDATTHFETTVTDVLNMYTMITGKTVDLSVDLSAASAAE

SEQ ID NO: 26502 - DNA, 375 bp, Panicum virgatum
  misc_feature: Ceres CLONE 1870229
  misc_feature: Encodes the peptide sequence at SEQ ID NO. 26503
atccacctcgcccacccgtctgccgtctgactgcccgttcttgcatgcttgatactcgcatccagcttggctggcagtggcagctgatccttcggccggccggtcatgagctaccaagcaggctacccgcctcccggcaccgcctcgttccctccgccggggcagcatgcggcctaccgcgcgcccccaccccaggcccacctcgcgccgccgcccgcgtaaccaccgtcccaagacgacgccggcgcgcaccgccagcaccccctgctccaaaccgcgatcccccctgcctacggggactggaaaggacgcttgaccctccgtctgccgctggtgcgtcctccacgcgtgcttctgaggacgacaaccgaactt

SEQ ID NO: 26503 - protein, 38 aa, Panicum virgatum
  misc_feature: Ceres CLONE 1870229
  misc_feature: Useful for making plants with altered cell wall content and/or composition
MSYQAGYPPPGTASFPPPGQHAAYRAPPPQAHLAPPPA

SEQ ID NO: 26504 - DNA, 750 bp, Panicum virgatum
  misc_feature: Ceres CLONE 1870249
  misc_feature: Encodes the peptide sequence at SEQ ID NO. 26505
atctgtagccttcgccagcgccggaagttaaagaacaaagaagaggacgccccggccgcaactcccctagacgaagaagagacccttgggctgacgtcgagcggagaaggcgagagaagatggggaagggcgtcctggaggtgcacctcgtcgacgccaggggcctctccggcagcgatttcctagggaagatcgacccctacgtgatcgtgcagtaccggagtcaggagcgcaagagcagcgtcgcccgagaccaggggaggagcccgtgctggaacgaggtgttcaagttccagatcaactcttcggcgtccagcgcgcagcacaagctcatcctccggatcatggaccacgaccacttctccagcgacgacttcctcggcaaggctacgatcgacgtgacggacatcatcagcttgggcgcggagcgcggctcgtaccacctcaacgcggggaagcacaacgtggtcctcgccgacagcacgtaccacggcgagatcaaggtcggcatcaccttcaccgccgcccaggttgaggaagatgatgaggattttggaggctggaggcgcagaagctccaatgcgtaggtgcggtgaaatctgaagaagttctttggttggtttgtagtgtagtaattcaggtcgggtgtagtttttgtcgtttgtactggcagaagtttgtgcccaagattgttgattggctggttagactatgtgtaatcaagtatgcttaaagccgttgttgattgac

SEQ ID NO: 26505 - protein, 155 aa, Panicum virgatum
  misc_feature: Ceres CLONE 1870249
  misc_feature (6)..(91): Pfam Name: C2 Pfam Description: C2 domain
  misc_feature: SWISSPROT Homolog: EC 3.1.1.4 Phospholipase A(2)
MGKGVLEVHLVDARGLSGSDFLGKIDPYVIVQYRSQERKSSVARDQGRSPCWNEVFKFQINSSASSAQHKLILRIMDHDHFSSDDFLGKATIDVTDIISLGAERGSYHLNAGKHNVVLADSTYHGEIKVGITFTAAQVEEDDEDFGGWRRRSSNA

SEQ ID NO: 26506 - DNA, 720 bp, Panicum virgatum
  misc_feature: Ceres CLONE 1870304
  misc_feature: Encodes the peptide sequence at SEQ ID NO. 26507
acccccgcatcgcgcccgcccgggccgccttctcttctccagcgtccgatctcccactcgccgccctcaccgcagctccctccgctcggtcgcttccccacctccgccttccccgcgcgcgcgcgcgcccgccacctcgccctccttccctccacgtcgcgcgcgcccgcccttatataagtgcgggaggagcgcatggcggacgcgccagcgagccccgggggcggcggcgggagccacgagagcgggagccccaggggcggcgccgggggcgggggcggcggcgtcagggagcaggacaggttcctgcccatcgccaacatcagccgcatcatgaagaaggccatcccggccaacgggaagatcgccaaggacgccaaggagaccgtgcaggagtgcgtctccgagttcatatccttcatcaccagcgaggcgagtgacaagtgccagagggagaagaggaagaccatcaacggggacgacctactgtgggccatggccacgctggggttcgaggactacatagaacccctcaaggtgtacctgcagaagtacagagagatggagggtgatagcaagttaactgcaaaaactggcgatggctctattaaaaaggatgcccttggccatgggggagcaagtagctcagccacacaagggatgggccaacaaggagcgtacaaccaaggaatgggttatatgcaacctcagtaccataac

SEQ ID NO: 26507 - protein, 174 aa, Panicum virgatum
  misc_feature: Ceres CLONE 1870304
  misc_feature (36)..(101): Pfam Name: CBFD_NFYB_HMF Pfam Description: Histone-like transcription factor (CBF/NF-Y) and archaeal histone
  misc_feature: Useful for making plants with modulated drought sensitivity
  misc_feature: Useful for making plants with modulated water use efficiency
MADAPASPGGGGGSHESGSPRGGAGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKTGDGSIKKDALGHGGASSSATQGMGQQGAYNQGMGYMQPQYH

SEQ ID NO: 26508 - DNA, 463 bp, Panicum virgatum
  misc_feature: Ceres CLONE 1870309
  misc_feature: Encodes the peptide sequence at SEQ ID NO. 26509
ccttatcatttggagtgcacggcactgcggggcgcgcgggtcgacgctgcggggcgatgctgctggcgggcgcctgcggggtgctgctgcggcgagtgccaactgccactacgacgcgcgctgcaagaacctctacatcattgccggcaagaggcatcaagggcacgctcaaccggcctggctgccgcctgcgtgggcgaccgcccaggcccaccatcaagaatgccaagcccgcacctcaggaagaaggccatgcccgacggcatcctccgccaacacattgccgtggggccgcgatgactgagtctacatgatacttcgaatataatgactggggttattagtataacccaaaaggctacatgaaaggatctgctatcactggaccaattgggaacgattgtgctgatctttggcctacgattgctactgcatcaaacgccatagcctaaaatcaggattt

SEQ ID NO: 26509 - protein, 29 aa, Panicum virgatum
  misc_feature: Ceres CLONE 1870309
  misc_feature: Useful for making plants with modulated biomass
  misc_feature: Useful for making plants with modulated heat sensitivity
MKGSAITGPIGNDCADLWPTIATASNAIA

SEQ ID NO: 26510 - DNA, 730 bp, Panicum virgatum
  misc_feature: Ceres CLONE 1870333
  misc_feature: Encodes the peptide sequence at SEQ ID NO. 26511
gccatgtggaagcgcgccacctgcctcctcctccgccaccaccgcttcgccctggccccccaatccccggcggtctccgccgccgccgcgcctggactctgccgggcgccggcgcccctcttcttctccactcttgatgcggctggtaagaggacgagggtggaagacgtgatgccgatcgccacggggctcgagcgcgaggagatcgaggccgagctccagggaaagaagagattcgacatggacgcgcccgtcggtccctttggcaccaaggaagctcctgctgtgattcagtcatactacaacaaaaggattgttggttgccctggtggtgaaggagaagatgagcatgatgtggtgtggttttggttggagaaaggcaaaccacatgaatgcacagtctgtactcaatatttcatgcttgatgtgattggaggaggatcccctgatggacatgatgacgatgatcaccaccattaaggttctgtaggctatggcaataaaatgggggtgcaaataccatttttgtcacagcgttgtgaagctgtggaaaactcagcatttgggcattatagagttcggtagaccatgtcaacccgattgccccacggcttggaagctggaaacaggacatggtttgtaagacataaaagtcacttcattaaatcggctatacaaataacttagacaacgctgtacttttgcccatcaacacatgttctgctgaatc

SEQ ID NO: 26511 - protein, 158 aa, Panicum virgatum
  misc_feature: Ceres CLONE 1870333
  misc_feature (49)..(148): Pfam Name: COX5B Pfam Description: Cytochrome c oxidase subunit Vb
  misc_feature: SWISSPROT Homolog: EC 1.9.3.1 Cytochrome-c oxidase
MWKRATCLLLRHHRFALAPQSPAVSAAAAPGLCRAPAPLFFSTLDAAGKRTRVEDVMPIATGLEREEIEAELQGKKRFDMDAPVGPFGTKEAPAVIQSYYNKRIVGCPGGEGEDEHDVVWFWLEKGKPHECTVCTQYFMLDVIGGGSPDGHDDDDHHH

SEQ ID NO: 26512 - DNA, 723 bp, Panicum virgatum
  misc_feature: Ceres CLONE 1870335
  misc_feature: Encodes the peptide sequence at SEQ ID NO. 26513
  misc_feature (633)..(633): n is a, c, t, g, unknown, or other
attcttgactcttccccgccttcctctgctcgctcgtccgctcctctctcccccgtcaccgtccatggcggcgtcctcctccgcctccgcctcgccgctcctcctcccctcagggtcgaggcgtgcgtcggcgtcgagggcgcggctccgcggcggcggcgcgtccaggagcagggcgctgggctcagaggcgccgtgctgctgcaaggccctcgccgccgccggaaacgcggcacaatgcggggcggctgacagtttcgtgatcagcagcgggagtagcaccaggagggggctcctaggggtggccctgggagcgtctgccctggggctcgccgcgctcgatgccgtcgccgccgggctgccgccggaggagaagcccaagctctgcgacgccgcctgcgaaagcgagctcgaaaatgtgcctatggtaaccacagaatccggcctgcagtacaaggacatcaaagtgggcgaagggccaagcccacccgttggtttccaggttgctgcaaactatgttgccatggtaccgaatgggcagatattcgacagttcactagagaaaggtcagccctacatattccgggtcggatcaggacaggtgatacaggggcttgatgaaggaattttgtncatgaaggttggaggactacgtcggttgtacatacctggaccattagcgtttccaaagggtcttacttcagctccaggaaggccaagggt

SEQ ID NO: 26513 - protein, 219 aa, Panicum virgatum
  misc_feature: Ceres CLONE 1870335
  misc_feature (136)..(212): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature (190)..(190): Xaa is any aa, unknown, or other
MAASSSASASPLLLPSGSRRASASRARLRGGGASRSRALGSEAPCCCKALAAAGNAAQCGAADSFVISSGSSTRRGLLGVALGASALGLAALDAVAAGLPPEEKPKLCDAACESELENVPMVTTESGLQYKDIKVGEGPSPPVGFQVAANYVAMVPNGQIFDSSLEKGQPYIFRVGSGQVIQGLDEGILXMKVGGLRRLYIPGPLAFPKGLTSAPGRPR

SEQ ID NO: 26514 - DNA, 672 bp, Panicum virgatum
  misc_feature: Ceres CLONE 1870362
  misc_feature: Encodes the peptide sequence at SEQ ID NO. 26515
attcgcctttccgcacccgccgctcggtcgccttcgagttccaccagccaccaaacccgccggggagaagtcgagaggagcaagtcgccgagaagaggagagatggcccgtacgaagcagaccgcccgcaagtccaccggagggaaggcccctcgcaagcagctcgccaccaaggttcgttcgcgtctctctctctcgtgttcctccgttccgatctgctctgttctcgccgagatttggcggttgttgggcgcaagttgtcctgagaagcggttgcgatttgttgcgcaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggctctccaggaggccgccgaggcctacctcgtcgggctattcgaggacaccaacctctgcgccatccacgccaagcgcgtcaccatcatgcccaaggacatccagctcgcccgccgcatccgcggcgagcgcgcgtaagccgcagccgccgctgccgtaccggtagtggagatgtaggag

SEQ ID NO: 26515 - protein, 175 aa, Panicum virgatum
  misc_feature: Ceres CLONE 1870362
  misc_feature (97)..(171): Pfam Name: Histone Pfam Description: Core histone H2A/H2B/H3/H4
MARTKQTARKSTGGKAPRKQLATKVRSRLSLSCSSVPICSVLAEIWRLLGASCPEKRLRFVAQAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 26516 - DNA, 805 bp, Panicum virgatum
  misc_feature: Ceres CLONE 1870371
  misc_feature: Encodes the peptide sequence at SEQ ID NO. 26517
ctgcacgccggccggtcgccgtgacggcgtcacctctctctcccccgcgaaaaccctaatggcgtcgcgcctcctccacctccgccgcctcctaactccacgccccaccctccatgccgccgcgttctccaccgccgccaccccgaccccgcgcgtctccgggatcgtcgacgagatctgcggcctcactctcctcgaggcctcctccctcgccgacgccctgcgcggccgcctcggcgtcgaccagctccccccgctggccatcctcacgggcggcgccgtcccgctcgccggaggagcagcgggacccggggcggccggcgaggaggccaaggcgaaggaggagaagatggcgttcgacgtgaagctggaggggttcgacgccgcggcgaagctcaagatcatcaaggagctcagggcgttcacgaatttggggttgaaggaggcgaaggagctcgtggagaaggcgccggccgtgctgaaggcaggagtgcccaaggaggaggcggagagtatcgccgagaagatgcgagcggtcggcgccaagatcgttctcgagtgagacgacgagagctctgtatggcctcgtttcttgatttgttttatcttaattgtacgaagaaactgatagaattttggaacaaggaagcaataattagtgagattgactgtggagatattttcattgccggtggaaatgccaattgggctttggggaatagtcttagatttagcaatattgcttcgagctctgtatcttggttgtttgttttatggtatgaaaaatagagattcttttactcac

SEQ ID NO: 26517 - protein, 167 aa, Panicum virgatum
  misc_feature: Ceres CLONE 1870371
  misc_feature (100)..(167): Pfam Name: Ribosomal_L12 Pfam Description: Ribosomal protein L7/L12 C-terminal domain
MASRLLHLRRLLTPRPTLHAAAFSTAATPTPRVSGIVDEICGLTLLEASSLADALRGRLGVDQLPPLAILTGGAVPLAGGAAGPGAAGEEAKAKEEKMAFDVKLEGFDAAAKLKIIKELRAFTNLGLKEAKELVEKAPAVLKAGVPKEEAESIAEKMRAVGAKIVLE

SEQ ID NO: 26518 - DNA, 562 bp, Panicum virgatum
  misc_feature: Ceres CLONE 1870396
  misc_feature: Encodes the peptide sequence at SEQ ID NO. 26519
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcaacatcaccgtcaacgatgcccagtcccacggcggcccgcgctccggcggcgggagcgcgccggtacgggtgccgcctgtgcctgcgccgctacaacgcaagtcggaggggttccgactgcaccacctcgtgacgggcgctgagaagctggtggagaaggatggccgccaactggagagcgcctgcagcctcgccggtgggctgtttatgatggcccacgggttcctacagtagag

SEQ ID NO: 26519 - protein, 154 aa, Panicum virgatum
  misc_feature: Ceres CLONE 1870396
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with modulated biomass
MAASDVEYRCFVGGLAWATDDNSLHNAFSPFGEVLESKIILDRETQRSRGFGFVTFSSEQAMRDAIEGMNGKELDGRNITVNDAQSHGGPRSGGGSAPVRVPPVPAPLQRKSEGFRLHHLVTGAEKLVEKDGRQLESACSLAGGLFMMAHGFLQ

SEQ ID NO: 26520 - DNA, 633 bp, Panicum virgatum
  misc_feature: Ceres CLONE 1870400
  misc_feature: Encodes the peptide sequence at SEQ ID NO. 26521
gtcgggttgggggtcgccgcgtcgcctgcttccagtttcttcctccctgaaccctcgccgccgccgccgccgctccgggtccgtgcccctgccggcgccgccgccgccaaaagagggaaaatagggaggatggccggcgctctcgacttgtccctcgacaacctcttctccaaaaacaaaaaaacccagccgcgccccagcggccaaggcccgacctcgggaggcggaggccccgcacccacggggccgcgccgtcgcttcaacgcccgcgcagccgcagccccgtaccaccgcggcaccattttccttttccaggcgcaggcgcggcggcccttggtttatgctggatacggagccccccagccccagccgccaatggacccgcccaccaagttttacttctccaacctcgactatggcgtctccaacaacaacttcaaggaattattttctgatgtcggcaatatccagcgttcctccttcaactatgacaggattggaaaatcaaagggaaccgcaaaggttgtcttctcaagaaggtctgatgttctagctgctcttaggaggtacaacattgtgcagcttgatggcaaacttatgaaaattgagatcattggaacaattattgagggc

SEQ ID NO: 26521 - protein, 167 aa, Panicum virgatum
  misc_feature: Ceres CLONE 1870400
  misc_feature (89)..(159): Pfam Name: RRM_1 Pfam Description: RNA recognition motif. (a.k.a. RRM, RBD, or RNP domain)
MAGALDLSLDNLFSKNKKTQPRPSGQGPTSGGGGPAPTGPRRRFNARAAAAPYHRGTIFLFQAQARRPLVYAGYGAPQPQPPMDPPTKFYFSNLDYGVSNNNFKELFSDVGNIQRSSFNYDRIGKSKGTAKVVFSRRSDVLAALRRYNIVQLDGKLMKIEIIGTIIE

SEQ ID NO: 26522 - DNA, 707 bp, Panicum virgatum
  misc_feature: Ceres CLONE 1870409
  misc_feature: Encodes the peptide sequence at SEQ ID NO. 26523
atcgcactcagcaatcttgccgagcaatccctcgtcgaatccaccagcgaagcaaatccccagccttcctcgcccgctcccccgatggcccgcacgaagcagacggcgaggaagtccaccggcggcaaggcgccaaggaagcagctggcgacgaaggcggcgcgcaagtcggccccggcgaccggcggcgtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctccgcttccaaagctcagccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggcgagagggcctaggcgccgtcgccgtggagtggaagtagtacaaatggtagcttgtcatctgtgtccaatcggaatggtgtagtgatgtgctgggttccttagctttggttgttggtcgaatcaagaagtggttggttggtctcctgctgtaatttatcccattgtatcttctgtaccttggagtggcaatggatgcatgaaatgggcatgggcaccgagttatc

SEQ ID NO: 26523 - protein, 136 aa, Panicum virgatum; identical to SEQ ID NO: 10238
  misc_feature: Ceres CLONE 1870409
  misc_feature (58)..(132): Pfam Name: Histone Pfam Description: Core histone H2A/H2B/H3/H4

SEQ ID NO: 26524 - DNA, 685 bp, Panicum virgatum
  misc_feature: Ceres CLONE 1870427
  misc_feature: Encodes the peptide sequence at SEQ ID NO. 26525
tgctgagatgagggacaatgaacagagttcggaagcaaaaagtgcacctgaggaactggttcagcaggtgctaagtgccggatggagagagggcctaaacatagcatgtgaaaatgcactcagtcgctatgatgccacagcttacaacacaatcctcaggaatgcaagaccacaaggaatcaacaagaatggccctcctgaacacaagttgtacgggttcacctacctccgagtatcgagtgagctccttgaaggacaaaactatgccactttcaaaacttttgtcaggagaatgcatgctaacctggattacaacgcaaatattgatccacttgcacctatggaaagatcaaagccagaaataccaatcgaaaaaatcctggaagtagcacagccaaagttggagccatttcctttcatcgagaacacagatctaccaatttaaacatcccaatggttcaatctactggaaggggcacaaggaactttaaaaagcaagacagacacagcaagcctattgtcgaacaatatgctgaaaccaaataaactgctatgttaagcagactacaatcatgttgcaccaataatcttgtgttgttcaacctgaggcttgatgcttgtctaatgagctgtaataccttggccttcacattgttgtatgtatttgagctaatgaataaaaatg

SEQ ID NO: 26525 - protein, 147 aa, Panicum virgatum
  misc_feature: Ceres CLONE 1870427
  misc_feature: SWISSPROT Homolog: EC 3.2.1.2 Beta-amylase
AEMRDNEQSSEAKSAPEELVQQVLSAGWREGLNIACENALSRYDATAYNTILRNARPQGINKNGPPEHKLYGFTYLRVSSELLEGQNYATFKTFVRRMHANLDYNANIDPLAPMERSKPEIPIEKILEVAQPKLEPFPFIENTDLPI

SEQ ID NO: 26526 - DNA, 630 bp, Panicum virgatum
  misc_feature: Ceres CLONE 1870428
  misc_feature: Encodes the peptide sequence at SEQ ID NO. 26527
aggaacggctccgcctctcgccgcctagctcgcggtctcgcaccatttccttcgctccaagaaaaggcgctgccatggccatggcggcgctgcgcggggcctcccgctgcctggcgccaagggggagcgccgtggccgcgcggcccatgctcctggcgcactcgcgcggaatcacctacaagctcttcattggaggcttatcacagtttgcaacggaagacagcctagcagaagcgttctctcgttacggccaagtaatagaagctacgatcatcacggataaggtgaccaacagaccaaaggggtttggcttcgtgaaatttgcttccgaggaagaagccaataacgcgagggaagagatgaacggcaaggtactgaatggccgtgtgatctacgtcgacattgcaaaggccaaactggaccgggatgtagatgccctgccaatagcgacaggccctcctaagccaattggcaacgactgaaaaagaatggcctggtgtgtagactccatacttctcctctgctcctctctgctgtactagttcactcctcatattcggaagctctagatatggagtgatgtttaataatgtgtcgaggttttgcgagaatacaaatcaagtccactta

SEQ ID NO: 26527 - protein, 135 aa, Panicum virgatum
  misc_feature: Ceres CLONE 1870428
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated cold sensitivity
MAMAALRGASRCLAPRGSAVAARPMLLAHSRGITYKLFIGGLSQFATEDSLAEAFSRYGQVIEATIITDKVTNRPKGFGFVKFASEEEANNAREEMNGKVLNGRVIYVDIAKAKLDRDVDALPIATGPPKPIGND

SEQ ID NO: 26528 - DNA, 675 bp, Panicum virgatum
  misc_feature: Ceres CLONE 1870438
  misc_feature: Encodes the peptide sequence at SEQ ID NO. 26529
aatccggcaatcccccccagtcgctggcagccgcaagcgccgtgctcgtcgccgtccgccgctcgtcttcgtcccgcacggccgccaggcgagctgcgacttcgaccgcaaccacacaccagcagcgcaagaggttgattatcagttgggttctgattttgggatttgtggctcttgtattgaggtggcaaactaaaacagtcaacaaccatgcaggctagcgatcggttcaacataaattctcagcttgagcatcttcaagccaaatatgttggcacaggacatgcggacttgaccagatttgaatgggctgtaaacattcagagggacagctatgcctcttatattgggcactatccaatgttggcatattttgctattgctgaaaatgaatcaattggaagagagcgttacaattttatgcagaaaatgctgcttccatgcggcctccctcctgagagagatgaagactgaggagcctctacacgatccttatgcatcacaacagtagcttgtgttgaacttaggttcgctaccggagtaaaaggggggcacactagaatggccacgctagtaatatctgtggctgtgcttgaaatttgaattccctgatcatgcattgcacgcttttggcttaaacgacacggatctttctcatgaaatcccgaattttca

SEQ ID NO: 26529 - protein, 87 aa, Panicum virgatum; identical to SEQ ID NO: 15474
  misc_feature: Ceres CLONE 1870438
  misc_feature (5)..(87): Pfam Name: SF3b10 Pfam Description: Splicing factor 3B subunit 10 (SF3b10)

SEQ ID NO: 26530 - DNA, 574 bp, Panicum virgatum
  misc_feature: Ceres CLONE 1870440
  misc_feature: Encodes the peptide sequence at SEQ ID NO. 26531
agcagtacaagaagcacaagaaaaaacacttgtagccatcagcttcttcttcttcttcttcttcaccgtcatcaagtcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcagagacaagcccgacgccgacatccgcgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccgatcagggttagaaatatcggccgcaatttcacgagatacccgatatatcgggtttatcggtggggtctgatattttttttatcggccgaaattgatttaatgaatattttttatactaaaaagtaaattag

SEQ ID NO: 26531 - protein, 74 aa, Panicum virgatum
  misc_feature: Ceres CLONE 1870440
  misc_feature (15)..(74): Pfam Name: potato_inhibit Pfam Description: Potato inhibitor I family
MSSSAEAADQCGGGKTSWPEVVGMSIEEAKKVILRDKPDADIRVLPVGTPVTRDFRPNRVRIFVGTVAQTPHVG

SEQ ID NO: 26532 - DNA, 722 bp, Panicum virgatum
  misc_feature: Ceres CLONE 1870456
  misc_feature: Encodes the peptide sequence at SEQ ID NO. 26533
gtaagtagcattacgccaagcaacatcagacagtagcagtagctagacagtaatgggtttcagcgaggctcaggaagagctcgtcctgcgctcatggaaagccatgaagaaggacgccgaatccatagctctcaagttcttcttcaggatctttgagatcgcgccgggcgccaagcagatgttccccttcctgcgcgacgccggcgacgcgcccctggagaaccaccccaagctcaaggcgcacgccgtggccgtcttcgtcatggcttgcgagtccgcgacgcagctgaggaacaccggcgacgtgaaggtgagggaggcggcgctgaagcggctgggcgcgacgcacgtcaaggccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacgccgccgccgcctgagttcgtcgtgaagaccttaacactctgtcacacgcatcccctgctgctgcgaagaacgcgcgttgctggggagagcttggagctgccactgctgctggctgctgctactccacgaagatgtcgctactactagagtactagtccactactgtgttctgtttttgtcagtgccagccacgtcattgatgaataaaac

SEQ ID NO: 26533 - protein, 157 aa, Panicum virgatum
  misc_feature: Ceres CLONE 1870456
  misc_feature (7)..(117): Pfam Name: Globin Pfam Description: Globin
  misc_feature: SWISSPROT Homolog: EC 1.14.12.17 Nitric oxide dioxygenase
  misc_feature: Useful for making plants with modulated cold sensitivity
  misc_feature: Useful for making plants with modulated salt sensitivity
MGFSEAQEELVLRSWKAMKKDAESIALKFFFRIFEIAPGAKQMFPFLRDAGDAPLENHPKLKAHAVAVFVMACESATQLRNTGDVKVREAALKRLGATHVKAGVADAHFEVVKTALLDTIRDAVPDMWTPEMKAAWEEAYDQLAAAIKEEMKNAAAA

SEQ ID NO: 26534 - DNA, 702 bp, Panicum virgatum
  misc_feature: Ceres CLONE 1870462
  misc_feature: Encodes the peptide sequence at SEQ ID NO. 26535
aaatcgatcggagcacaacagaagccacacgctcacaagacacaagcaagcaagcatctgaggagaagccggccgccgatttccccagcccgtgcattgttcccgatggcgaccatggtgatggcctccgccgcgagctccctcgccttcgccgccaccggcgcgagcgccggccgcttccccgcccggcttccggcggcggcggggctcgcgccgcgccggcgcgcaccgctcgtcagggcgcaggctaataagggtcctgagaagccggcagcgagcccggggctctgggacgcgctggcgttcagtggccccgcgccggagcggatcaacgggcgcctcgccatggtgggcttcgtgtccgcgctcgccgtcgaggcggcccgcggggacggcctcctcgcgcaggtcggcaacggcgccgggctcgcgtggttcgcgtacacggccgtcgtgctgtccgcggcgtcgctggcgccgctgctccagggggagagcgccgaggacaggagcggcggcttcatgaccgccgacgccgagctctggaacggccgcctcgccatgctcggcctcgtcgcgctcgctgccaccgagtacctcaccggcgcgcctcttgtcaacgtgtaaatacggcgtacattacgtacgcatacgtgtagctgtatgtgtagaggcggtagtgtatatacgtgtgtatttgta

SEQ ID NO: 26535 - protein, 173 aa, Panicum virgatum
  misc_feature: Ceres CLONE 1870462
  misc_feature (49)..(164): Pfam Name: Chloroa_b-bind Pfam Description: Chlorophyll A-B binding protein
  misc_feature: SWISSPROT Homolog: EC 4.99.1.1 Ferrochelatase
MATMVMASAASSLAFAATGASAGRFPARLPAAAGLAPRRRAPLVRAQANKGPEKPAASPGLWDALAFSGPAPERINGRLAMVGFVSALAVEAARGDGLLAQVGNGAGLAWFAYTAVVLSAASLAPLLQGESAEDRSGGFMTADAELWNGRLAMLGLVALAATEYLTGAPLVNV

SEQ ID NO: 26536 - DNA, 488 bp, Panicum virgatum
  misc_feature: Ceres CLONE 1870473
  misc_feature: Encodes the peptide sequence at SEQ ID NO. 26537
attacccctcaaacatacaagaagaagcagcattcgaagtgcttacatcttgtggtatatatctctgaagaagatgagcagctcggcagttggtgatggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggagcgttctggtatgccattaaaattgttatgtttcggatatacaccattattatttgcaatatcagaaacatgctattac

SEQ ID NO: 26537 - protein, 76 aa, Panicum virgatum
  misc_feature: Ceres CLONE 1870473
  misc_feature (17)..(76): Pfam Name: potato_inhibit Pfam Description: Potato inhibitor I family
MSSSAVGDGKGCDATPKTEWPELVGSTIKEATEKINAERPDLNVEPVPVGTIVPQDFDPKRVRLWVDTVAEVPRIG

SEQ ID NO: 26538 - DNA, 673 bp, Panicum virgatum
  misc_feature: Ceres CLONE 1870478
  misc_feature: Encodes the peptide sequence at SEQ ID NO. 26539
atcagtccatcagcaagctaagcactacacctagtagctgaaacgccacctgagacaaaggttatctgaacattcagccaggaaagcatcagaagcaaccatggtcagtgccaagagacttgttcaaatggcgaagaagtggcaaagaatggcggccctcgcgaggagaaggatcacgtcgccggcgaaagagaccgaagggtcgtcgtgcagcacttcgtcggtggccggcaagggccactgcgttgtgtacttggccgacggccggcggttcgaggtcccgctggcgtaccttaacacggcgatcttcggcgagctcctgagcctgtcgcaggaggagttcgggttcgccggcgacgacggcaggatcacactgccctgtgaagctgccgtgatggagtacgtcatgtgcttgctccggagaaacgcatcagaggaggtcgaggcggctttcctgacctccatagcgaggccgtgccactatggaagcggcttggcgcaatccattggagttagccagcaacttgctgtttctagcttctgaagaacacagcattgagcttgtcttctccttctagctccagcacgatgtatgtaaattgttacatggggagattggaaatagaatagagatgatttttccccaaaagagatggtgccggttctctgaatt

SEQ ID NO: 26539 - protein, 147 aa, Panicum virgatum
  misc_feature: Ceres CLONE 1870478
  misc_feature (1)..(107): Pfam Name: Auxin_inducible Pfam Description: Auxin responsive protein
MVSAKRLVQMAKKWQRMAALARRRITSPAKETEGSSCSTSSVAGKGHCVVYLADGRRFEVPLAYLNTAIFGELLSLSQEEFGFAGDDGRITLPCEAAVMEYVMCLLRRNASEEVEAAFLTSIARPCHYGSGLAQSIGVSQQLAVSSF

SEQ ID NO: 26540 - DNA, 714 bp, Panicum virgatum
  misc_feature: Ceres CLONE 1870486
  misc_feature: Encodes the peptide sequence at SEQ ID NO. 26541
acgagcatcagcggcatcagcaggctggcaagtggcaacacgcggcatggagcaccagctgttcgatgaccccttctcgagcagcatctcgtcgctggaggcggacatcttctccgccggcggccagctgccgtcgccgccgtggccggacctcgaactcgacctcgacctcgacgacgacgacatccacgacctctccgcgccggcggccaacgccacctcctcaggaggctatggctcgggcggaggctccggcggctcccacaggaagctcagccacaacgcgtacgagcgcgaccgccggaagcagctcaacgagctctactcctcgctccgctccctcctccccgacgctgaccacactaagaagctgagcatccccaccacggtctcccgagttctcaagtacatccccgagctgcagaagcaggtggacaacctggagaggaggaagaaggagctgacgaacgccaactgcaaaccaggagttctgaagacgagccagattgtaattcccattgtttctgctacctgcctcaacgatacggagatcatggttcaggtcagcctgcagagcaatgtggccgccacaagtcttcctctgtccaagtgcataaaagtgctggagaacgaaggccttcacctgattagttcatcaacttactccaccttcgacaacaggacattctatagcctccatcttcagagaagtca

SEQ ID NO: 26541 - protein, 222 aa, Panicum virgatum
  misc_feature: Ceres CLONE 1870486
  misc_feature (74)..(126): Pfam Name: HLH Pfam Description: Helix-loop-helix DNA-binding domain
  misc_feature: The sequence is a functional homolog of SEQ ID NO 1315 in the 10/666,642 US patent application
MEHQLFDDPFSSSISSLEADIFSAGGQLPSPPWPDLELDLDLDDDDIHDLSAPAANATSSGGYGSGGGSGGSHRKLSHNAYERDRRKQLNELYSSLRSLLPDADHTKKLSIPTTVSRVLKYIPELQKQVDNLERRKKELTNANCKPGVLKTSQIVIPIVSATCLNDTEIMVQVSLQSNVAATSLPLSKCIKVLENEGLHLISSSTYSTFDNRTFYSLHLQRS

SEQ ID NO: 26542 - DNA, 695 bp, Panicum virgatum
  misc_feature: Ceres CLONE 1870501
  misc_feature: Encodes the peptide sequence at SEQ ID NO. 26543
aaaccccccggcccaaaccctcctcgcctcctcagtccatccatccaaatcctcggggcgagcgcgcgcggagagagagggattcccacggcgatggcggcggtagctagggttttccgcgggtccaggttcctcatgttcccggcgccgggcgcggcggcggcagcgggggcgaagaaagcggcggcgccaaaggtcaccaaggccgacgcgacggcggcgaaggagaagcgcgggatcatgaagccggtgccggtctccgaggagctgagcaggttcgccggcggcgcgcccgagctcgcccgctcccaggttgtcaagctcatctgggcccacatcaaggccaacggcctccagaacccggcgaagaaaaaagagatcaactgtgatgccgcactgaaaagcttgtttggtgggagggacaaggttgggatgctggagatcccgaagctactgaaccctcacttcatgaagaactaacagaagcagcagatggcaccaacgatggagctttcgtcttaagtctttattggatggctcccagtaggtagttaagccaaagttgtgtgatgacgtcaagaattcatacttgtgttcatctgttgggtttggggcgtgatgcatgtaaaaaggattcccagtgttatcgctactcttgtgatgtgggaaatgtttgtctgctaatgacacatcgt

SEQ ID NO: 26543 - protein, 128 aa, Panicum virgatum
  misc_feature: Ceres CLONE 1870501
  misc_feature (49)..(126): Pfam Name: SWIB Pfam Description: SWIB/MDM2 domain
MAAVARVFRGSRFLMFPAPGAAAAAGAKKAAAPKVTKADATAAKEKRGIMKPVPVSEELSRFAGGAPELARSQVVKLIWAHIKANGLQNPAKKKEINCDAALKSLFGGRDKVGMLEIPKLLNPHFMKN

SEQ ID NO: 26544 - DNA, 658 bp, Panicum virgatum
  misc_feature: Ceres CLONE 1870524
  misc_feature: Encodes the peptide sequence at SEQ ID NO. 26545
cagatcgatcgagcaccccaaacttgcacacaatcaccatcagttctagtagacaagacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgagaagcgccttgggcttcaaccagcatgcactgctgcctgaagggcaaacaatctagttgtacagctaacagttgctagaccccacgcagaatcaagggaggagtgatgcatgcaagtttgatgtgcaagctgctgtaaagaggaggaagatggaggggagtaagaagcacgtttattaatctgctgctgtacaaattaaatttagcactagagtgagagaaagtaagctgttagctgtctaaaagaaaagccgaagccattggccctctggttgtatctgttgatatagtagtggcttcctgttgtttggcctttgttgtaacataagcagaggcgcactagccttcgtttacagttaagctgaattattagtacc

SEQ ID NO: 26545 - protein, 87 aa, Panicum virgatum; identical to SEQ ID NO: 18987
  misc_feature: Ceres CLONE 1870524
  misc_feature (12)..(71): Pfam Name: potato_inhibit Pfam Description: Potato inhibitor I family

SEQ ID NO: 26546 - DNA, 739 bp, Panicum virgatum
  misc_feature: Ceres CLONE 1870527
  misc_feature: Encodes the peptide sequence at SEQ ID NO. 26547
gtcgccgttggcaagcagcagcgtcgcagggaaggaaaagggggccgagggccgcgaggcgaggaggaaggggaaggaaggaaggaaggaagaagagggtcggggagcgatggggctgggcgtgcgggcggcgcccttcacgtacgtggcgcacgcgctggccatcgcggcggcggtcatggtgctggtgtgggccatccacttccgcggagggctcgccatcgaggccaccgacaagaacctcatcttcaacgttcatcctgttcttatgctgattggatatattattatcggcagtgaagctataatggtatacaaggtatttccaacgttgaaacatgacacggctaagcttatccatcttattctacatggcatcgcgcttgtccttggtgcggttggaatatactttgctttcaaaaatcacaatgaaagtgggattgccaacctttacagtctgcattcttggcttgggatcggaacgattactttgtatggtattcagtggatatttggattcgttacattcttcttccctggtgctgcaccaaacttgaggaggagcctccttccttggcacatactgtttgggctattcgtctacatcttagcactggctaatgcagaactcggctttctggagaagctcacttttctcgagagctcgggcctcgacaaatatggtaccgaggcattcttggtgaacttcacagcattggttgtcgtgctatttggtgct

SEQ ID NO: 26547 - protein, 209 aa, Panicum virgatum
  misc_feature: Ceres CLONE 1870527
  misc_feature (11)..(209): Pfam Name: Cytochrom_B561 Pfam Description: Cytochrome b561
MGLGVRAAPFTYVAHALAIAAAVMVLVWAIHFRGGLAIEATDKNLIFNVHPVLMLIGYIIIGSEAIMVYKVFPTLKHDTAKLIHLILHGIALVLGAVGIYFAFKNHNESGIANLYSLHSWLGIGTITLYGIQWIFGFVTFFFPGAAPNLRRSLLPWHILFGLFVYILALANAELGFLEKLTFLESSGLDKYGTEAFLVNFTALVVVLFG

SEQ ID NO: 26548 - DNA, 613 bp, Panicum virgatum
  misc_feature: Ceres CLONE 1870534
  misc_feature: Encodes the peptide sequence at SEQ ID NO. 26549
ataagaaaggcacaatttttggtggtttagttgaggctccattgcagccatccagttcaaagaagtatcaggggagcaataattgctttgttttcactaatttacatgaccgccctgttatatatcgtccgacaggtgcaaataactatttcaccgtgtgctccaccgactatttggctctgggaggaggaggtcattttgcactctatctagatggagaccttttgaccggttcaagttccaattcagagacttttaacaacgagtgtttatcgcattccccagacttctcagtgaaagatgttgagctgtggggcttcgtctatccttccaagtatgaggagatgctcacgctctgccggactgagaaaccaggaatttgtcgatggtgatcgtcagtcggagttcccaatcaatcaatcatagacatgctgcacatctgtacagttttcagtagactccgtgagttacgagcattttttttcttcttctttagtgcgcagagtactggacttgcttttctcaagccagtttgctcagatttgtaaataccaactttgtaatttttcatgctgtcactcggcgaaacatggacgtagcaggttattgttcc

SEQ ID NO: 26549 - protein, 129 aa, Panicum virgatum
  misc_feature: Ceres CLONE 1870534
  misc_feature (1)..(107): Pfam Name: TLD Pfam Description: TLD
  misc_feature: Useful for making plants with altered protein content
KKGTIFGGLVEAPLQPSSSKKYQGSNNCFVFTNLHDRPVIYRPTGANNYFTVCSTDYLALGGGGHFALYLDGDLLTGSSSNSETFNNECLSHSPDFSVKDVELWGFVYPSKYEEMLTLCRTEKPGICRW

SEQ ID NO: 26550 - DNA, 621 bp, Panicum virgatum
  misc_feature: Ceres CLONE 1870535
  misc_feature: Encodes the peptide sequence at SEQ ID NO. 26551
aaaccaaaagaagaaagccacgccgcgagatctgggagagagagagagagagagagagagagagactgagagaggcccccgcaagatgcacgacttctgcttcacgatcccctacgggttcgccgtgctggcaggcggcgtgctgggctacctccgccgcggcagcaccgcgtccctggcggggggcgccggcgccggcgcgctcctcctcctcgcggggttcgtcagcctcaaggccttcgagaagcggcgcaactcctacctcgccctcgcgctcgagaccctttgtgcattcgccttgacctacgttatgggacagagatacctagaaacttcgaagataatgccagctggtgttgttgctggtctcagcgccgtgatgtctgcattctatctattcaagattgcaactggcggcaaccacatcccaccaaagaaagagtaaaccaatgtttaacttgtaatatatgtttgattgaactcaaagatcacgaccgattgtgttgtctagttgcacggtaacttgagggactagtgatgctctccatttgtaattctgttagattgtaccatggatctctgaactttgtacaagaaataaagattaaagatgtgattcac

SEQ ID NO: 26551 - protein, 119 aa, Panicum virgatum
  misc_feature: Ceres CLONE 1870535
  misc_feature (4)..(107): Pfam Name: TMEM14 Pfam Description: Transmembrane proteins 14C
MHDFCFTIPYGFAVLAGGVLGYLRRGSTASLAGGAGAGALLLLAGFVSLKAFEKRRNSYLALALETLCAFALTYVMGQRYLETSKIMPAGVVAGLSAVMSAFYLFKIATGGNHIPPKKE

SEQ ID NO: 26552 - DNA, 747 bp, Panicum virgatum
  misc_feature: Ceres CLONE 1870564
  misc_feature: Encodes the peptide sequence at SEQ ID NO. 26553
acccaaaaaaattatcgaatcccgcctccctcgtttcgccccaacccaaaaccgagttccctccaattccacccgcctcccctccgagatggacgccggcgcaccgaaggtgaagaaggcggcggcgggccgcaagcttggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcaccttgcttttgtgtgtatgtagttccgcatctcaatgtatcgtgtcctccgagcttcggatcctatgtcgtaggtctaggctttagctgtagtggttggtgatgggggatatgtatgttttccaaatttaatgaggaggtgggagcggttttgctttccttt

SEQ ID NO: 26553 - protein, 151 aa, Panicum virgatum; identical to SEQ ID NO: 11988
  misc_feature: Ceres CLONE 1870564
  misc_feature (27)..(100): Pfam Name: Histone Pfam Description: Core histone H2A/H2B/H3/H4

SEQ ID NO: 26554 - DNA, 729 bp, Panicum virgatum
  misc_feature: Ceres CLONE 1870578
  misc_feature: Encodes the peptide sequence at SEQ ID NO. 26555
ttccacttctcccctgctcaatctcagctcccctgcctgcgaagcatcccccatctctccccaatctctccgatcgcgcgagctcgcacgcaagcccgggcacctcatccccacgccaaaccctaaccctaacccgaaccgacccagggtcccgggccgcggcggcgggagggcatggccgacacggcgcgcgacggcggggacgccttcgcggacgaggcggagcccacggtcaccatcgacgagtacatcgagggcatcgaggccgaggagctggaggcggatttggtgctgggcggcgacgacggcaaggagtgcacctacgccggcgggtacctcaagcgccaggctgtcttctcctgcctcacctgcgtgccggatggagtcgccggggtgtgcaccgcctgcagcctcgcctgccacgatggacatgaggtgagtctgctcactcttcccattcattttccttcctaaacagcattagctctccattgttgcgagggggaacaaggcaagtaaatgaagattatcaactgttctgcccactagtatcaactgaatgtttattccagcagcacaatgtacccgctagtttcttcaaagatatgtttttattttttaattgaacacacaagacagctgcacgtcactgtattagagaaagcgtaagaaatgccggtccgtttacaaagccgacatgagcaaagtaaaccaaaggaaagaagatag

SEQ ID NO: 26555 - protein, 99 aa, Panicum virgatum
  misc_feature: Ceres CLONE 1870578
  misc_feature (46)..(97): Pfam Name: zf-UBR Pfam Description: Putative zinc finger in N-recognin (UBR box)
MADTARDGGDAFADEAEPTVTIDEYIEGIEAEELEADLVLGGDDGKECTYAGGYLKRQAVFSCLTCVPDGVAGVCTACSLACHDGHEVSLLTLPIHFPS

SEQ ID NO: 26556 - DNA, 662 bp, Panicum virgatum
  misc_feature: Ceres CLONE 1870599
  misc_feature: Encodes the peptide sequence at SEQ ID NO. 26557
gacacccgcgcctctgacgcctccctcccagcctccctccacctctgacgcctccctccctccaccctctcctccaggcaacctcagcgcctcagccgcttgcgctcgcccgctccgggcctccggagctccctgcctccctccatcctcccttcatctccgcgcatccgcgggccggggctccgccccctccagccggcggagctgcagatccggccgacagagctgcagatctgggcatccggccggctcttcggccgatctggcccgggttagtgcggccggcgcgacggaagccagcgggcacggcggcggcaagcgaggcgagccagcgggcgcggttgtggggcaggcgcagaagcgcagcatggcgaagctcaagccaaaggcgttgctggcacaaagcaaagtgaagaaggtccctagccaaatcagtgtgatcacgatcttcacctacttggtcctcggtgtcgtagtcgtgtcctctgtttatgctgtttacaaatactgggtaggcaaaggaccagcagtgacagcagcaggcgtggaggggaactaaacccccaaactatgtaactgattttgttgttgtatcatccagttggataattttggttgctgcagcccagttaacggaatatggatagattgtatcttgctac

SEQ ID NO: 26557 - protein, 63 aa, Panicum virgatum
  misc_feature: Ceres CLONE 1870599
  misc_feature: SWISSPROT Homolog: EC 5.2.1.8 Peptidylprolyl isomerase
MAKLKPKALLAQSKVKKVPSQISVITIFTYLVLGVVVVSSVYAVYKYWVGKGPAVTAAGVEGN

SEQ ID NO: 26558 - DNA, 706 bp, Panicum virgatum
  misc_feature: Ceres CLONE 1870620
  misc_feature: Encodes the peptide sequence at SEQ ID NO. 26559
cggctccgtcgccgtgcagatgctcacgctgctgtgctcgcgtgccgtcgccctcccactcgctccgcctccacgcttccttcaccgcctgccgcacccgcgcgcctcctcctcctcttcctcgctcccgccgccgccgccgtcggggatggagacctcctacaagttcggcccctacaagatcgacgccagggaggtcttccacgccacgcccctctcctacgccatggtcaacctccgccccctgctccccggtcatgttcttgtgtgccccaagcgtgaagtgaaaagatttgctgatctaagttctgatgaaacaattgacttatgggttactgcaaaggaagttggtgcacgtcttgagcagtaccataaagcaacttcacttacctttgctattcaggatggtcctcaagctggccaaacagtcccacatgtccacattcacgtcatcccaaggaagaaaggggattttgagaaaaatgatgaaatatatgatgcgattgatgtgaaagagaaagaattgaaggagaagcttgacctggacattgagaggaaagatagaagcatggaagaaatggctcttgaggccaatgagtaccatgctcttttctcctagaattgcatctagtatagttagtttctaagttgagctgactgcttgccacaaataagtctatgggctggtccctataagatggggagt

SEQ ID NO: 26559 - protein, 156 aa, Panicum virgatum
  misc_feature: Ceres CLONE 1870620
  misc_feature (14)..(107): Pfam Name: HIT Pfam Description: HIT domain
  misc_feature: SWISSPROT Homolog: EC 3.6.1.29 Bis(5'-adenosyl)-triphosphatase
  misc_feature: Useful for making plants with modulated heat sensitivity
METSYKFGPYKIDAREVFHATPLSYAMVNLRPLLPGHVLVCPKREVKRFADLSSDETIDLWVTAKEVGARLEQYHKATSLTFAIQDGPQAGQTVPHVHIHVIPRKKGDFEKNDEIYDAIDVKEKELKEKLDLDIERKDRSMEEMALEANEYHALFS

SEQ ID NO: 26560 - DNA, 668 bp, Panicum virgatum
  misc_feature: Ceres CLONE 1870633
  misc_feature: Encodes the peptide sequence at SEQ ID NO. 26561
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaaggagaagaagcacggcgagggccaccacgacggccacagcagcagcagcgacagcgactgatcgcctcgcggcgcgccgtgcttgccggtgaaaaaggtgcttggagaggactatctaccggaagctgtgtgatgtaatatgtttcacgagtgccatacgtgtgtgtgctaatcaagggagaaatgaaaaaaaaaaaccttttatgttgatcaatgtactcctaatgatggctccacggtgctagcttgtaataaaatgttaatgcagaaattggtctgctggcttgtctttgacatgtattcacgggcatcatgcatactagtatttctttgctgtattgttt

SEQ ID NO: 26561 - protein, 102 aa, Panicum virgatum
  misc_feature: Ceres CLONE 1870633
  misc_feature (2)..(92): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKDKKKKKKEKKHGEGHHDGHSSSSDSD

SEQ ID NO: 26562 - DNA, 685 bp, Panicum virgatum
  misc_feature: Ceres CLONE 1870663
  misc_feature: Encodes the peptide sequence at SEQ ID NO. 26563
acctgctgccaatcaaccaagaagcacgcgcagccacaccaagtcagggagaaggccatggccggcgtgaactcaaccagcgtcgtcgggctcaagcccgccgcggcggtgccgcacgccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaaggttctcagcacatcagtcacacggcactgtcttaaccggaaggcctgaatttttggtttctgatcttgccgtgtctctgcacctgtgttcctgcagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaa

SEQ ID NO: 26563 - protein, 136 aa, Panicum virgatum
  misc_feature: Ceres CLONE 1870663
  misc_feature (9)..(130): Pfam Name: PsaN Pfam Description: Photosystem I reaction centre subunit N (PSAN or PSI-N)
MAGVNSTSVVGLKPAAAVPHAATSSPAAKRVQVAPKDRAAEGRRAALLGLAAVFAVTATTGSAKAGIIDEYLEKSKANKELNDKKRLATSGANFSRAYTVEFGSCQFPYNFTGCQDLAKQKVLSTSVTRHCLNRKA

SEQ ID NO: 26564 - DNA, 754 bp, Panicum virgatum
  misc_feature: Ceres CLONE 1870704
  misc_feature: Encodes the peptide sequence at SEQ ID NO. 26565
gcaagttcctctcgtctctcgccttcgcaaattccttggtctggtcctcgtcccgccgccgccgcccagcagcagccgttgccggagaagaaggggagggagccatgggtcgcgtccggaccaagactgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacaaggagacaatggagatgctcgcttccctcggcatggccgacctccccggcgtcgagcgccaggctgaggtctccaacgcccccacctacggtcgcccgcagtacggtggcccccgccgcgaccgcgtctaggcttctagccggttccagtggttggatcttgatcgcttcacttatcgtcgttattaattattatgctactatgtcaaacttattttaggtcattgttgctttgtggcgattgagtcttaacctctctgttttgctctaaattctgcactcttttgatctgcgtgtgatgtacaggatctatattctcgcgcgaatggaatcatatgcgatttataagttag

SEQ ID NO: 26565 - protein, 142 aa, Panicum virgatum
  misc_feature: Ceres CLONE 1870704
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLASLGMADLPGVERQAEVSNAPTYGRPQYGGPRRDRV

SEQ ID NO: 26566 - DNA, 714 bp, Panicum virgatum
  misc_feature: Ceres CLONE 1870716
  misc_feature: Encodes the peptide sequence at SEQ ID NO. 26567
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaaggagaagaagcacggcgagggccaccacgacggccacagcagcagcagcgacagcgactgatcgcctcgcggcgcgccgtgcttgccggtaaatatccattaattacccgcggtcagatccttgctaatgaataattaaaaaattgtttgcctttataatttcctttttgtgatctttttcgcgtgcatacaggtgaaaaaggtgcttggagaggactatctaccggaagctgtgtgatgtaatatgtttcacgagtgccatacgtgtgtgtgctaatcaagggagaaatgaaaaaaaaaccttttatgttgatcaatgtactcctaatgatggctccacggtgctagcttgtaataaaatgttaatgcagaaattggtctgctggcttg

SEQ ID NO: 26567 - protein, 102 aa, Panicum virgatum; identical to SEQ ID NO: 26561
  misc_feature: Ceres CLONE 1870716
  misc_feature (2)..(92): Pfam Name: Dehydrin Pfam Description: Dehydrin

SEQ ID NO: 26568 - DNA, 502 bp, Panicum virgatum
  misc_feature: Ceres CLONE 1870727
  misc_feature: Encodes the peptide sequence at SEQ ID NO. 26569
actgctgggtgaggatttcactccgaacctttctgactttggacttgcaaaactcggaccagttggtgacagaactcatgtctccacaagactaatggatacctatggctactgagctccagactatgttgtgagtggtaaacttaccatgaaatcagacatctacccttttggtgttcttctattgcaactgataactggcaggaggatttatgatgcgtcaaggcctaaaccagaccaaagtttgctaacatggccaaggccatttctgcatgacaaaagtaatttctcccgacttgcttatccggctctgctgggctgctacccgtcatcctttctgaaccacctacttgtgatcagcataatgtgtctccagcaccaggaccatgtccacccttatcatcgctgatgtctgtgataggcctgaaccatgttgcatgccagccatatgcgcctgagcgcccgccagtaactataagctcccctgcgaacagtgggtcac

SEQ ID NO: 26569 - protein, 37 aa, Panicum virgatum
  misc_feature: Ceres CLONE 1870727
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
LLGEDFTPNLSDFGLAKLGPVGDRTHVSTRLMDTYGY

SEQ ID NO: 26570 - DNA, 681 bp, Panicum virgatum
  misc_feature: Ceres CLONE 1870750
  misc_feature: Encodes the peptide sequence at SEQ ID NO. 26571
ggctgcacccacctgttccgctcctcgtccctcacctctccatggcggactgtgtagtcgacggctacacaatcccctccggcactagagtcatcgttaacacatgggctatcagcagggatccagagttatgggaggagccagaggagttcatgccggagaggttcatggacggcgggagcgctgcggccatcgactttaaaggcaacgactttgagtttgtgccatttggggctggaaggaggatctgtcctggcctcaactttggtttggctactgttgagatcatgctggcaaacctcgtgtattgttttgactggcagctgccagacggcatagaggccaaggatattgatttgacagaggtgtttggattgtcagtccgtccaaaggagaagctcatgctatttccaaaaccacgtggtcatcactccatgcaaattactgaggctggtcactgagttgtctatcacaccccatcgatcgattacacatgcatatatatcctgtatagcagctatatatattatatatacaataatgctgccttaactagctattattgtaggtacaatcacaattaatgcatacatcctattcaccttatacatctggtcaggttgtatagctcaatagtgcatatatgcatggtataaacaataattcgatctggattatatt

SEQ ID NO: 26571 - protein, 152 aa, Panicum virgatum
  misc_feature: Ceres CLONE 1870750
  misc_feature: SWISSPROT Homolog: EC 1.14.13.21 Flavonoid 3'-monooxygenase
  misc_feature: Useful for making plants with altered carbohydrate content
  misc_feature: Useful for making plants with modulated drought sensitivity
LHPPVPLLVPHLSMADCVVDGYTIPSGTRVIVNTWAISRDPELWEEPEEFMPERFMDGGSAAAIDFKGNDFEFVPFGAGRRICPGLNFGLATVEIMLANLVYCFDWQLPDGIEAKDIDLTEVFGLSVRPKEKLMLFPKPRGHHSMQITEAGH

SEQ ID NO: 26572 - DNA, 967 bp, Panicum virgatum
  misc_feature: Ceres CLONE 1870754
  misc_feature: Encodes the peptide sequence at SEQ ID NO. 26573
aacaaaactcgcggacaggaacagaggggatcttcctcttccccaagcaatcctatcggatctcgatccacccagctatctcacgtcgtcggcgatgtgccgacggccacgggcgtgacagcggtgctgccccaggtcccggatcccccctcccacaccttccgcctcgcagatccggcggcggcgagagctcaagtttgtaatgtctgggatggcatctgatgatgcaactgctcaagagagggttgaaggagatgttgcagataaaaaagtagaagaagttcaggaccagaatgaagttggtgggatgccctcacgacaggaggaggaggcagtaattaagaaaaagtatggaggaatattacccagaaagactcctcttatatctaaggaccatgaacgtgcttactttgattctgctgattgggctctaggaaagcaaggtggtgttcccaacaagcctaaaggccctcttgaagcacttcgaccaaagcttcagcctactcaacagaatgcgcgtgcccgtcgaacttcttatgcatctgcggacagtgatgagactttgaacttgtctgctgaggatctgggccagcaaggagaacctgttgaggacaagaacaaggaataagtacgcctggtggctctaagccttttatacggaagatgccatttgctgtgctcatgctaagacccttgccttgataataagtaacgcggatttgtatactaaacactggtgagtttgacatgtgcagttcgagctggatgtgaggtgtggtacatgtaatatccgcggctaccctcagctgttcagcctttcggatgcctgtaacagctaggaatgagtccgcgaggatggtgacaatgtttacagtgctggatatgcacgcaaacacatgcaaatccaatggttgaaactccctttgaactgtagttactacctataataaagaagattgttctgatg

SEQ ID NO: 26573 - protein, 141 aa, Panicum virgatum
  misc_feature: Ceres CLONE 1870754
  misc_feature (47)..(140): Pfam Name: Lg106 Pfam Description: Lg106-like protein
  misc_feature: Useful for biocontainment applications
MSGMASDDATAQERVEGDVADKKVEEVQDQNEVGGMPSRQEEEAVIKKKYGGILPRKTPLISKDHERAYFDSADWALGKQGGVPNKPKGPLEALRPKLQPTQQNARARRTSYASADSDETLNLSAEDLGQQGEPVEDKNKE

SEQ ID NO: 26574 - DNA, 726 bp, Panicum virgatum
  misc_feature: Ceres CLONE 1870768
  misc_feature: Encodes the peptide sequence at SEQ ID NO. 26575
caagtacaggtggtccacctccaagtccgagagcggcgtgcagttcggccccttcgcgctgccgctcaacggcctgcccatgaccttcacccgcagggactgagccgggccgacgcacggaccaggccaaaaccgacggagatccgaaaccggaccggatggtggtattggtagtggtatatactcctacttgcactaagcaatacctaggcacggcacgcggaaaccgctgccggaattgggcgtcggccgcgggcgccggtcgccatcggacgggacggccatcggatcaggcatgggatcgcagaaagatcacgcaagataacccgtgtacagattcttcctcagctctctgcctctctctcagctggtaggaccggaccccaacaagccggaagaggagaccagacacaaagattagttgtagccgcgtaggtgtcagtcagtcagtgttaagctaagctaagctgctccagtaggcatcagacgccacaaagaagtggcgctgaactgtaaaaccaaactcattttgatcttcttcttattttcccccccttataatttttttaaagccagccagacagcaccctatagcagaaggacaagcgaacaaaaaagaaaggagaagagaggaggcccctgattgggattgtaagcaaagctaggttgtccgcctgaaagcaggctggcagctaggccgaataatccatggacggatggatggat

SEQ ID NO: 26575 - protein, 33 aa, Panicum virgatum
  misc_feature: Ceres CLONE 1870768
  misc_feature: SWISSPROT Homolog: EC 1.14.13.93 (+)-abscisic acid 8'-hydroxylase
KYRWSTSKSESGVQFGPFALPLNGLPMTFTRRD

SEQ ID NO: 26576 - DNA, 284 bp, Panicum virgatum
  misc_feature: Ceres CLONE 1870838
  misc_feature: Encodes the peptide sequence at SEQ ID NO. 26577
tatcaccaggctgggccttatctctttgcccgctatccgtcctgacatatacgaataagccggccaggggcggaagcgtcccacggatgcgcagggcttctgatgctccccggcgctcgccttcctgctgcccccgtggggcgtgttcctccggcctcggcgccggctcctgtccttgatccaccaactactatcactgctgtgctgcatctagctcatcatctcccccacttcctccttctgctgctatcgacgctggtagcggagcatatctacggcctgct

SEQ ID NO: 26577 - protein, 60 aa, Panicum virgatum
  misc_feature: Ceres CLONE 1870838
  misc_feature: Useful for making plants with altered carbohydrate content
MLPGARLPAAPVGRVPPASAPAPVLDPPTTITAVLHLAHHLPHFLLLLLSTLVAEHIYGL

SEQ ID NO: 26578 - DNA, 699 bp, Panicum virgatum
  misc_feature: Ceres CLONE 1870844
  misc_feature: Encodes the peptide sequence at SEQ ID NO. 26579
cttgtcgttggccgttgctagcactccgcccaccctgctctccgccatggccgcacgccccgtgaccgcgagcagctcacgccgccctcctctcccagctcaggctgctgctgctgctgctgcttcctcttcccccgcggttcgtggagtcagatcgggggagcgctcgctccttcggccgtgcccgatgctgctgacgtctgtggcagtggggagtttggttgccgctggggccgctaatgctgccgagctattggatcctctgcacggatcatcagaacttcttttggccgatcttggcattggagattggtttgggggtttgctgttttctgctggacagcaggctaatgaggctgttcaggatcagctatctgctcttagtttctctagcttggcagtcattttcggtgctggacttgtaacaagtttgtctccatgtacactcagcgttctgccattgaccctgggatatataggtgcatttggctctggaaaaggccgaaccgaggttatcggaaattcaatagcattttcattaggactggcaacaaccttagctattcttggtgttgctgcttcgtttgctggaaaggcttatggtcaggttggacaaggactcccagtggctgcttctgggttggccatcatcatgggactgaaccttctggaggtactcgagttgcaacttccctcctt

SEQ ID NO: 26579 - protein, 217 aa, Panicum virgatum
  misc_feature: Ceres CLONE 1870844
  misc_feature: SWISSPROT Homolog: EC 1.8.1.8 Protein-disulfide reductase
MAARPVTASSSRRPPLPAQAAAAAAASSSPAVRGVRSGERSLLRPCPMLLTSVAVGSLVAAGAANAAELLDPLHGSSELLLADLGIGDWFGGLLFSAGQQANEAVQDQLSALSFSSLAVIFGAGLVTSLSPCTLSVLPLTLGYIGAFGSGKGRTEVIGNSIAFSLGLATTLAILGVAASFAGKAYGQVGQGLPVAASGLAIIMGLNLLEVLELQLPS

SEQ ID NO: 26580 - DNA, 641 bp, Panicum virgatum
  misc_feature: Ceres CLONE 1870862
  misc_feature: Encodes the peptide sequence at SEQ ID NO. 26581
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgc

SEQ ID NO: 26581 - protein, 126 aa, Panicum virgatum
  misc_feature: Ceres CLONE 1870862
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 22 in US patent 7244875
MAAADVEYRCFVGGLAWATDNASLQQAFASYGDVLDSKVITDRETGRSRGFGFVTFSSEQSMLDAIEAMNGKDLDGRNITVNQAQSRGGGRREGGYGGGGGGGRREGGYGGGGYGSRGDSGGNWRN

SEQ ID NO: 26582 - DNA, 648 bp, Panicum virgatum
  misc_feature: Ceres CLONE 1870896
  misc_feature: Encodes the peptide sequence at SEQ ID NO. 26583
gcagatcgatcgagcacacgatcggcactactcatcatcacaaacttgcacactcggcgagctcgagtaattcattccacaaacactctccatcgatcgatctctttaattgttgactctgacatctgtgcgcgcagatcgatcgacatcgacgacgatatgagctccgtggacgccaccggcggcgagaagaagacgtcgtggccggaggtggtgggcctgccggcggaggaggccaagaagatcatcctcaaggacatgcccgacgccgacgtcgtcgtcctgccggccggctcgccggtgaccatggactggaggtccaaccgcgtccgcgtcttcgtcgacaccgtcgctcggaccccgacggtgggctgaaccaacgataaaccgcctcctgctggatcaaagccgctgctagctcacccttgattttcctgaatgtcttcaccataaaagggaagacctagagatcgaagcacaaataatggagctaggtagcggctatctgatataaaatttatggaatgcatgaataaataatgttccctgctcctcaataaagaaatgaattatgagcatgcagcttaactttggccaaaagataaaagataacagagaataaaactgatctgatcatatatatggact

SEQ ID NO: 26583 - protein, 71 aa, Panicum virgatum
  misc_feature: Ceres CLONE 1870896
  misc_feature (12)..(71): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVARTPTVG

SEQ ID NO: 26584 - DNA, 718 bp, Panicum virgatum
  misc_feature: Ceres CLONE 1870906
  misc_feature: Encodes the peptide sequence at SEQ ID NO. 26585
ctctctctaaaccctacccgccgccgccgccgccgctgaggtcagaccgaccagcttcaaccatggcggacgtcgatgtcgagcccgaggtcgccgccggcgcgcccaagaagaggacgttccgcaagtacagctaccgcggcgtcgacctcgacgcgctgctcgacatgtccaccgacgacctcgtccagctcttccccgcgcgcgcgaggagaaggttccagaggggtctgaagaggaagcccatggcgctcatcaagaagctgcgcaaggcgaaaaaggatgctcctgccggcgagaagccagagccagtgaggacccatctccgcaacatgatcattgtccctgagatgattggaagcatcattggtgtctacaacggcaagacattcaaccaggttgagatcaagcctgagatgattggccactacctcgctgagttctccatctcctacaagccggtcaagcatggtaggcccggtatcggtgccactcactcctcacggttcattccgctgaaatgagttattagcccagttatcagcctccagaatccagcacggaaggcgcatggcatgtcttgtttccttccagttgtgctgcttgttttgaacaagttacataccaatggtgttttgctctgttccagctctagaatcctagctaagcactgcacgatgtatgctgttttgagttaatcttatctatacggcgatgt

SEQ ID NO: 26585 - protein, 153 aa, Panicum virgatum; identical to SEQ ID NO: 12318
  misc_feature: Ceres CLONE 1870906
  misc_feature (55)..(136): Pfam Name: Ribosomal_S19 Pfam Description: Ribosomal protein S19

SEQ ID NO: 26586 - DNA, 655 bp, Panicum virgatum
  misc_feature: Ceres CLONE 1870938
  misc_feature: Encodes the peptide sequence at SEQ ID NO. 26587
cacctcgctgagattggacgtggattccgggaccttggcttcaagattatcgccacatctggaacagccaaagtgctccagctcgagggcatcccggtggagccagttctgaaaatacatgaggggcgaccaaacgccagagatatgctgaagaatgatcagattcaggtgatggtgataacaagctctggtgacgcactagactcaaaggatggcctccaactccgcaggctagcccttgcctacaagatcccaataatcacaactgtggatggggcgcgagcaaccatggatgctatcaagagcctgaagaacaagtcgatcgagaccctcgccttgcaagattacttccagactgctgatgcgcccgacttgcaagcagcggcacaaaccactccttagaggcatgtcccctaattcatgtaatgtgagcctagtgcgaactaaaacacatcccttgcgatattatgtttacttgttagcatccgtgcacctgcagcatgcataattgctagaaggtggggatgattagctgagtgccagttaccattttttgagaacacttgaatttagcatgaattgcaacatatggattaatagggaagcaggatgctggttgcaaagtgcacagtttctgtttaatgaaacttggaca

SEQ ID NO: 26587 - protein, 133 aa, Panicum virgatum
  misc_feature: Ceres CLONE 1870938
  misc_feature (1)..(88): Pfam Name: MGS Pfam Description: MGS-like domain
  misc_feature: SWISSPROT Homolog: EC 6.3.5.5 Carbamoyl-phosphate synthase (glutamine-hydrolyzing)
HLAEIGRGFRDLGFKIIATSGTAKVLQLEGIPVEPVLKIHEGRPNARDMLKNDQIQVMVITSSGDALDSKDGLQLRRLALAYKIPIITTVDGARATMDAIKSLKNKSIETLALQDYFQTADAPDLQAAAQTTP

SEQ ID NO: 26588 - DNA, 614 bp, Panicum virgatum
  misc_feature: Ceres CLONE 1870953
  misc_feature: Encodes the peptide sequence at SEQ ID NO. 26589
acggcgtggggagagacgagaagaagcctcaaggaagaggaagctgaaggcgagcgagtggggagggaagaagatgaaggtccgcgcgtcggtgaagcggctgtgcgggttctgcaaggtggtgaagcgccggggcatcgtcttcatcccctgcaccgccaaccccaagcacaagcagcgccagggcttctccaccctcgccgaagccgccgcatcatgcacccccctgcccccgcccccgccaccgcatgccagcagcaccgcagccgccgcagcgttcgcggatgcttccaaggtagctagacaagagatgtttacaaaattcaattggcctctgggtttagctgccctgctcaagaatggcgaaaaataatgtgtctgctctactatacgctgacgattcagaaacagatttggcactttgatatcaagtgaaagtttgtagccaaaacttgaagatgtatcatcatgatgtattttgcagtcactactagtcagttgagttggtcctgtggtgaaataatatcagcacatattgttacgcgcctcaatatgtttgcttgttcgaacaaaatttattacacatttgaagaaagctgacatacttgactgcc

SEQ ID NO: 26589 - protein, 99 aa, Panicum virgatum
  misc_feature: Ceres CLONE 1870953
  misc_feature (1)..(38): Pfam Name: Ribosomal_L36 Pfam Description: Ribosomal protein L36
MKVRASVKRLCGFCKVVKRRGIVFIPCTANPKHKQRQGFSTLAEAAASCTPLPPPPPPHASSTAAAAAFADASKVARQEMFTKFNWPLGLAALLKNGEK

SEQ ID NO: 26590 - DNA, 672 bp, Panicum virgatum
  misc_feature: Ceres CLONE 1870955
  misc_feature: Encodes the peptide sequence at SEQ ID NO. 26591
aggggccagaaaagcctttgaaacccgtcttactgctcgtctctctcgcctgcctccttgtttcccaaggccgccctgcagcgtctccaatggcgtacaaggtgaaagggttgttcaaggtcatctcccggatcttcgtggtgaaggagcacgagacggagatcggttatccgacggacgtgaagcacgtcgcgcacatcggctgggatagcgcggcggggaatgcctctccaagctggatgaacgacatcatgacatcccccaacttctcgtccttgggcaactttgctgcgtccacagggacctcctgggtttctcaaggggcggtttcagagaccaccggccggcgggaatcggctacttgtcccgacgttccaaggccgctcgggaagacgagggggaagaagccggaggacggatcgccaaccgcgccgtcgacgtccacggacgagctggcgtcaccgccgccagcggccgctgaggccgaggctgccgatggcgctgctgcagatggcacgcgatgatccaaactgtgttccggtcttttcttattgtcgtgtaggcaatggcaacgattgtatgtctcgactttgtttcaactttgagattggattgcagatgataaaaaatggaacgaatgcaacgaaatagaatgcgacgatctgtttgttc

SEQ ID NO: 26591 - protein, 144 aa, Panicum virgatum
  misc_feature: Ceres CLONE 1870955
  misc_feature (24)..(137): Pfam Name: PBD Pfam Description: P21-Rho-binding domain
MAYKVKGLFKVISRIFVVKEHETEIGYPTDVKHVAHIGWDSAAGNASPSWMNDIMTSPNFSSLGNFAASTGTSWVSQGAVSETTGRRESATCPDVPRPLGKTRGKKPEDGSPTAPSTSTDELASPPPAAAEAEAADGAAADGTR

SEQ ID NO: 26592 - DNA, 713 bp, Panicum virgatum
  misc_feature: Ceres CLONE 1870961
  misc_feature: Encodes the peptide sequence at SEQ ID NO. 26593
atccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatgtcgacgagcgtcggcggcggccgcgcgctgccgtcgctgcaggccggccggccggcgccgtacccgcggctcgcgctgccgtcggcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcgtcgacgacgccactggcctcgacaaggccgtcaaccctggcaccggcaagttcatcatcggcgaggacgagaagtagagagagaccgagggaaatgatgcgcctggttgtttgtgggtgatcgatcagt

SEQ ID NO: 26593 - protein, 177 aa, Panicum virgatum
  misc_feature: Ceres CLONE 1870961
  misc_feature (62)..(175): Pfam Name: Chloroa_b-bind Pfam Description: Chlorophyll A-B binding protein
  misc_feature: Useful for making plants with modulated light quality response
  misc_feature: Useful for making plants with modulated nitrogen use efficiency
MAQSMLMSTSVGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLLGAIGALGDRGTFVDDATGLDKAVNPGTGKFIIGEDEK

SEQ ID NO: 26594 - DNA, 542 bp, Panicum virgatum
  misc_feature: Ceres CLONE 1870988
  misc_feature: Encodes the peptide sequence at SEQ ID NO. 26595
atcatacacgaagaccgactgaaaaccgaacctgccgctcctgcaatggaggactccatgatctcgccgtctgctctggcggcaccggcctagcgcccagggcctgccgcccctcggccgccgcgcgtcctccttcgccgtcctctgcggcaccgcaaagaacatcaagaccgactagcccttcgggataggacctggcctccccgtctaccactatgcctccgggaggaaggtcaagggccagggcatgtaccaattcttcgacaagcaccgcgcctacctcaacggatacagcccaatctaccaagaggaagactggtctcccaccggcgacgtctacatctgcggaaccactggacttctgatctggcccgcctccctcgccgggttccttggccgcggcgccctccttgtttacaacaccagcgccctcgccagctaagaacactattcatgcatagtccatgcaagcgcttgtggttcatgtaagatcagatcgggtgtctgtcggctgtaatctagcctgaagctttgacgcgcta

SEQ ID NO: 26595 - protein, 64 aa, Panicum virgatum
  misc_feature: Ceres CLONE 1870988
  misc_feature (1)..(64): Pfam Name: PsbR Pfam Description: Photosystem II 10 kDa polypeptide PsbR
MYQFFDKHRAYLNGYSPIYQEEDWSPTGDVYICGTTGLLIWPASLAGFLGRGALLVYNTSALAS

SEQ ID NO: 26596 - DNA, 907 bp, Panicum virgatum
  misc_feature: Ceres CLONE 1871005
  misc_feature: Encodes the peptide sequence at SEQ ID NO. 26597
agcacccgctgtgcagtgcgcaagtgcgcttcatcgtcctctcccccctgccgtgcacccgctttccccaccaccaattcgggaaccctactccgccgccgccgccgccgccgccgccgccgccatgagccgccaacctgaggttctgtgggctcagcgctctgagaagatttacttgactatctcattgccagatacaaaagatgttgagctgaagactgaacctaaaggcctctttactttctcagctgttgcccatggggaaccttttagcttcactttggagctctttgattccatactgccagagggaagtaaaacaaagacaaagatgggcttgcgaaacataatctgttcaatccaaaaggaaaagaaaggttggtggaagcgcttgctgaagtcagaggaaaagcatccatacatcaaagttgactggaacaaatggtgtgatgaggatgaagagtctgaagcctcgggggattctgatgatgactttgatggggccaatgaaggagatgaaagtgatgatgatgacgggatgctttatctccctgaccttgaaaagttaaggggcaagtgacttggctgctcaggtgagggaagtaggtctgctgtaacagattatcattgacgtgacagataggctctccattaacgtagttgctgttacctgcaaagcatctgcgatggcaccagagttttgtcatgatctttgcttggcgtgtcttttatctccggggtgtctttcctgaccagtgagcttgtgctctgaatgtagctatgagctgtgtagttttcgactaactcttagcgccagtcgatgacctaattctactatcacaatgcatctagatcttttggaatcatgatatcttggtaaggattatcatttgctggcagggtgatt

SEQ ID NO: 26597 - protein, 151 aa, Panicum virgatum
  misc_feature: Ceres CLONE 1871005
  misc_feature (5)..(81): Pfam Name: CS Pfam Description: CS domain
  misc_feature: SWISSPROT Homolog: EC 5.3.99.3 Prostaglandin-E synthase
MSRQPEVLWAQRSEKIYLTISLPDTKDVELKTEPKGLFTFSAVAHGEPFSFTLELFDSILPEGSKTKTKMGLRNIICSIQKEKKGWWKRLLKSEEKHPYIKVDWNKWCDEDEESEASGDSDDDFDGANEGDESDDDDGMLYLPDLEKLRGK

SEQ ID NO: 26598 - DNA, 627 bp, Panicum virgatum
  misc_feature: Ceres CLONE 1871014
  misc_feature: Encodes the peptide sequence at SEQ ID NO. 26599
actacctgggcaacccgagcctggtgcacgcgcagagcatcctggccatctgggcgtgccaggtggtgctcatgggcgccgtcgaggggtaccgcgtcgccggcggcccgctcggggaggtggtggacccgctgtacccggggggcagcttcgacccgctggggctcgccgacgacccggaggccttcgcggagctcaaggtgaaggagatcaagaacggccgcctcgccatgttctccatgttcggcttcttcgtgcaggccatcgtcaccggcaaagggccgctggagaacctcgccgaccacctcgccgaccccgtcaacaacaacgcctgggcctacgccaccaacttcgtccccggcaagtgagcgagctcgatcgctatgtgaagctagcgacccgggggatcgcgcgtgtaccgtagacgtacgtattcgtatgtactgctacatactgcagggtgtacgagtatctgtgaaggggacctgggatcgcacagtttggtgtacaagtagtagtgtatttgtacgcatgcatgcgctggaccggatcaatgaaatacgcgcaccgcgttgtaaatttgtagcaaaataatttataataaagtgtaatatctaaatctgtatc

SEQ ID NO: 26599 - protein, 121 aa, Panicum virgatum
  misc_feature: Ceres CLONE 1871014
  misc_feature (1)..(88): Pfam Name: Chloroa_b-bind Pfam Description: Chlorophyll A-B binding protein
YLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 26600 - DNA, 827 bp, Panicum virgatum
  misc_feature: Ceres CLONE 1871030
  misc_feature: Encodes the peptide sequence at SEQ ID NO. 26601
aatagcacaacccgcgattagcccgcgacctccgcaaaagcagcgcgccattttggatccagggagctagagtgcggactgttcccgagatttctttctcccccaccgcacccccgcctcctcgcgccgcagcggacgagaccatgtgtcccacgggcaggtacctgggcctcgacctctccgccgccgcgggcgtcggcggcgacctgaggccggcgttcgacgtgctggacgcggaccgggacggccgcatcagccgggaggacctcaagaccttctacgccaccgccggggggcggttcgacgacgacgacctcgcggccatgatcgcggccgcggacgccgaccgcgacggcttcgtgcagtacgacgagttcgagcgcctgctggccgcccgcgcggggggcgccgcggggcggtccgcgatggaggacgcgttccggctcatggaccgggacggggacggcaaggtcgggttcgaggacctcaaggcgtacctcgcgtgggccgggatgcccgcggcggacgaggaggtgcgcgccatgatccgtgtcgccggcggaggggacggcgacgaaggcgtggggatcgaggcgctcgccagagtgctcttggtcgacttggaaggcatcgctctctgaaaactctcaactgcttgcagaggcagagcattgtgcgttgttttttttttgcgaatctcttccttggtttggttggtgacaccgagagatgggatgtgatttgtctgtggttggttcacgcggaccttgaggcgtgcgtgtattgtatacctgcccccctgatgagaatattgaaaagattgcctc

SEQ ID NO: 26601 - protein, 165 aa, Panicum virgatum
  misc_feature: Ceres CLONE 1871030
  misc_feature (94)..(122): Pfam Name: efhand Pfam Description: EF hand
  misc_feature (57)..(85): Pfam Name: efhand Pfam Description: EF hand
  misc_feature (21)..(49): Pfam Name: efhand Pfam Description: EF hand
  misc_feature: SWISSPROT Homolog: EC 2.7.11.1 Non-specific serine/threonine protein kinase
MCPTGRYLGLDLSAAAGVGGDLRPAFDVLDADRDGRISREDLKTFYATAGGRFDDDDLAAMIAAADADRDGFVQYDEFERLLAARAGGAAGRSAMEDAFRLMDRDGDGKVGFEDLKAYLAWAGMPAADEEVRAMIRVAGGGDGDEGVGIEALARVLLVDLEGIAL

SEQ ID NO: 26602 - DNA, 721 bp, Panicum virgatum
  misc_feature: Ceres CLONE 1871041
  misc_feature: Encodes the peptide sequence at SEQ ID NO. 26603
ctcccctcctccttcctccaccaccttccagcaagcgagccttatcttcttcttcgtccatccgtcctggcattggctagtaggtgtcgcgagacagggagggtagcagcgagctgagaggttcacggtgggggcggcggcggcggccatgaagatccagtgcgacgcgtgcgaggccgcggcggccacggtggtgtgctgcgccgacgaggcggcgctgtgcgcgcgctgcgacgtcgagatccacgccgccaacaagctcgccagcaagcaccagcgcctcccgctcgaggcgctctccgccaagctcccccgctgcgacgtctgccaggagaaggcggccttcatcttctgtgtggaggaccgggcgctcttctgccgggactgcgacgagcccatccacgtccccggcacgctctccggcaaccaccagcgctacctcgccaccggcatccgcgtcggcctcgcctccgcggcctccgcgtgcggcgacgcccacgactcggaccaccaccccccgcccaaggccgccgtcgagccgccgccgcagcccgccgtctccgccgcggcggcgcagcaggtgccctcgccgccgccgttcctgccgcagggctgggccgtcgacgagctcctccagttctccgactacgagtccggcgacaagctgcaaaaggagtcgccgctcgggttcaaggagctcgagtggttcgccgacatcgac

SEQ ID NO: 26603 - protein, 190 aa, Panicum virgatum
  misc_feature: Ceres CLONE 1871041
  misc_feature (1)..(47): Pfam Name: zf-B_box Pfam Description: B-box zinc finger
  misc_feature (52)..(99): Pfam Name: zf-B_box Pfam Description: B-box zinc finger
  misc_feature: The sequence is a functional homolog of SEQ ID NO 465 in the 11/479,226 US patent application
  misc_feature: The sequence is a functional homolog of SEQ ID NO 1961 in the 11/479,226 US patent application
  misc_feature: Useful for making plants with altered lignin content
MKIQCDACEAAAATVVCCADEAALCARCDVEIHAANKLASKHQRLPLEALSAKLPRCDVCQEKAAFIFCVEDRALFCRDCDEPIHVPGTLSGNHQRYLATGIRVGLASAASACGDAHDSDHHPPPKAAVEPPPQPAVSAAAAQQVPSPPPFLPQGWAVDELLQFSDYESGDKLQKESPLGFKELEWFADI

SEQ ID NO: 26604 - DNA, 704 bp, Panicum virgatum
  misc_feature: Ceres CLONE 1871043
  misc_feature: Encodes the peptide sequence at SEQ ID NO. 26605
agtccaccgctccgctcctctccactaccgccgccaccacccccaaaaccctcgccccggccggaggggaggagagcgaccgaggaggaggaagcgagcgcgaccggccggcggagatgcagatcttcgtgaagacgctgacggggaagaccgtcacgctggaggtcgagagcagcgacaccatcgccaccgtcaaggccaagatccaggacaaggaaggcatcccaccggagcagcagcggctcatcttcgcggggaagcagctggaggacgaccgcacgctggccgactacagcatccagaaggagtccacgctgcacctggtgcttcgcctccgcggtggcggcaggggcggctaccctaccatgaccgtaccgtgggacctcatcaaccttgcccgcaaacacaatgagaagaagatggtctgccgcagttgctatgcgcgccttccctccaggtccacaaactgccgcaagaagaagtgtggccacaccaacgagctgagggcaaagaagaagttcatctccaagttgaacagtttgtgaacgatttggaaatcgagcgaagtgacattctggagtgccatctgaaagtatcacgcatcagttgaaccaacttatcttagcatatgtatcggagctgtgttagctttgtcctattttaagtttccatctgcatgctgaacctaatttactctctcgaat

SEQ ID NO: 26605 - protein, 142 aa, Panicum virgatum
  misc_feature: Ceres CLONE 1871043
  misc_feature (6)..(74): Pfam Name: ubiquitin Pfam Description: Ubiquitin family
  misc_feature (85)..(136): Pfam Name: Ribosomal_L40e Pfam Description: Ribosomal L40e family
  misc_feature: SWISSPROT Homolog: EC 3.1.2.15 Ubiquitin thiolesterase
  misc_feature: Useful for making plants with modulated cold sensitivity
  misc_feature: Useful for making plants with modulated flowering time
  misc_feature: Useful for making plants with modulated nitrogen use efficiency
MQIFVKTLTGKTVTLEVESSDTIATVKAKIQDKEGIPPEQQRLIFAGKQLEDDRTLADYSIQKESTLHLVLRLRGGGRGGYPTMTVPWDLINLARKHNEKKMVCRSCYARLPSRSTNCRKKKCGHTNELRAKKKFISKLNSL

SEQ ID NO: 26606 - DNA, 948 bp, Panicum virgatum
  misc_feature: Ceres CLONE 1871080
  misc_feature: Encodes the peptide sequence at SEQ ID NO. 26607
ttcctcgtctctccttcgtgcctcgccccatcagatccgccaaccccgggccgctcagatacacagatcggcacccaccatggccgcggcttcccctccgctcctccccacctctgtcgtcccggccgccgcgccatccccctcccccatccccaccgccgacgtcgccgccgccgacgccaaccccgccgcggcgcgcgccttcgtctcccgcctcctcgactccgccaggcgcgcgctctccggcgcccgcccctggtccgagctcgccgaccgcaccgcgctctcccgcccggacaccctctccgaggccacctcccgcctccgcaagaacctcgcctacttccgcgtcaactacgccgccgtcgtcgggctctccctcgccgccgcgctcctcgcgcaccccttctcccttgcggcgctcctcgccctgctcgccgcctggtgcctcctctacatgctccgccccgccgacgcgccgccgctcgccgccttcgggcgcaccttctccgacagggaggtgctcgggggcctcatcgcgtcctccgccttcgtcgtcttcctcacctccgtcggctcgctcatcttctccgcgctggccctcggcgccgccgccgtctgcgcgcacggcgcgttccgcgtcccggaggacctcttcctcgacgagcccgaccaggctgccggcagcggcaacccgctgctctccttcatcgccaccgccaccggaggacgcgtctgactgatggaggcaggccgcttcaattcttttggcagctgaggttgaggataccgatcgatcgatactgcgcgaaattactttatctgcataattacagaacaatacatacagacagacagcgaacgaacgaggaaccggaaacctcatttgtttccgtgaataaaaaagttggtttcatgtatcaatcaattggcatgattaattatttc

SEQ ID NO: 26607 - protein, 219 aa, Panicum virgatum
  misc_feature: Ceres CLONE 1871080
  misc_feature (49)..(203): Pfam Name: PRA1 Pfam Description: PRA1 family protein
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
MAAASPPLLPTSVVPAAAPSPSPIPTADVAAADANPAAARAFVSRLLDSARRALSGARPWSELADRTALSRPDTLSEATSRLRKNLAYFRVNYAAVVGLSLAAALLAHPFSLAALLALLAAWCLLYMLRPADAPPLAAFGRTFSDREVLGGLIASSAFVVFLTSVGSLIFSALALGAAAVCAHGAFRVPEDLFLDEPDQAAGSGNPLLSFIATATGGRV

SEQ ID NO: 26608 - DNA, 690 bp, Panicum virgatum
  misc_feature: Ceres CLONE 1871091
  misc_feature: Encodes the peptide sequence at SEQ ID NO. 26609
accgccatcctctctccctccgatcagcagcagcacagccagagccagcaccagcgcagcggcgagcggtccaccatccacagcttcaattcaaatcgcacggccatggcgtcgcagcagcagcagcagcggcaggcggcggggtcggcggcggcggcggcgcccgtggggttcgaggactacctgccggtgatggcggagcggctgggtgaggatgggctgatgcgggagctggcgagcgggttccggctgctcatggacccggcccgcgggctcatcaccttcgacagcctccgccgcagcgcgccgctgctgggcctgggcgccatgtccgacgacgacctccgcgggatgctcgcggagggcgacttcgacggcgacggcgcgctcagcgagatggagttctgcgtgctcatgctccgcctcagccccgagctaatggacgggccccgcaggtggctcgacgacgccgtctcgcaggcctcgcacttcctcttcaccagctaggcgggctgcctgctggagacggccgcgcgcgtaggaattgttcgttgagcttctctttcttttcgttgttcatagctggattaggaattcgttcaaaaaaaatagctggattaggaagggactggtgcctgattggtcgatagatggattccatgccttgtgtactcgatcgcctgttcctcc

SEQ ID NO: 26609 - protein, 133 aa, Panicum virgatum
  misc_feature: Ceres CLONE 1871091
  misc_feature: Useful for making plants with altered glycerol content
MASQQQQQRQAAGSAAAAAPVGFEDYLPVMAERLGEDGLMRELASGFRLLMDPARGLITFDSLRRSAPLLGLGAMSDDDLRGMLAEGDFDGDGALSEMEFCVLMLRLSPELMDGPRRWLDDAVSQASHFLFTS

SEQ ID NO: 26610 - DNA, 927 bp, Panicum virgatum
  misc_feature: Ceres CLONE 1871122
  misc_feature: Encodes the peptide sequence at SEQ ID NO. 26611
aaaataatcttatcttagcttgatttcgagttaggcatttgccacctcaacgtttctcccaaccctgtcctctgttcaatctcttgtaacctgcagagcatgctcatgagtagtcatggctcatgagcgttttttttttgcggaagcataaagcatatggattttttaaggaattcaagttccaagtttttagtactgtgtgtgaaacaaaacaaaagaacgttttaaatttgatgatgcgttgcaggtacagggcggtgacgagcgcctactaccgcggcgcgctgggcgccatggtggtgtacgacgtgacccggcgcgccacgttcgagcacgtcccgcggtgggtggaggagctccgcgcgcacgccgacggctccaccgtcgtggcgctcatcgggaacaaggccgacatgcccgcggcgcggcgcgaggtggcggccgacgaggccgcgcgcctcgccgaggagcaggggctcttcttctccgaggcgtccgcgctcacgggggacaacgtggagcgcgccttcctcacgctcctcgaggaggtcttcgccgtcgtctcgcgccgggcgctggagctcgacgaggcacgccggatgcgcggcgagcagggcgatggcggcgccggtggcgaggtgctgtcgctcagggggacaacggtggacctgggctccatcatggagaccagctccatgaagaagagctcgcagtgcgcctgctcgtgatggcgttttcacctcagatgtaggagttctttcaaaagtactatatttttttaagagcttcatttacaaatcacagatcattacactattggtcttttaggcatgctaccttgtaaagcctgtaagtacgagacgttctattgtacctgatcaattgttttgttttcgaagttcccaagcaaacaggcagatttatgcc

SEQ ID NO: 26611 - protein, 201 aa, Panicum virgatum
  misc_feature: Ceres CLONE 1871122
  misc_feature (16)..(145): Pfam Name: Ras Pfam Description: Ras family
  misc_feature: Useful for making plants with altered lignin content
MSVFFLRKHKAYGFFKEFKFQVFSTVCETKQKNVLNLMMRCRYRAVTSAYYRGALGAMVVYDVTRRATFEHVPRWVEELRAHADGSTVVALIGNKADMPAARREVAADEAARLAEEQGLFFSEASALTGDNVERAFLTLLEEVFAVVSRRALELDEARRMRGEQGDGGAGGEVLSLRGTTVDLGSIMETSSMKKSSQCACS

SEQ ID NO: 26612 - DNA, 543 bp, Panicum virgatum
  misc_feature: Ceres CLONE 1871123
  misc_feature: Encodes the peptide sequence at SEQ ID NO. 26613
acgctccatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagtggggtcacatcgctgagcagaagtacggtggcggtgggtacggtggcggcggcggcggatactgtggcggcggtgggtacggcggcggaggtggtgatggtagctatagaggcatcttcccctgccgcttcatgatcttcctcggcgtcggcggcttgctcgccggctacctcccctgattcctcaagggatgggtctatgtcacggatgccttcgtcgaggactacttacgccgtggtggaactgtcgtccgaatgctgcttgacgccattgacttgtttctcattggaacggccatgtttgtgcttcggcacgggcttgtacgag

SEQ ID NO: 26613 - protein, 86 aa, Panicum virgatum
  misc_feature: Ceres CLONE 1871123
  misc_feature (2)..(65): Pfam Name: GRP Pfam Description: Glycine rich protein family
  misc_feature: Useful for making plants with altered lignin content
  misc_feature: Useful for making plants with modulated biomass
  misc_feature: Useful for making plants with modulated nitrogen use efficiency
MMSGKALLVAVLLVGVASRCSGSRGLQWGHIAEQKYGGGGYGGGGGGYCGGGGYGGGGGDGSYRGIFPCRFMIFLGVGGLLAGYLP

SEQ ID NO: 26614 - DNA, 721 bp, Panicum virgatum
  misc_feature: Ceres CLONE 1871123-R
gcggtgggtacggtggcggcggcggcggatacggtggtggcggtgggtacggcggcggaggtggtggtggtgggtatggaggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaagaaggccaactacgcctgccactactaatcgatcgatgacgaaggagcgagctgcttcctccatctatcatttcgtcagtgtagcgtgcttgttaaataagatgtgtgtgtgtgtccgatccccagctagcgtcgccttcgcttctgcgtcgtcgtcttcccgtgactagctcccatgaatccatgaggacgcatgacgccatgccgtctcgttgtctgcttcttcagtagtgatgatgcctgcttccttgtcgttgttgctgatgtaatgagaaataagatgagttggttggtggt

SEQ ID NO: 26615 - DNA, 672 bp, Panicum virgatum
  misc_feature: Ceres CLONE 1871128
  misc_feature: Encodes the peptide sequence at SEQ ID NO. 26616
atccaccctcatcggaagctccccccaactccaagcctccttccagcagcgaagaagcgaggagccagccggagagcggcgatcgagcagcgtcgcgacaccagccagtcggatacaagcgatcccatggcgcccagaaggtcaccgtcgccggcggggcagcagccgaggctccgaggcgtgcggaagcggccgtggggccggtacgcggcggagatccgcgaccccgtacgcaaggcgcgcgtgtggctggggaccttcgacacgcccgaggacgccgcgcgcgcctacgacgccgccgcgcgcaggctccgggggccgcgcgccgccaccaactacccggcccaggacccgagggccgtggcggcggacgctccggcggcgagcaggagcgggagcgttgcgctgtcggagggcgcgtcgtcttcctcgtcgcgctcccgggactcgccgctggcggtcacggtggccgtcgcggcggctccgtcgaaggacctgagtctggcgctcccggccacgccatcgtcgtaccacatgttcctggacccggccgcgacgatggtagccgtggcgccagcgctgctgcagttcctgccgcccaagagtgaggaagaccagagcttctcagggtcgtgctcctcctcaggctcctcgtcggccgtgttccacgcc

SEQ ID NO: 26616 - protein, 181 aa, Panicum virgatum
  misc_feature: Ceres CLONE 1871128
  misc_feature (14)..(65): Pfam Name: AP2 Pfam Description: AP2 domain
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
MAPRRSPSPAGQQPRLRGVRKRPWGRYAAEIRDPVRKARVWLGTFDTPEDAARAYDAAARRLRGPRAATNYPAQDPRAVAADAPAASRSGSVALSEGASSSSSRSRDSPLAVTVAVAAAPSKDLSLALPATPSSYHMFLDPAATMVAVAPALLQFLPPKSEEDQSFSGSCSSSGSSSAVFH

SEQ ID NO: 26617 - DNA, 673 bp, Panicum virgatum
  misc_feature: Ceres CLONE 1871135
  misc_feature: Encodes the peptide sequence at SEQ ID NO. 26618
cctccctccacagatcccgattcgatcagccgccatggcccgctcctcctcgcagtcccagtcctccgtcggcggcgccggcgccggagcccgcccggccaccgttggcccccgcggcacggcagcagctgccgccggcatgcgccgccgccgcgccaccgctagcgccgggggagggggcttctccggcggcggcgggagcaacatgcttcggttctacaccgacgaggccccgggcctgcgcctctcgccaaccatggtgctcgtcatgtcgctgtgcttcatcggattcgtcaccgccctccacgtcttcggcaagctctaccgctcccgcaccgccgcagcctccgcgtgacccatccccatcccatccctccggcgcgactatcatcagatcaaggttttcaatatatcatcatcagtctacttactcttgtcttgcctagctttccttcctgtgctagtgctagatctggagggagatgaatggaaccctacaacttgaagttagtgatgatgccctttctgttgccttattcttcccctttccttgttttagtgcctttttatttactcccagatgcaaatagttgtgcctagtcactgtaatcatggggattgctacaattaattttgcatctcggtaacttagcgtgtgctcgaggatttctac

SEQ ID NO: 26618 - protein, 106 aa, Panicum virgatum
  misc_feature: Ceres CLONE 1871135
  misc_feature (52)..(97): Pfam Name: Sec61_beta Pfam Description: Sec61beta family
MARSSSQSQSSVGGAGAGARPATVGPRGTAAAAAGMRRRRATASAGGGGFSGGGGSNMLRFYTDEAPGLRLSPTMVLVMSLCFIGFVTALHVFGKLYRSRTAAASA

SEQ ID NO: 26619 - DNA, 1042 bp, Panicum virgatum
  misc_feature: Ceres CLONE 1871180
  misc_feature: Encodes the peptide sequence at SEQ ID NO. 26620
gcattgaactcgccctcggttcgttccagcgcttgcccatcggactcaccgccgagacgaagccccacaacatccccccagaccccagccagcttctctctcagccccctccgcttgtcgcgttgcggacccggcgcacgccggcccgcccagatatagagcgaacagagccgccggccagacagacactcgaagcggttgcttggtgcggcaagggagaaggatcatcagaccccagttggtttactactagccggccatggctgccaagaaggtggtgctgaagatcgacctgcacgacaacaaggataagcagagggtgctcaaagcggtctccactctccacggtatcgactccatctccgtggacatgaaggactctaagctgacggtgatcgggctcgccgaccccgtcgacgtcgttgccaagctgcgcaaggtcggggccgcccacatcctctccgtcggcccggccaaggaggagaagaaggacgaaaagaaggacggcgacaagaaggatggcgataagaaggacggcgacaagaaggacggcgataagaaggtcgtggtgtacccgccgccgtggtacgccgggcagtacccctactacccccactacgtcgtccacagcgccgaggaggaccccaactcctgcgtcatctgctgattgccgatccccgcccggtttttgtaaattcctagttggcctgcctgcctacctcgagctccagcgtcagtgatcgccggctgggacccggaccagggccggggctgcggtggttggccgctgcgctcagctctatgcctctattccctgggttggttggcccgtccgcaggtcgttatatgatgacgatgacgatggccggagcaattacgcaggcgatccaggagtagttggtgggatttcaggttgcagcgccattgctgatcagcgagttgtgtagtgttcatagcatattgtatctgggttttgtccttgctatttgggtgttgaggcatgaaactatagacatatataaaggttaactgaacatacact

SEQ ID NO: 26620 - protein, 135 aa, Panicum virgatum
  misc_feature: Ceres CLONE 1871180
  misc_feature (6)..(73): Pfam Name: HMA Pfam Description: Heavy-metal-associated domain
MAAKKVVLKIDLHDNKDKQRVLKAVSTLHGIDSISVDMKDSKLTVIGLADPVDVVAKLRKVGAAHILSVGPAKEEKKDEKKDGDKKDGDKKDGDKKDGDKKVVVYPPPWYAGQYPYYPHYVVHSAEEDPNSCVIC

SEQ ID NO: 26621 - DNA, 342 bp, Panicum virgatum
  misc_feature: Ceres CLONE 1871216
  misc_feature: Encodes the peptide sequence at SEQ ID NO. 26622
aaatcccgtgaggcgcctcgccgcgcagacaaaaatccccaaatcccctcgagagcccagcctctcaaacccagcgattcgagccggtggcggcggcggcggtcggttcgtggcatggcggagattcgcaagcacgccatgtccaaccaggcgccagatattcctcagatactactggaagctcagaataggtggctgcggcccaacgaaatctgccaaatattgtcaaactacaagaagttctccatcgcacctgagccaccaaacagacccccaagtggttcgctgtttctgtttgatcggaaaatattgagatacttcagaaaggacggacataactgg

SEQ ID NO: 26622 - protein, 75 aa, Panicum virgatum
  misc_feature: Ceres CLONE 1871216
  misc_feature (19)..(75): Pfam Name: CG-1 Pfam Description: CG-1 domain
  misc_feature: The sequence is a functional homolog of SEQ ID NO 1308 in the 10/666,642 US patent application
  misc_feature: The sequence is a functional homolog of SEQ ID NO 588 in the 10/666,642 US patent application
MAEIRKHAMSNQAPDIPQILLEAQNRWLRPNEICQILSNYKKFSIAPEPPNRPPSGSLFLFDRKILRYFRKDGHN

SEQ ID NO: 26623 - DNA, 682 bp, Panicum virgatum
  misc_feature: Ceres CLONE 1871239
  misc_feature: Encodes the peptide sequence at SEQ ID NO. 26624
cttagcccccgccgccgccgccagttctcgccctctcccaaaccctacccgccgccgccgccatgccgccgaagctcgacccgtcgcaggtggtggaggtgttcgtccgcgtgacgggcggcgaggtcggcgcggcgtcgtcgctggcgcccaagatcggcccgctggggctctccccgaagaagatcggggaggacatcgccaaggagacggccaaggactggaagggcctccgcgtcaccgtcaagctcacggtgcagaaccgccaggccaaggtctcggtcgtgccctccgccgccgcgctcgtcatcaaggcgctcaaggagcccgagagggaccggaagaaggtcaagaacatcaagcacagcggcaacatcggcctcgacgacgtcgtcgagatcgccaggaccatgaggcccaggtccatggccaaggagatggccgggaccgtcaaggagatcctcggcacctgcgtcagcgtcgggtgcaccgtcgacggcaaggaccccaaggacctgcagcaggagatcgatgacggcgacgtcgagatcccctcagcttaaaaggctaaggagactgtaattgatgctgctgaagtggtgttttgttctgcatgctgttgtacctccaaacaatgtgattccacctttttcgtctagctctattagtgttattctgtgag

SEQ ID NO: 26624 - protein, 166 aa, Panicum virgatum; identical to SEQ ID NO: 12538
  misc_feature: Ceres CLONE 1871239
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 26625 - DNA, 741 bp, Panicum virgatum
  misc_feature: Ceres CLONE 1871249
  misc_feature: Encodes the peptide sequence at SEQ ID NO. 26626
gccattcgccgaccacaagccgcaccaaacccgcagcgcccatccatcgacgagacgacgacgtcgccggcgagagagaaggggagacagttgacagatggaggcggcggcggcagcggccggcgtgcagctcggctcctccaagccccagatcgccacgcaggcggagatggcggaggcccgggtgccgctcccctaccgcgaccagtgcgcgcacctcctcatcccgctcaacaagtgccgcgtcgccgagttctacctcccgtggaagtgcgagcccgagcgccacgcctacgagaaatgccagtacgagctcgtcatggagcggatgctccagatgcagaagatccgcgaggcgcaggaggccaaggtcaagggcggcgcctccattggcctcatcccggccaccgccaagctcgcctgatccttccccggtccgatccggttgatttaggtctgctggttatcacagcgtgcagaggcattgtgcaagaatcctgaatgtttgttgtatgaacaaacatctgttgaatttggcataaagttaactgttatcttctcctcatcccccttttctccttggtgggcatcttcaagtttcaatttgatggaataacgaaacctactgtcttacgcttgatgactgaatgacgccttgaagttttgaatgcaattcgtggacccttcatatgtagacagacctactttgtgctgtaggttatgtaatgacctacccgcctt

SEQ ID NO: 26626 - protein, 108 aa, Panicum virgatum; identical to SEQ ID NO: 12524
  misc_feature: Ceres CLONE 1871249
  misc_feature (1)..(89): Pfam Name: NDUF_B7 Pfam Description: NADH-ubiquinone oxidoreductase B18 subunit (NDUFB7)

SEQ ID NO: 26627 - DNA, 688 bp, Panicum virgatum
  misc_feature: Ceres CLONE 1871276
  misc_feature: Encodes the peptide sequence at SEQ ID NO. 26628
aaagctcgccgcgccgcagccaccccccaccaggccaccagcaccccgagtcccggagagaagcagatcggcggcgcgtcactccaacttccggtaagcttaaatggcgacggttcctgattctctgatctgggagatcgtgaggaagaataattccttcctggtcaagcagtttggcaatggcaatgccaaggttcagttcagcaaggagcccaacaacctctacaatgtccactcctacaagcactctggccttgccaacaagaagaccgtgactgtgcaaccggccagtggcaaggagatggcggtggtcctctcaacaaccaagacaaagaagcagaacaagcctgccagcctctaccacaagtctgtcatgcgcaaggaattccgcaagatggccaaggctgttaagaaccaggttggcgacaactactacaggcctgatcttaccaagccagctcttgcaaggctgagcgcagtgtaccgcagcctccaggttgccaagtctggtgtcaagaagaagaataggcaggcgaactaagtcacaaggaattgttttgatgggcgatgtttatgtttcatggtttctagatttggagcatgatggatgatgtgcgccgtacctaagactgccacaaatgaaatttcattgtaggttccaccttttgtacttgtacccatgacatga

SEQ ID NO: 26628 - protein, 145 aa, Panicum virgatum
  misc_feature: Ceres CLONE 1871276
  misc_feature (5)..(137): Pfam Name: Ribosomal_L28e Pfam Description: Ribosomal L28e protein family
  misc_feature: Useful for making plants with altered oil content
  misc_feature: Useful for making plants with modulated cold sensitivity
MATVPDSLIWEIVRKNNSFLVKQFGNGNAKVQFSKEPNNLYNVHSYKHSGLANKKTVTVQPASGKEMAVVLSTTKTKKQNKPASLYHKSVMRKEFRKMAKAVKNQVGDNYYRPDLTKPALARLSAVYRSLQVAKSGVKKKNRQAN

SEQ ID NO: 26629 - DNA, 686 bp, Panicum virgatum
  misc_feature: Ceres CLONE 1871297
  misc_feature: Encodes the peptide sequence at SEQ ID NO. 26630
ttcatcactcacgtagaacacagaaccagatctgttaatccaggagctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggtggccgggtacgtcgacgccggcaaggtgatgcggcgggtggcgcgccggacgggcaagcgggtggagccctggccctacgtcgtcgccgaccccgccgccgcgccgctcgcccgggcctcgtccaccgaggtcaggtacaccgccgccttcagcgacgagaaccccaacgccgcctgcgccgtcatgtagagctgcacgctgcctcgctcctgtagtagtaggagtagatggactaggaagttgctgctgtttcttggagcatttttttttctactttagtatttctctacgcttgtgctctggttcgattcgctgtaaaaaaagaagatggttttgattcctcagtggtagtaagtaggcttgaaggctagctagtagtgtttgttgccttgttgattgatgtatcatttctgaaaaagaagatattttga

SEQ ID NO: 26630 - protein, 130 aa, Panicum virgatum
  misc_feature: Ceres CLONE 1871297
  misc_feature (29)..(91): Pfam Name: HMA Pfam Description: Heavy-metal-associated domain
MGIVDVVSVFCALPRTRRHLKKRKEFQTVEMKMRIDCEGCERKVRKALEGMEGVSSVEVAPRQHKVTVAGYVDAGKVMRRVARRTGKRVEPWPYVVADPAAAPLARASSTEVRYTAAFSDENPNAACAVM

SEQ ID NO: 26631 - DNA, 654 bp, Panicum virgatum
  misc_feature: Ceres CLONE 1871340
  misc_feature: Encodes the peptide sequence at SEQ ID NO. 26632
atgcccggggcagagcacgagccgacggacgcgtttgacgcgcacatggaggccgccgtccggcggtaccagtccacgctcagcctgcccgtcacggggcagctcgactccgccacgctcgaccggatcatggccccgcgctgcggcgtcggcgacaacggccacggcgccacgcccgtgtccctgacggccgcccccggcgcggtcagccggttcaccttcttcaggggcgagccgcggtggacgcagccggacccgctcgtgctcacgtacgccatctcgccaacggccaccgtcgactacctgccggccgagaccgtgcgcgccgtgttccggcgcgcgttcgcgcggtgggcgcgggtcatccccgtgggcttcgtcgagaccgacgactactacgcggccaacatcagggtgggcttctacgtgggcagccacggcgacgggatccccttcgacgggccgctgggcgtgctcggccacgccttctcccccaggaacgggcggctccacctcgacgcggcagagcggtgggcggttgacatggacacggagacggcgcactcggctatcgacttggagtccgtggccacgcacgagatcgggcacatcctcggcctgcggcactcctcgtcgcccaaggcggtcatgtac

SEQ ID NO: 26632 - protein, 202 aa, Panicum virgatum
  misc_feature: Ceres CLONE 1871340
  misc_feature (65)..(202): Pfam Name: Peptidase_M10 Pfam Description: Matrixin
  misc_feature: SWISSPROT Homolog: EC 3.4.24.17 Stromelysin 1
MEAAVRRYQSTLSLPVTGQLDSATLDRIMAPRCGVGDNGHGATPVSLTAAPGAVSRFTFFRGEPRWTQPDPLVLTYAISPTATVDYLPAETVRAVFRRAFARWARVIPVGFVETDDYYAANIRVGFYVGSHGDGIPFDGPLGVLGHAFSPRNGRLHLDAAERWAVDMDTETAHSAIDLESVATHEIGHILGLRHSSSPKAVM

SEQ ID NO: 26633 - DNA, 323 bp, Panicum virgatum
  misc_feature: Ceres CLONE 1871356
  misc_feature: Encodes the peptide sequence at SEQ ID NO. 26634
tatctcttcaattttaagcctaatgactttagaggagtaccaatggattttatcatgaaattaattcctcagcatgccaagaagcaatgcgccttcttaggaatatgaggaagcagttcagagtgctcacaaaaagaagcaagcagcagtttggaggttacctgcctattacatcaatattgtgttgaaaactgcacactcccattcgcctacagcattattgcatgggcaatgcatgctgttttctttcacttcggctgtgatgctgcatggttgttctacaatgggggggagcactttcaccacattctgttaaagctgat

SEQ ID NO: 26634 - protein, 35 aa, Panicum virgatum
  misc_feature: Ceres CLONE 1871356
  misc_feature: SWISSPROT Homolog: EC 2.7.11.1 Non-specific serine/threonine protein kinase
  misc_feature: Useful for making plants with modulated water use efficiency
YLFNFKPNDFRGVPMDFIMKLIPQHAKKQCAFLGI

SEQ ID NO: 26635 - DNA, 564 bp, Panicum virgatum
  misc_feature: Ceres CLONE 1871360
  misc_feature: Encodes the peptide sequence at SEQ ID NO. 26636
ttacgataaatgataacttcttcccaggacatttccctgaacgccccataatgcctggtgttctcatggttgaggctatggctcaggttgggggtctggtgatgctgcaacctgaagttggtggatctcgagacaacttcttttttgcagggattgacaaagttaggttccggaagccagtgattgctggggacacattgatcatgagaatgactctgacaaagtaccagaagagatttggactcgcaaagatggatggaaaagcttatgttggtggtgacctagtttgtgagggggagttcctccttgtcagtgcaactgaatagtccaaagatatctagcactgcccaattcccttccagagtcattggctaggatgggaccaggttagtttcttgaaagaatcaagttttgagctaaacatacaatcggcatgaggcaatcctttacctgttaagtgtgttgagtccatgttcacacgatttctatcgcctaccagagcttaatctagctctattgctgttgtaatacaggattacagtatgtgaggtagttgtttgatgg

SEQ ID NO: 26636 - protein, 107 aa, Panicum virgatum
  misc_feature: Ceres CLONE 1871360
  misc_feature (1)..(99): Pfam Name: FabA Pfam Description: FabA-like domain
  misc_feature: SWISSPROT Homolog: EC 4.2.1.60 3-hydroxydecanoyl-[acyl-carrier-protein] dehydratase
TINDNFFPGHFPERPIMPGVLMVEAMAQVGGLVMLQPEVGGSRDNFFFAGIDKVRFRKPVIAGDTLIMRMTLTKYQKRFGLAKMDGKAYVGGDLVCEGEFLLVSATE
